United States Patent 7,560,542 (NUCLEIC ACID MOLECULE SEQ ID NO. 68811 AND OTHER MOLECULES ASSOCIATED WITH PLANTS) - sequence listing, part 11

SEQ ID NO: 64507 - DNA, 383 bp, Zea mays
  Clone ID: LIB3075-019-Q1-K1-A6
acagctggaatgcatgtcgacgacgattgtttcgagtttcgacttccaataagagtaacaacaaagcaaaggccttcctcccggcgtatttgctttggctcttctcctccacgccataagatatctagcaattggtcactcgccttaattagttcgctttgcttttgaggttgattcgaccattttgctgtaacgtgaattgcatgcatggacatgcaacgctccaatggcctttggaatgtggaatttttttccccattttatgtatttttcctataaaaaatgaactggttcttatataattcctctcagatccctgctgttcaaatgatatgaaagcagatactatattctgtgctgataaaaaaaaaagcgtggaatta

SEQ ID NO: 64508 - DNA, 415 bp, Zea mays
  Clone ID: LIB3075-019-Q1-K1-A7
caacatatatcttagatagtttaattttgtataatggatccaagatatatcaccctatgcatcttcctagtacttgtcttacatggagatacaactttggcagaaacttgcagacaatttgttaaatgggatccattctgctttagtgcaatgtgcaaggcaagttgttttatagagggaaaatcctccgatggttcctatgtaaaggggcacagatgtgaatcaaatggatatcatgctgtgtgtgtttgctttctgtgtaaaaattaggtatctaatgacatgcgaatctatcttcttttgatcctctccgacatctaggagtgttgtctaaataattatatggtaaaatagttaactagtatgtatactattagagttatgtagcactagttaactagtcggtatttcttca

SEQ ID NO: 64509 - DNA, 410 bp, Zea mays
  Clone ID: LIB3075-018-Q1-K1-H2
atttcccagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagcgaagaagtgaggagaaggttctacaagaactggtgcaagagcaagaagaaggctttcacaaagtatgctctcaaatatgaaaatgatgctggcaagaaagaaattcagctgcagcttgagaagatgaagaaatatgcttctgttatccgtgtcattgctcatacccaga

SEQ ID NO: 64510 - DNA, 429 bp, Zea mays
  Clone ID: LIB3075-019-Q1-K1-A8
cacaggtcacatggagggtgatagttctcaggcatatggtctcttgttcctgggtttcctttcctttcttcctggtttctacgagactcgagttgcttactattcatggcggcgagcaccagggtacacttttgcatccataccagattattagcctttcagtttgcgctgctgatgcagtaaggataatgaacaagcaaacaacttcaaactttccttgggaaccaatttcagtgataaaagagttaagcatgcatatgtagtggctcaaatgattgttgtgtttataggatgttattgcttcgtcggtcagtaaaagaataattccttgtgatattgtgtaagagcaaaggttgattttgcaatttcttggtatttccttgtcaaatataacagaaattagtgccaaaaaaaaatataaagaaataa

SEQ ID NO: 64511 - DNA, 422 bp, Zea mays
  Clone ID: LIB3075-018-Q1-K1-F6
gtgaccctgtcacagtgaacatagaagagaagctcaatgttgttgttaaaagagatggtggtattagtaactttgatgttcaaggaacacttgctcttcaggttcttaatgatactgatgggttcatccatttgcagattgaaagccaagatatgcctgggcttagcttcaaaacacacccaaatatcaataaggatttgtttaacagtcagcaaattttgggagcaaaagatccaaacaggccctttccgagtggtcaaaatgaaactcctctggtgaaatggagaatccaggggatggatgagtcgtctttacctctgtcagtcaattgctggccgtcagtatctggaaatgaaacctatgtgaacattgaatatgaagcttctgagatgtttgatctgcacaacgttgtcatatctata

SEQ ID NO: 64512 - DNA, 186 bp, Zea mays
  Clone ID: LIB3075-018-Q1-K1-F7
catgcactttcaccattcacatatttcatttacaccaatcatcttcacaaaagagcgcatgatcctataaactttgccctggaaaacactcttattattaaacctcttactcatactcatagcactatctactttcaccaataaatccaacacatcccatttctaaccttctcaacacactcaaat

SEQ ID NO: 64513 - DNA, 435 bp, Zea mays
  Clone ID: LIB3075-018-Q1-K1-F8
ggaagatcggtgtcctgaagcccgttttcacgatctggtctggttgctgagaggtatattgatatcaaatacaggtggttttatgatatcaatggggcattttgaagctgaaaactctgctaacctacttacctgcaactaacaaaaggtcacctatatatcaggaaaaaagaaagcaaagcctgtagtgtgtcgctaatctataccatggagcaaaaggacattgcagtatgcctgccacttaattgtgctgcgtataaactatccaacgtattaggtcgtgctgtaaacaatgtagaactgtacctgctggacggttaccatgtatataaagatgaagtgtttaactgatgtgaagattgatggatatagtacgtcctctctttgccataagcgtgttgcaaatagtgcttttgcaatatatcccaatggaca

SEQ ID NO: 64514 - DNA, 166 bp, Zea mays
  Clone ID: LIB3075-018-Q1-K1-F9
aacagggccaacagagatcttgttcatatttcattactttcaatgcagaacaagttctgggcgtgggtatttgtaccattgcgacatcacactgctagccatgttctgtatcctgttgtgtggtaactgggaaacattaaatattgacataccgttttgatttttt

SEQ ID NO: 64515 - DNA, 346 bp, Zea mays
  Clone ID: LIB3075-018-Q1-K1-G1
cccacgcgtccgcccacgcgtccgcccattcgttcggatggcggcgtcatcgtcaaccggcacgtaaaccaactcgatcgatcgcgtgcgactgcgagccgtccgtccgtcatggcggacgtgctggtgggctccgagcgccgtgtcctcatcagcggctacgggtacggactttccccgcagcccccgcccccgccgtcgccggcagagagccagctgctcggtcgcctcgatcacatcgatctacggctgcggcagctggaggagcagcatcagcgccgtccgttgcacgccgacccggtcccggtcacggccctacgagcgccggcggcgcaggaccagcaca

SEQ ID NO: 64516 - DNA, 350 bp, Zea mays
  Clone ID: LIB3075-018-Q1-K1-G11
gttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatggagctacagcgggaaatccatgatgagcgaattattctgaaaggatcaaatcagtcaagccttaaca

SEQ ID NO: 64517 - DNA, 371 bp, Zea mays
  Clone ID: LIB3075-018-Q1-K1-G12
caaagacgagtttaggaaagtgatgacactgatgcgatcctataatagacaaggagctgcccatagggatggtttacgctttggacgcaaggttggtcagccagtggaaaatggtggactggtcgaatacttctttggcaaggatgggaatgaacatctacactatgataagttctctagttttttgaagaaattgcatgatgagattgtccgcttggagtttagtcactacgatgtgaaatcatccaacacaatacctgttaaggactttgcgttatccatggttgcttctgctgatatgatttacatagacaagttactggatagagttgaggatttggacgacaatcttgacctcaaggatctgcgta

SEQ ID NO: 64518 - DNA, 439 bp, Zea mays
  Clone ID: LIB3075-018-Q1-K1-G2
caaaaaatggaactttgggaagaaaatctcagtactgccgtgagcctcgaagtgttgggaataactgagaagttttcagttgctgcaggcgctcgaagcatcactactgattacgcgaagctagattgtgtaacatcaatcttaatgggtcttttatctaggaaccaatccttggctttttggaaggctttccttcctgtggtctacaatatatttaatgttcatggtgcaacactaatggcaagggagaatgaccgcttcttgaagcaaattgcttttcatcttttgcggcttgctgttttccgaaacgattcgattagaaaaagagctgttgttgggctgcagattcttgttaggaactcattcaactatttcaaaaacactacaaggttaagggtcatgttgacaattactttgtccgagttgatgtccgacgtgc

SEQ ID NO: 64519 - DNA, 380 bp, Zea mays
  Clone ID: LIB3075-018-Q1-K1-G3
aagacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggtggcggctgctggtacaaggacgtgaacaagccccccttcaatagcatgggcgcatgcggcaacatccccatcttcaaagatggtctgggttgtgggtcctgcttcgagatcaagtgcgataagcctgtggagtgctccggcaagcccgtggtggtgcaca

SEQ ID NO: 64520 - DNA, 415 bp, Zea mays
  Clone ID: LIB3075-018-Q1-K1-G4
cttgggtatgaggattgtctgacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcaagggaaaccttgacgggcagggcccagctgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcattcacatgggc

SEQ ID NO: 64521 - DNA, 365 bp, Zea mays
  Clone ID: LIB3075-018-Q1-K1-G5
tgttaatggagggcagatacatggtcttaaaaaccttggttgttcttcggtacctgatgctcagccatcaggttgcccatctgagtctgttattagtaggaggaggtttgagttcatgagaaagagggcctttgaccaggaaagctcttccagatcagtgaacttaagcttaggtcattcaactcctacagatattcgcagaatcagaatgaatgaacaatcactttgtcaacaaataccacgaagcagcagcagaagccatcaggaatcggcaggttcagttaggacaagacgaccttctcctcatgccactaggatgagtgttcctgatggaagagcagatggcgtgctttctctgcacgagt

SEQ ID NO: 64522 - DNA, 390 bp, Zea mays
  Clone ID: LIB3075-018-Q1-K1-G6
ctttgttctccattacaaagatatattattgaagtgttaagccttatatgctgagggagagctgataaatttcagttgatgcaactagctaactagatgcaatactgattacacgtatactggatcgaggcacatcaaccttaatgggcctcttatgtacgaaccaatgcttgacttattggaacgctatggttcctgtggtctaaactatatttaatggaaatcgtgcaacactcatagctaaggagaatgaccgcttattgaagcatattgattttcatcttttgcgaataggctgtttccgaaacgatttgattagaaaaagaactgttgatgggctacagattcttcgtatgaactcattcaactattgcaaaaacactacaaggt

SEQ ID NO: 64523 - DNA, 408 bp, Zea mays
  Clone ID: LIB3075-018-Q1-K1-G7
ggcggccgaggtcaccaaggcctgcagcgtcacctgcgccaaggagaagaacccgcgcctcagcgagaactgcaagaggtcctgcacccctcctccttcttgaagcgaagccccttgaaatgaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgttttttttccaaatataccgtcgatggaactccaaatgtaatgtcacgcaaatgtgtgtttttcatcgattgaatggattataataaaaagcatgctggcaggtactact

SEQ ID NO: 64524 - DNA, 276 bp, Zea mays
  unsure at all n locations
  Clone ID: LIB3075-018-Q1-K1-G8
gaaacaacaagactgacagcgacgatgatgccacagctgcgtagcctcgtcgcgctgggcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgncacttcgagtcgcagcaagtccacgacaaggcggaagcgacgacgggccccggcggctggtacaagatggagatc

SEQ ID NO: 64525 - DNA, 58 bp, Zea mays
  Clone ID: LIB3075-018-Q1-K1-G9
gtggactgtagagagcacacgatttacatgtacagaaccgttgcttcctgattgcttt

SEQ ID NO: 64526 - DNA, 333 bp, Zea mays
  Clone ID: LIB3075-018-Q1-K1-H1
actgaacagcagtccgagacgccatgaacgtggaggaggaggtcgggaggctcaaggaggagatccataggctcggccagcagcagcccgatggctcttacaaggtcaagtttggcgtcctcttcaacgacgaccggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaagcgaagagcaccaccaagttctcgattccatacaactcgtatgct

SEQ ID NO: 64527 - DNA, 370 bp, Zea mays
  Clone ID: LIB3075-018-Q1-K1-H10
gatgcggtaaaagcgaaagaagaatccgatccgcttctccacgccgaacccggtaaggccgccgccgcttctcgaatggcctcaacctcctcctcctcgcctcagccgccgccggcggcggcggcagcgtcgcccggggcagcttcctcgcccgaggatcgccgcgcaggtggaggccgcggcggcccgcccccggtcccgccctatgtcaaggcggcggcggggtccctgggcggcgtcatggaggcgtgctgcctgcagccgatcgacgtcgtcaagacgcggctgcagctcgaccgcacggtggcctaccggggcatcgcgcactgcggcgccaccgtggcccgcgccgagggcgtgcgcgcgctct

SEQ ID NO: 64528 - DNA, 310 bp, Zea mays
  Clone ID: LIB3075-018-Q1-K1-F5
aaaaaaaaaaaaaaataaaaaaaatttattataaaaaaaaaaaaaaaaaaataaaaaagcaaggaaaaaaaaaaaaaaaaaaaaaaaaaaaataaaaaaaaaaaaaataaaaaaaaaacaacaaaaaaaacgggcagtcccaaaacatttcacccaactttaacaaagaattcttttaactctaaacttacatattattgaaaaccaaattaaattcattcccataacaaaaataacagatatacatacaaaaactctaacaaaccccactttaataacattgactcattcaggaacattcccattttta

SEQ ID NO: 64529 - DNA, 215 bp, Zea mays
  unsure at all n locations
  Clone ID: LIB3075-018-Q1-K1-H11
tcgcgacgctggggttctagatccgngcttctttcgcgactagaaccacctatctgggaatcgntgcatctttcttggaatcgtcctggtgtacggtgaaccgaacaaccctgaaaaagatcatgtctacaaaaaaattgattatactcggagtttgaatatccatgatagcagcaaatctattaagggtgtacctcttcctagaatttcgtctg

SEQ ID NO: 64530 - DNA, 265 bp, Zea mays
  Clone ID: LIB3075-018-Q1-K1-H12
cgaaccttctaataagtgggccactcttcctcacatcgcctccctcgacgatggccggcgccaccgccgtcgccgccacggcgtcggcttcgcgtcttctccggaggtctatatcctctgcattcctcgcgaggcgcgcggtccctaacattccgggtacaactctctggtattccttcttcgcattccgcagacttaaaccaacgccggccctgtcttcgcctgacaccttcggcaatgattgaagccgccggattaggtggga

SEQ ID NO: 64531 - DNA, 358 bp, Zea mays
  Clone ID: LIB3075-018-Q1-K1-E1
ctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcggagcagatcgagtggagcaagatccagaccccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctgtcattgaagtccgcaatgggttcacattc

SEQ ID NO: 64532 - DNA, 310 bp, Zea mays
  Clone ID: LIB3075-018-Q1-K1-E10
cagcgagcgaccgcaccggcacggcgcttatctatccatcggcattctctagcccaggcgaaaggaaccctagccatgagcgccgcctccaagaagctcttccaggccgccaggtccctcgtcctctccgcttctaaccgctccgtcctcgccgtcaatggccgtaccgacgcgctcgccacgctcaccaactttggcaggaagacccttcccaccgactacttatcctaccacaagcagggatcccaccatgccgcgtcggcgtggtgagccatcgccgtagcagtcccagctgcagtttacatgctcc

SEQ ID NO: 64533 - DNA, 432 bp, Zea mays
  Clone ID: LIB3075-018-Q1-K1-E11
cggacgcgtgggttcggcgtccgcatcaaggcgtacgaggacgccgcctccgtgctcaccgtctccaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagacccttcatcgactgacccatctctctagttataatttttctctc

SEQ ID NO: 64534 - DNA, 319 bp, Zea mays
  Clone ID: LIB3075-018-Q1-K1-E12
gaaaggctgggcgactacctgctcgaacaggtgatgtaacaacaaccccttaccctggaatgcatgttgatgatgttgctggttccaacttcgttttcagtaataataacaacaaagcgaagaccctcctacctaccctatttgcttgagcggctcttgtccgcgccacaagataccaattgttgcgctgggaatattcagttacgatgacccgctttagttcagctttttttttgggggggttggttccatcatttggctgtagcgtgaatcgcatggacaacagactccaattactaagcaaatatttttcttctgc

SEQ ID NO: 64535 - DNA, 431 bp, Zea mays
  Clone ID: LIB3075-018-Q1-K1-E2
cccagaagaagcaagagaaggaagaggaggaggaaaagctaattctgcagaaggctaaggagttggatgcctttgatcagcagaatcatggggctgttccccagtaccatgatcgcagtggttcccaaggcaagaatgggtttcatggagcgaacagtgtgaaggtcacttcttttgaagaggaagccctccgtaacatgaaggcattctggcttccttcagctactcctgaagctacggtcaaggtagatgcaccctccgccgacactgtctgccctgaggggcaggagaagctcaagttgaaatcgctcttccctatctcatttatggaagaaactgctgatccgaagaggaagaaggcaatggaaaagagctatatgtgccctagttgcaaatccactctcacaaatacaatgtccctcgtggcggtc

SEQ ID NO: 64536 - DNA, 412 bp, Zea mays
  Clone ID: LIB3075-018-Q1-K1-E3
agcgctctggagaaagcaacaacgaacccgactgtagtacacgagcacaaagcatgactgacagacggatacttctgctcatcagattgcactaacttcattggagaacgttctgacaaccgagtctaatggatatgatattaatcagaggaaaaatcgttattatgagaggagtcctttcgatgacagtcatatctgcagaggagttgccacctatggacattgacggcaaggctgacccatttgtggtcctgtacttaaagaacggcgaaaccagccagaagacaatggctgagacagacacgctaaatccaatatggaaccagacatttgatttcatggcagaagatgcactgcatgatttgctcatggtggaagtatcggaccatgatacatttggaaaggattacat

SEQ ID NO: 64537 - DNA, 403 bp, Zea mays
  Clone ID: LIB3075-018-Q1-K1-E5
tcggtggtcaggttcacctggagctcctctactacccttacgcgaagcatgaaggggtgcctgaaccttttgctaatcagattcaactaacttcattggagaaggttctcaaaaccgagtctaatggatatgatattaatcagaggaaaaatgttattatgagaggagtcctttcggtgacggtcatatctgcagaggagttgccacctatggacattggtggcaaggctgacccatttgtggtcctgtacttaaagaagggagaaaccaaaaagaagacaagggttgtgacagacacgctaaatccaatatggaaccagacatttgatttcatggtagaagatgcactgcatgatttgctcatggtggaagtatgggaccatgatacatttggaaaggatta

SEQ ID NO: 64538 - DNA, 420 bp, Zea mays
  Clone ID: LIB3075-018-Q1-K1-E6
cgacaagatggcgtgcacaaacaatgcgttgagagccttgttcctcctggtcctcgtcggcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcatgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacctggtcatcaccggcatgggaaacct

SEQ ID NO: 64539 - DNA, 268 bp, Zea mays
  Clone ID: LIB3075-018-Q1-K1-E8
gacccattcgttcgaacacccatcccacgtaaccaagattctttcctagctgaccttccaacaactgtgggctgctgtgtaaaaatacctaaccctaacgatggtttattatgatgtacaatcatcgaaagatataccacctggagatcccaacaagcgtgcatttgcttactatgtcctgagtggtggtaggttcatatatgcatcactgttgcgtctcctctcattgaagattgtccttagcatgttatcaagtaatgacattctt

SEQ ID NO: 64540 - DNA, 231 bp, Zea mays
  Clone ID: LIB3075-018-Q1-K1-E9
caaaaaattatggcctggcttagatgattgcgagatgttaggacatgccttgagtttcagatagagaccaacctgtggtgccttccgcatctaagggatagccaagaacccgcaaattctgtagcattcttccagctttgaggcaggtagttcttagtggaggatcatgtgaccagctatggattcagtagtacaatgaagatggccaatggatgaaaattgtttcgcgag

SEQ ID NO: 64541 - DNA, 406 bp, Zea mays
  Clone ID: LIB3075-018-Q1-K1-F1
ccgcactaatccaagacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgatgacaacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagccccgtgtggtgcacataacggacatgaac

SEQ ID NO: 64542 - DNA, 353 bp, Zea mays
  Clone ID: LIB3075-018-Q1-K1-F10
aaatcgagtccctgaacaagaagtatggatgtaatgtccctttacttctgaggaactgtttgaatacccatgatgacccacagaagatcgttgagaagttttccaactccaacattgaaattaatcctttcaatcagagccagtatcctcgaattgttaccgaggacttttggccacttccaagcaaagggaaatctggaaaggatggctggtatcctccaggccatggtgatgtgttcccctctttgaataacagtggaaaactcgacatcttatgggctcagggcaaggagtatgtcttcgttgctaactcagacaactggggtgctatagtcgacatcaagatcctgaac

SEQ ID NO: 64543 - DNA, 328 bp, Zea mays
  Clone ID: LIB3075-018-Q1-K1-F11
gcgagtaccaggcggagcacgcggcgcattgcgtcaaggacaccgccgcagccgcggccgacagtgcgcagctgcagcagcaccgccccaccggcaccgttgagcaggtggcgcagacgggccagggcgtggcggcaggcgtcaaggacacggtggcgggcgcggcggttggcgtcacgaacacggtggcgggcgtggcggcgggcgtcacgaacacggtcacgggcgccgtggcgggcgtcacgaacacggtgaccggcgcggcggctggtgtcaaggacaccgtgaccggcgggcactgatcgacgacccaagaatgcttcatgca

SEQ ID NO: 64544 - DNA, 431 bp, Zea mays
  unsure at all n locations
  Clone ID: LIB3075-018-Q1-K1-F2
ctgaaacacttgtcccaggaaaccaagatgctggcctagctgacctcccagcaactgtggctgctgtgaagaatcctaaccctaaggtggtttatgatgagtacaatcatgaaagatatcctcctggagatcccagcaagcgtgcatttgcttactttgtcctgagtggtgggaggttcatatatgcatcactgttgcgtctcctcgtattgaagtttgtcctgagcatgtcagcaagtaaggacgtgcttgcccttgcttcactcgaggtggacctctccagcattgagccaaggaccacggtgactgtgaaatggcgtggaaagccagtcttcatcagacgccggacggacgacgacatcaagcttgccaacagtgtggatgtggcatccctgcgccacccagagcaggatgcanagcgtgtgaagaat

SEQ ID NO: 64545 - DNA, 342 bp, Zea mays
  Clone ID: LIB3075-018-Q1-K1-D9
cggacgcgtgggcgcgaaggcacctagcagccgccactcgccgaactgaggaacacgcctggcgacgggatacagcagcagcgcgcccctctatccccgacgcgacggcgccctgcagctgcagataaacctgttccaatgggcaaacaaaaagagggtgtggacaaaagaactgctaggaagatgatccgatctacggaaggctgtgcaaagagcattactttcgagaggaacaacaaatcagacgatgtgcagcttcacgatctgccgaatgacatcctacgtagcatactatcacggttgacattcagagaatcctcacagatgggccttgcttctcat

SEQ ID NO: 64546 - DNA, 254 bp, Zea mays
  Clone ID: LIB3075-018-Q1-K1-F3
attgcaccgacggcgaccgcccccaattttcttctaacccttcggcttcaattaagtcggcggggtcccaggttccttggcctgggtaaccattattttattaagccttgtgcccaaattggacgcaaggacttccgggcggaattccttgagccgagccaatttggataccggttggccacatagatatccgaggacaccacacccaaggggccgagccaaagtgatacggagacaaatctcccgccggtgtt

SEQ ID NO: 64547 - DNA, 424 bp, Zea mays
  Clone ID: LIB3075-018-Q1-K1-F4
cccacacgtccgcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcagtggcggctacggcggtcggcgcgagggtggtggcggcggctacggaggcggtggcggctacggcggtcggcgcgagggtggtggtggcggctacggcggcggcggcggcggctggagggactgatgtgt

SEQ ID NO: 64548 - DNA, 407 bp, Zea mays
  Clone ID: LIB3075-018-Q1-K1-C4
gctgcctgcctgtccttctcctctcctttcctctccccgcgcccaacagcctcacatgtgcatctgaaaagttgagaacgacagttcctgagcacagggcgcgatggacgtcccggccgtggcggaccctggaacggagcgaggcgaaggcgcgctgatccagtgcccgtactgcgactcggaggcgatgcacaagctggcgcagatcctcctcccgggcctcgccgccgtctgcgtggacggcaccacgggggacccgttccgcagcccgtccgcggtggccgtggacctccgcaaggagatggtggactacatcacgcagcggagcgacagcttcatcgcggacgcgctgatcgagtcggaggcgaaccaggacgcgcccggggccgaggtgcccgacgacccct

SEQ ID NO: 64549 - DNA, 350 bp, Zea mays
  unsure at all n locations
  Clone ID: LIB3075-018-Q1-K1-C5
ggacagggctctcgcgacgcgatcggccatggcggcgtctctgcgggcctcgtcgtccgtccgctcgcgcctcctctcgttctcctcggagtgttctctgtgtccgtggcgtctcctcctctcctcacctgtccactcggacgccccccaccagaccgaaaccctcgctttcgacgagatccagctgtcgccggagaagccggctaccgncactgccttcgtcctgcacggnctcctcggttccggccgcaactggcgctccttctctcgcgccctcgtctccgaactccgtaaccgatccccttcagacgagtggaggatggttctcgtggacttgaggaaccatggca

SEQ ID NO: 64550 - DNA, 351 bp, Zea mays
  Clone ID: LIB3075-018-Q1-K1-C6
cattcactaacccaagacaaaacatggatgtgaatgtgagaaccatgtggtcgtcgatgcgggcacaggttgcgatggctgtggtgttggtgttcttggtgagcggcgcatggtgcggtcctcccaaagtccccccaggcaagaacatcacggccacctatggcaaggactggctggacgctaaagcgacatggtatggcaagccgactggtgccggtcccgacgacaactgtggtggctgcgggtacaaggacgtgaacaagccccccttcaatagcatgggcgcatgcagcaacatccccatcttcaaagatggtctgggtctgaggtcctgcttcaagatcaagtgcg

SEQ ID NO: 64551 - DNA, 164 bp, Zea mays
  Clone ID: LIB3075-018-Q1-K1-C7
gcaaagctatatatgattctatggtataatgtgtggttgcggcaaacgcgcggaaatgatgtgcttgcgtgattggttttctctctcttttttggttaaataatgtaaacaatgcataccggcgatggtttaacatggtaactgagaatgtggtactctttctc

SEQ ID NO: 64552 - DNA, 408 bp, Zea mays
  Clone ID: LIB3075-018-Q1-K1-C8
gcgcgaggtgcggcgcctccaccggctcgtcggaaacgccgtggtcgatggataccatgtgatcgtcgggactgggtccacgcagctgttccaggccgtgctatacgcgatctcgcctgcaagtgacggcacgcccatcgacgtcgtctcgccggcgccttactactcgtgttacccagttgcgtcgagctttctaaactctgggctctaccgttggggtggtgacgccaatacatttgccggcgacgacaccagctgtgttgaggtcgtctgctcgccaaacaaccctgacggtggcatccgacatgccgtcgtcaagtccaaatccagcaaggcgatctatgacttcgcctactactggccgcagtacacgcccatcaccgaggcggcttgccatgatgtcatgct

SEQ ID NO: 64553 - DNA, 427 bp, Zea mays
  Clone ID: LIB3075-018-Q1-K1-C9
aagacaaaatatgcggttcctgtttacttagaagttcgtgcaagtttgtgaaccgggaagtggccaggcataatagagtgattctatcagatacgatgagaattatctacttgtttgtactggacgcttgcccacaagagctcgagattaccgatgagttaaaagccagtgtctgcaagctgctaaaggacgccataaatctcagcagttaactgctgagcattacggagcataagtttgctagattacttgtccttgtagttctaatagcgtgctgtcagcatttatctggacttatggaggaaattgccgatgcccatgtttgacgtcgcgctcgcaatcgctccctgtgaaggttggagtggtgaaccccagcgacttccttctgatccgtgttttcttttgtgcaactaatatgaagatgaag

SEQ ID NO: 64554 - DNA, 410 bp, Zea mays
  unsure at all n locations
  Clone ID: LIB3075-018-Q1-K1-D1
ctcaggcgaagatctacggcaaggccatggagcagctgaccgccgcaatgggcgcctgcgagagctgcgaggacgcgtggaagggcgaggaggaggatgtccccgtcgccgcgcacgacagggagtacggtcggatggcgcacatcgccttcggattcacacaccacgccgccgtcgccgccgccgccgcatgaatcgattaattattatatatatatatgcatgctatctactatgatcgatcgcttctcgaccttcttgcatcgatctgcatgcatattataacttatattatattgatgccacgccgcatgcaggtctttccaaggcgtacgtactatatcaaattatnttaatgtccttacatgtatatgtatgtgctgctgatggatacgtacgtatatatatat

SEQ ID NO: 64555 - DNA, 340 bp, Zea mays
  Clone ID: LIB3075-018-Q1-K1-D10
gtcagggtcaaggacgggcacaagatgcccgatgcgcgcgacgaggacaggcagggcctggtcctcaactgcctagaggcgccgcttgacgtcgacatcaagaacggagggcgcgtcgtggtcctcaacacccagaacctgccgctcgtcaaggaggtcgggctcggtgctgaccttgtcaggatcgacgcccactccatgtgctcgcccggcttctcctgcgactccgcctaccaggtcacctacatcgtgcgcggcagtggccgcgtccaggttgttgggatcgacggcacgcgagtgctcgagacccgcgccgagggaagctgcctcttcatcgtgc

SEQ ID NO: 64556 - DNA, 428 bp, Zea mays
  unsure at all n locations
  Clone ID: LIB3075-018-Q1-K1-D11
ctcggaggcagcgacgcgcgggtggaggagctcagtgacagcgccagtgcctatcgagctagcgaatcgaggagattttccccactgtttctttcctgctgattccgatttcacgttgaaacaccggggggagaagaattgcgggcgaccataactcggcaagaagcggctccaaaaagggcatctacctttgccgattccggcaccgatggataccgcggcgtcggggaggttcgacaagctccagagctcgttcaagctctccatccagtgcctcctcacggcctgctcccgcgaggatgtcaatgacgctttctcgtccttcactgatgctgagaaggagcgtttgcaccggatgctcacccttgtgatgaagaatctgcatgccaacgtantggatgagtttgacgactttctgccagaaacac

SEQ ID NO: 64557 - DNA, 309 bp, Zea mays
  Clone ID: LIB3075-018-Q1-K1-D12
cccacgcgtccgcggacgcgtgggaagaaatatgaaactgcccagttccagtaagtttagctctagatctctagaagaaaaacaaaatcagtgcacagctgcctgctcaaatgatgcaacacaaaataaaggtggtttgagggaaagcttgtgggtaactcggcttttgccaaaagcatcagtagaattgatggaggcaacaccatgcaatgtagagaatgctgttagtccacaggctgtgggtgacaagttgtgttgtccacctcttcagaattttaatttggagaaggaaactaataatatacaata

SEQ ID NO: 64558 - DNA, 381 bp, Zea mays
  Clone ID: LIB3075-018-Q1-K1-D2
cacaggacttactgacgaaaagattaggagtaacttgaatcaacggaaatgtgtcttaaaagcattggatgatcctctaacaagtgttgtaccatgctgggtgcgccaggaagacgatccggaaggctagtacctggacatgctggattgtggtcatgactgtgaaacagcatgtgtcaaacaatggctggttataacagacctgtgctgaatttgcaagaatacaggactggacacctagaaacattgatgcctttacccttatgaataagcctaccgactctgggcaagtaggttacatgtaacatacacgctgccatgactagcatagtatgttacagctttcccatgatcatcatacatgttggaatctatactata

SEQ ID NO: 64559 - DNA, 234 bp, Zea mays
  unsure at all n locations
  Clone ID: LIB3075-018-Q1-K1-D3
cgaggaaccgaatgcccagtctcacgtcttcacccgtgctcgtgcgctgcgcccatccgttccgcctccacgctccccacgtgcaccgtgcaccgtgcacagcaccacacagccaggtccccatggcggcggcggtggcggttgcgtctgcgacgacggcggaagacgaagcgcgcctgctgcgcctggaggagcangcggagcacggcggcggcngcgcctgggaatacctct

SEQ ID NO: 64560 - DNA, 437 bp, Zea mays
  Clone ID: LIB3075-018-Q1-K1-D4
gcacgcagaggagcaggaagccggagactcaagatgtcgtcggtgttcagcggcgatgagacggcccccttcttcggtttcctcggcgccgccgccgccctcgtcttctcatgcatgggcgcagcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcactgggatcaaccccaaggccaagccctactacctttttgatggctacgctcacctttcgtccgggcttgcctgtggccttgctgggcttgcagctggcatggccatcggcattgttggtgatgctggagtcagggcgaatgcacaacagccgaagccttttgtgggcatgat

SEQ ID NO: 64561 - DNA, 367 bp, Zea mays
  unsure at all n locations
  Clone ID: LIB3075-018-Q1-K1-D5
ggtggttgaggccatgacctgcggtctgtccacgtttgccacagcctacggcggtccggccgagatcatcgtgcacggcgtgtctggctaccacatcgacccttaccagggcgacaaggcgtcggccctgctcgtggacttcttcgacaagtgccaagcggacccgagccactggagcaagatctcccaaggcgggcttcagcgtatcgaggagaagtacacctggaagctctactcggagaggcttatgacccttaccggcgtgtacgggttctggaagtacgtgtccaacctgtagaggcgcgagacccggcggtacctggagatgctgtacgcgctcaagtaccgnaccatggccagcaccgtg

SEQ ID NO: 64562 - DNA, 439 bp, Zea mays
  unsure at all n locations
  Clone ID: LIB3075-018-Q1-K1-D6
gtctcgtccccgcacatcagcagagagacgccactaccaccaccgcaagcgacgacggggagatgtttctgcgacggatcctgaccggcggaggtggcctggcggcgctgagggcggcgcgcgccgtgaaggagacgacggggatcgtcggccttgaggtggcgcccaacgcgcgggaggttctcatcgggctctacacgcgtacgctcaaggagatcgaggccgtccccaaagacgagggctaccgcaaggccgttgagtccttcaccaatcaccgncttcagatctgccaagaggaagacgactggaagcgcatcgaggaccgaatcggatgcgggcaagtcgaagagctcatcgaggaggccgaggacgagctcaagctcatcgccaaaatgattgaatgggatccgtggngtgtccctgatgactacgaatgtga

SEQ ID NO: 64563 - DNA, 375 bp, Zea mays
  unsure at all n locations
  Clone ID: LIB3075-018-Q1-K1-C3
ggactgcaattgtcaccttctggtgatgccatggtagatatatctaataagccacccagctgccaagacgtaaaggaggccccgagcagtgacattttgggaaatgatgaaaattcagacaccgagaagactcctgctgccttgcatggacggctgaacaccgaacttgctcctagtggcagaaatacagaatttagtgaagctgacactggagaacaagagacacccgtgtctgctgaggctatggtagaatcatcgagcgagcctcgcagccatgaggcanaggaagctncaaccccctgacctgtcntgggatgatgaaaaagcgaagtcagcaagggctgctgnntgtgcggaactttttggagatgcaac

SEQ ID NO: 64564 - DNA, 394 bp, Zea mays
  Clone ID: LIB3075-018-Q1-K1-D7
gacaagatggcatgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaccatggtaattggatcgagattctacgcgtggataacc

SEQ ID NO: 64565 - DNA, 437 bp, Zea mays
  Clone ID: LIB3075-018-Q1-K1-D8
gactacttgatcatcgttagcctgcctttcgctgattttcagaaggtgaacgtttgatggaagaacactctcacaaatgggattgttaacgtatcatgcactagcgtaggtcggatgccactcctgaaaaggcatgatcggactttcaggttggcggatcctgctcctgagcattgaccacccggagagtttgtccgggacatcccactccctacccgaatccctgaagactccactctggaagcgtactgcgatgaaacaggcacagtgctgtagatcattgtcccgaagtttcgcgttggccctgaagaacacgaagtgcatgtgtacatgaggtcaccctcgtactggtgccaatgaaacctgtttccaagcttgcgctaggagacacgcatacggtgtggagctatgccgtaaggctaaagctactgcacaac

SEQ ID NO: 64566 - DNA, 352 bp, Zea mays
  Clone ID: LIB3075-018-Q1-K1-A6
cacgacccccaccgcccaccagtgatctttccgccgcgacgcgaggcaccgcggccggggccggccgccttcctccagaaagtatcacccgtggtcccgtgcgcccgaatcacctcttaatttcgttcttagccgctgcgtttcacagaggtcgcgacatgcccacctcggcggctcctcctgcccagcccgcggcaccgccccctcctcctcctcccgcttctcctgcccctccggaggatgtggaggcgactgccggttcaccttcgagggcttcagcagtggggacggtgaactggggaacggtcaccctcgttggcgtcttcgctgggctgctatacggcgggaagca

SEQ ID NO: 64567 - DNA, 429 bp, Zea mays
  Clone ID: LIB3075-018-Q1-K1-A9
aaaagactctataacaggtacaagccttttgtttgtcagtattcgatcactgggctatagttcctggtgatcccttagataagagtattgtccttcgccctctggagccagcacctatgcagcaccttgcccgtgagttcatggtaaagaccaggcgaaggaagggcatgagtgaagatgtgagcatcaataaattcttcgacgaggccatgatgaatgagctggcccaacaggctgctgatatccacttgcaaatgatgtagtcaaaaagcgagatgaagtgcacacgtggaagatgcatatgccctcagcttcttcataccatacatgctgcagatgggactgccggagttccagtcgcacctttatgctggcatttgcccctacctgtttcgctttgattaacacattatgattgctgggtatcat

SEQ ID NO: 64568 - DNA, 354 bp, Zea mays
  unsure at all n locations
  Clone ID: LIB3075-018-Q1-K1-B1
gcctcctacattgaccaacaactaagcctccgtgaccgccacatctattaggtgcagccatgggtgcctgtgcaacgaagcctaagacgcttgaggggaaagccccagctgaggccaccatctccacacccaaggttgcacctgagaccactgccatccacattgaggttgcggcgaaacaggcagtagttgagaaggtggaggaggacaaggaggaggcactaacagtggcggcgaaacaagagccagcagccaccatcgagcctcaacagattgctggtgaggtgaccacttcggaagtggcggtcgtcgttgtcgagcctgagaacaaagaggangaggaaagtgtggaga

SEQ ID NO: 64569 - DNA, 325 bp, Zea mays
  Clone ID: LIB3075-018-Q1-K1-B10
gaggaattcattacagtcggccgccttttctttctccctcacgtcatctggtcaactgggcggtgcctccatacgcactagcgagctgcctcgacctaatcactggtgccttacctgttgcagctattgcgatggcaaagatggacaagctttccaatgcaagggttaaaacagctggatcaatggctgcctggacagcacacacttctctacatgtggataccagcggcacatatgttgacaaattaccttaacccacgtaacactaaacggctgtcagctttcagcatgtcgattgcaatgctagccaacggacatatgattt

SEQ ID NO: 64570 - DNA, 396 bp, Zea mays
  Clone ID: LIB3075-018-Q1-K1-B11
atctacaagcatgctgtgcctgttccgaagtctgagtgcagcaagactacccagttgggtattagctttgctggtggttacgttgccggtgtcttctgtgctattgtttctcacccggctgacaaccttgtgtctttcctgaacaatgccaagggagctacagtgggagatgctgttaagaagcttggtctctggggtctcttcactagaggacttcctcttcgtatcgtcatgattggtacccttactggtgctcagtggggaatttacgatgcattcaaagtgatggttggactcccaacaacgggaggtgttacacctgccccagcagcagaggctggattgaaagccagtgcttgattttttttttctgtgttccctgagatcatatttggt

SEQ ID NO: 64571 - DNA, 330 bp, Zea mays
  Clone ID: LIB3075-018-Q1-K1-B12
cggcccgagccacgcgtgggaacgacatcaggaacgcggcggttttttttactcatcggacccggcacggtgtggggggcgcgcggctgcgctggcgagcgcctgcatcctctacaccaaggacgtgctcatcgggcagagcccgaccccggcgttcgacagcccgccgtcggagaccgtggccaacaaggcaggcggagggccctgttggagagagctcctggagccgggtgtcaggcgcgcgctcttctgtggcgtcatgattcacatcctgcagcagttgtctggcatcaatggtgtgatgtactacacgccccacatccttgacca

SEQ ID NO: 64572 - DNA, 354 bp, Zea mays
  Clone ID: LIB3075-018-Q1-K1-B2
cgggagcacagagctagctagccagccagccagcagccagcttgctcgccgcgcccgtgcttgttcctcgcctccgttccgttccgttccgtcccgcccgccgccgccgtcgcattcagggatggagatgaagaagatcgcctgcgccgtcctcgtcgccgcctcggcggccaccgtggcgctcgccgcggaggctccggctccgggccccaccagcggctcctccgtcgtcgcgcccgccgtcggcgccgacctcgaggccgccgtcgcctacttcttcggctactacattcagtgagccggccgcggccggtcgccccgaggccgaggaagagacgaagcgggagagagagt

SEQ ID NO: 64573 - DNA, 428 bp, Zea mays
  Clone ID: LIB3075-018-Q1-K1-B3
caggccttggaggaagccaatggtgatattcttgttttcatctcatcattcaacccaatgaagaacagcatatccaagcgccaggagaagactatcatgaaactggtagttgatgctgaaactgacaaagtacttggtgcatccatgtgtggaccagacgcacctgaaattatccagggcatcgctattgcggttaaatgtggagccaccaaagcagacttcgacagcactgtcggaatccacccttccgctgctgaagagttcgtgaccatgcgcaccgtgacgaggcgcttgagcccgacatccaagccaaagacgaacttgtaagcaagaaattggtattctggggaaatgttacaccggacaaatactctggtttcatcacgttggtaatttttacgtcattggaactggaaccatgtatattg

SEQ ID NO: 64574 - DNA, 366 bp, Zea mays
  Clone ID: LIB3075-018-Q1-K1-B4
gagacaccggccgtcgagcgagcagtctcccaattccacccaataactaataacatctgctggaacgccaggttccttggaccactatatccaggagcgacgaagtgatccacccgccagccatggagatgaagaaggtcctctgcgccgccctcgtcgccgccgtctcggccaccggcgtgctggcctcggtcgcctgcgaggcgccctccgaggcgcccgacggcgcggtcggtggtgcggctggccctagcgcaagcggcgccggcgtcgtcgacgtgcccgccgacggggcgctcgtagactactttctcgcctactacctccactgagcgacgacgcgcggggccggcacgttgggatgca

SEQ ID NO: 64575 - DNA, 300 bp, Zea mays
  Clone ID: LIB3075-018-Q1-K1-B5
ggctggcggctagcctctaaccaatacattaaaataaaaccaactctcccattcggccagttcccatcccatctcgccttcgcttcccaccacgcccctccgtcccgcctcgccgcggcaaggcaccgacgccaaccgccctctccctcttcgactcgaccgcgtgagtgagagacgaccgcgcgcgcccctcgcccgcccgcccgccaggagatcgacccctgaacgcgtcatgacgtacgtgctggtgaccggcggcgtcgtgaagcggctctggaagggcgtgactgtcagcagcgt

SEQ ID NO: 64576 - DNA, 278 bp, Zea mays
  Clone ID: LIB3075-018-Q1-K1-B6
cccacgcgtccgcggacgcgtgggagccagcgcagtgctattagttgctaaaggcactgccatacacaaatctttccttgtgccattttttgctcttcaggcaccttgcagcataatctcatggatcaagggtgactatggtcagtggactgcttttcttgctttgttggtgcgtctattcttcttcattccaggtgaactggagcttccgctgtcaacaatgctgcttgtgagtgttgctccttaccaattcatggatcttaagggaactcaaagtg

SEQ ID NO: 64577 - DNA, 395 bp, Zea mays
  Clone ID: LIB3075-018-Q1-K1-B7
gtctgcgctgggcattctgatcaagagatctaacatgctgaggtcactggtttcacgagatgatcgagcagattcatcacgcaattcccagagcggtgattctaacaccaagacaccatcagagtttcaagaacaggcagaaggaaatccgaatgatggcgcaagtggagcggcaataaaggggactgaagccgatcactgatgtaaatttactcgtatatacgtatagtgttctagctatgcatgcttgcgtatatgctgtacttccctcgcaaataggaacaggagagcaaatttatgctgccatgtcaatagatcttcagtacacctgtaaagcaaccactcacagttagatgattatttattgaatcaaattttatttaaaagaaaatttt

SEQ ID NO: 64578 - DNA, 98 bp, Zea mays
  Clone ID: LIB3075-018-Q1-K1-B8
aaaaaaaaaaaaaaaaaaaaaaaaaaaataaaaaaaaaaaaaaaaaaaaaaaaaaaaaaggaaaaaaaaaaaaaaaaaaaaaaaaaaaaagatcgcga

SEQ ID NO: 64579 - DNA, 406 bp, Zea mays
  Clone ID: LIB3075-018-Q1-K1-B9
tgggcatacaagagccaagaaagtgggttaatgcatgcttgtgggcacgatgcgcacacaacaatgctcctaggagctgctaagctacttcaagctcggaagggtgacttgaagggtgctgtaaagcttgtgttccaaccatcagaggagggctatggcggagcctactacgtcttgcaagaaggtgctcttgacggcgtgtcagccatatttggcttgcatgtggacccagcacttccagtaggtgtcgtcgcatcaaggccaggaccattcacagcgacagcgggtcggttctctgcaactattcgtgggaaaggtggtcatgccgcagtaccccatgaatccgtcgaccctgttgtggttgcagccactgcaatcctcagccttcagcaaatcgttgctcgtg

SEQ ID NO: 64580 - DNA, 110 bp, Zea mays
  Clone ID: LIB3075-018-Q1-K1-C10
aataaagagtaaatgagcatggtggatgtgtttatactagtcatcagcggatcttgtaggggggggctttctgagataatggcaaggtatttctactttttttgctttat

SEQ ID NO: 64581 - DNA, 339 bp, Zea mays
  Clone ID: LIB3075-018-Q1-K1-A5
tggaaggattatcagtaaggaacgtaattactggactagacgagttggaaatgacggggatctcatatgcatcgaagatccgcttgagatctcccatgatctcggtcgcgtagttgacaagttcaccatcaaaatactcagggaggaattcgagcgagcagctaatatattacagttcgatccaaaccccagcgtaacactctttgagccctacgtgccccctccatcgccgagcctgttgcaagaagaaactgcgaatgctgcagaaattgaactatgatagcgtttggttcgtccccaggtattggtatatgaaatagaatcaactcaaggattttg

SEQ ID NO: 64582 - DNA, 375 bp, Zea mays
  Clone ID: LIB3075-018-Q1-K1-C11
atttagtaaaaactcaattattggataaaccacgaattaacatgtccttaacctactggggtttcatgtagactgtcttaatccatagaagtcattgcatagcattattattttttcctgctgaattatctttgtcaaaatgttcagtgtgacaatcgttgttgcatatctcatgaagaagcatcaaatgagcctcgaaagtgccttgtcactagttagaagtaaacgacctcaagtggctcctaatggggggtttatttcccagctggagaagtttcagaaatccttgcaaggtaaaacacaaatagttgcctttgtcctcctttatgttaaaatggtttcagagcaaggtgacatgtgtatcttgcttaatga

SEQ ID NO: 64583 - DNA, 344 bp, Zea mays
  Clone ID: LIB3075-018-Q1-K1-C12
cccacgcgtccggaacaatggagatgatgtacactgacatcacacaagctctcgaagccaatggaatccaagcaaaccccaaggactatctcactttcttctgcttaggtaaccgtgaggtgaagcaggagggagaatatcaacctgaggaacacccagaacctggcactgattacatccgggctcaagaggctaggaggtttatgatctatgttcatgccaaaatgatgatagtggacgatgaatacatcatcattgggtccgccaacatcaaccagaggtccatggacggtgccaaggactctgagatcgccatgggcgcgtaccagccgtaccacctggcg

SEQ ID NO: 64584 - DNA, 319 bp, Zea mays
  Clone ID: LIB3075-018-Q1-K1-C2
gagacattttcggggtgtcattaatttggaggattgtaatcttgaggataatttagacgatgaagatgctccaagaagttcgaaggattccaaaaaggcaaatatggtagataccggaaaagattctagccttatgttcaagattacccacaagattgcatataaaaatgtgttgaaagctcatagcgctgttatactgaaagctgaaagcatgagtgataaaactgaatggatcgccaagattaagggcatcgtcgacccaaaaaggctttctgcaaagaaaccaagcgcttcagaaagcggtgccccaatgaggcaa

SEQ ID NO: 64585 - DNA, 380 bp, Zea mays
  Clone ID: LIB3075-056-Q1-K1-H9
cccacgcgtccgtgaagttccggaatgcagtggctaaggactactacttccagatgtactatgatgatctcccactgtggggcttcatcggtaaagttgagaagggcggcaaggatgatccgagcgagtggaaatactatctgtacaggcacatcatcttcgacatcctatacaacaacgaccgggtgatcgaaatcaatgtgcacactgatcagagtgcattggttgacctgacagatgataaggagaccaatgtggaattcctgtactcagccaagtggaaggagacaccaacaccattcgagaagaggatggagaagtacttcagctccttcaacatgccacaccacctggaggttcattggttctcaattattaac

SEQ ID NO: 64586 - DNA, 375 bp, Zea mays
  Clone ID: LIB3075-056-Q1-K1-G10
gtacaatggctggttgagccccaggatcctgggtgatttcacagctttcgccgacttctgcttcaagacgtacggcgaccgggtgaagaactggttcaccatcaacgagccgaggatgatggcccagcatggctacggcgacggcttcttcccccccgccagatgcaccggctgccagttcggcggcaactccgccaccgagccgtacatcgccggccaccacctcctcctcgcgcacgctgccgctgtcaagctgtaccgcagcaagtacaaggttcgtcaggccggcaagatcggcatcctgctggacttcgtgtggtacgagccgctgaccaagtccgtggaggacgagtacgcggcgcaccgggctcggat

SEQ ID NO: 64587 - DNA, 384 bp, Zea mays
  Clone ID: LIB3075-056-Q1-K1-G11
gcgagatggataagctccggctggtcgccctccccaaccttatcagtgtgcggccggagtgatacgaccgccagcgctcccacagcgacctgtaactgtggagcaagtggcgcctggctagagcaggccgccttgtacatacttttgcaaaaacgaggtgtctgtacatattgttcgtcgtgtcgtgtcgtgtcagagtgcctgatggcaacgggctaatacgttcgtgccaacgtgtgcatggtatcccacggaccctgtggtagtaaggagcagttgtaaatatgccgtgcttcctctccatgtggagtgctgctgtataaatagattggtgcattgctaaatacctctgcttggaaaaaaaaatttaatataaaaagggcg

SEQ ID NO: 64588 - DNA, 264 bp, Zea mays
  Clone ID: LIB3075-056-Q1-K1-G12
acgagtttcccgacccgctgtcgctcgctgccaactccaacgcctactgcacctgccctggctacttccgcttcatccacgaggaccttcacccatggcgcgccgctgggggcatcacccgcgccatggtcgaccgcgcgcgcgccaccggcaactttcgcctcggcgtcatccggggccgcgcgtacatcgagcgcatcgcgccggcattccagacgcgcgacctcttcaccatatgtcgcattctgcagctgctacggcgct

SEQ ID NO: 64589 - DNA, 427 bp, Zea mays
  Clone ID: LIB3075-056-Q1-K1-G2
tcggccctgctcatactgcttgccctcgccgtatcgtccaccctcaacgcacaggaggattccatggccgacaacaccgggacgttggcgggcggcatcaaggacgtgccggggaacgagaacgaccttcacctccaggagctcgcccgattcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacttcaaggagctgcatgaattcaagcctgttgaagagggtgctagcgcctaatgatctctacttcttcatgttgcgagcctgaagctcatagcaaagttgcaga

SEQ ID NO: 64590 - DNA, 419 bp, Zea mays
  Clone ID: LIB3075-056-Q1-K1-G3
ccagatatctatctttgtggtcgtggtcctcccgtcgtcgtcgactcgtcgtcgtcggtgttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcatggaagaaaggtggagatcttggttggttcccgcgtggcaagatggctggt

SEQ ID NO: 64591 - DNA, 451 bp, Zea mays
  Clone ID: LIB3075-056-Q1-K1-G4
aagtcagtaaagtaaattctgtcgctccaattcggacgaggagatgccgcggatccctctgatcaggttccccaagcggaatctcaaagccccatctccatccgcgccagcggcgtcgcaacccgcagaccagcacgcgaccctcatgttccggttaggggctaaagcagaggcaccatcttctggagagattaaaaattaccgctttagatctgatgtgccttgcccaccttctcatactgccgtaggaggtccagcttcactccttcctaagcgcaaacccctgactgaagaagagattgaggctattatgctggggggatccatctgatatcacctcatatgaattggaaattctaggaacatcaataagattgtatgcctgagcttattgcctttgacctctgaaagagtgttatcgaagccatgtcgatatgtaagtgggtttttt

SEQ ID NO: 64592 - DNA, 389 bp, Zea mays
  Clone ID: LIB3075-056-Q1-K1-G5
gataacttcagtgccaacgtcgtggttgatggtaacactgtcaacctcggcctctgggacactgcaggtcaagaggattacatcagactgagaccactgagctatcgtggagctgatgtttttcttctggctttctcactgatcagtaaggccagctatgagaatgtttcgaagaagtggatacctgaactgaagcattatgcacctggtgtgccaattattctcgtagggacaaagcttgatcttcgagacgacatgcagttctttgtggaccatcctggtgctgtccctatcactactgctcatggagaggagctaagaaagcaaataggcgctgcatactacatcgaatgcagctcgaagacccaactaaacgtgaagggcgtctt

SEQ ID NO: 64593 - DNA, 432 bp, Zea mays
  Clone ID: LIB3075-056-Q1-K1-G6
cggactcgtggggggtacaacaatggcgtgccgatagacgaggagttcttcatcaagaacatcgctgggaggagtgacgtcgaagctgcccagaacctgttcccggactgggagcttgagaaggggctcaaattcctagaggacaaggaagcaaaatacaggagtctggcaaaagagcgcttggtgcctgtgaaaggcctcgcgaaggtggtccagtgggtgaaagaccactggtacaagcgcgcggcggtgaccaacgcccccaggatcaacgcggagctgatgatctcgctcctgggcctctcggacttcttccaggccgtcatcgtcggaggcgagtgcgagcagccaaagcccgcgccgtacccttatctcatggccctcaaggagctccaggtgtccgcagagcacagcttcgtcttcgaggattcg

SEQ ID NO: 64594 - DNA, 446 bp, Zea mays
  unsure at all n locations
  Clone ID: LIB3075-056-Q1-K1-G8
atccaggacaaggagggcatcccaccggaccagcagcgtttgatcttcgctggcaagcagctggaggatggccgcacccttgcggattacaacatccagaaggagagcaccctccacctggtgctccgtctcaggggtggcatgcagatctttgtgaagacactcactggcaagacaatcacccttgaggtggagtcttcggataccattgacaatgtcaaggccaagatccaggacaaggagggcatcccaccggaccagcagcgcctcatcttcgccggcaagcagctggaggatggccgcaccctggcggactacaacatccagaaggagagcaccctncacctggtgctccgcctcatgggtggcatgcagatttttgtgaagacattgactggcaagaccatcaccttggaggtggagagctctgacaccattgacaatgt

SEQ ID NO: 64595 - DNA, 139 bp, Zea mays
  Clone ID: LIB3075-056-Q1-K1-H1
gaaataataaatggtgccattccatggcatcatttttctgtcagtagtttatgaggcactgttctaaatgtactgttgagtggaatttgaatatgtatgcttttgcaatctcacacctaaataccttgtgcttatactc

SEQ ID NO: 64596 - DNA, 338 bp, Zea mays
  Clone ID: LIB3075-056-Q1-K1-H10
cctatcccgaccccctgccgctccttgtctactccaacgccttcttcacctgccctgcgtacttccgcttcatccacgaggaccttcacccatggcgcgccgttgtgggctttacccgctccatgttctatcgttctcgcgctcattacaacttcctgcttttctgtcatttgtgtcctttcttattattgtgcatttttgttttctttttttttgttttacttttcccattgttgttatttttatattttttttttattttgttgtttttcttttttttttattttatttttatattttttttatgtttttttttttatttgttttctttctttttt

SEQ ID NO: 64597 - DNA, 436 bp, Zea mays
  Clone ID: LIB3075-056-Q1-K1-H3
aaaatttgcgtttctgttgggtacacagtggtgtagaaggagggccagtctcatatctgtctgctcgttccagtaattaagtcaagataaatgccaataaacaagttaagaaaaatgccatcatggaggacatagttgtccaagagttacttgatgatttctaggacactccttgggctagagctagctataaagttaagcttgatgattttgattctgattttgagtctgccctactaaaacaagaatcatgacctacatttcatttaattcctgcatgcagacccatgatgttgtattaactattccagtgtgcaattcatcatgtttcttatatctccattctactgctttaatgatatgtctagcatgtgtaatattcctaatcatggttcatctcgaatcgattgcatacaaaatgattatgtacgtatga

SEQ ID NO: 64598 - DNA, 85 bp, Zea mays
  Clone ID: LIB3075-056-Q1-K1-H4
cggactcgtggggggaaataccttctaagtgtttatttttattttttacttatttcacgtcaatcaatggaaaattatgcttccg

SEQ ID NO: 64599 - DNA, 447 bp, Zea mays
  Clone ID: LIB3075-056-Q1-K1-H6
tcgctcctggtgcccgaccagaagctgttcccggaccgcttcaagatcccctcgtacctgggccgcccctggaaggagttctcgcgcctcgtcatcatggagagcaccatctccgacttcgtcaagccagaggggttcatgccctggaacggcgacttcgccctcaagactctctactactccgagtacaacaaccgcgggcccggctccggcaccagcaagagggtcaactggcccggcttccacgtcatcggacggaaggaggccgagccgttcaccgtcgggccgttcatcgactgctccatgtggctcaagtacaccggcgcgccgcacatacttggtttcaagttctaaaggccgcatggcatggcatacatcacatcatatatagtgaggtggcacacgctcgcgagcgcacacacatgtttgtgtgtatgtacaatgact

SEQ ID NO: 64600 - DNA, 401 bp, Zea mays
  Clone ID: LIB3075-056-Q1-K1-H7
gatcctcaacaacgaggagtgcttcatcctgaagctggaggctggcgcctcgacgctgcgggctcggagcgctggggcgttcgacatcatccaccacacggtttggggctacttcagccagcgcacggggctgctcatccagctcgaagactcgcacctgctccgcatgaagtccggcaagggcgctcgccgcatcgagaacatcttctgggagaccagcatggagtccgtcatctccgactaccgctacatcgacggcatcaacatcgcgcacggcggccacaccaacgtcacgctcttccgctacggcgagggatccgtctaccacaagcggaagctggaagagacatggactgttgatgaggccgatttcaacgtgcacggtctaaccacggactact

SEQ ID NO: 64601 - DNA, 429 bp, Zea mays
  Clone ID: LIB3075-056-Q1-K1-G1
tcgctacccgatcaatcctacaaacatgagtgcttttgctgcccttggaaatgggggtggcgtcaattatatgggtctcccttctattgcccctgagttggcccagttgggcaacatttcaagccttgggtcagggaactttagccgtggagctggagttaataacttaagcttaccttctggctcctatgggaggagcaattcaactggtacaattggtgaacctttttctgcatcaggcaatgcatatgaagtgaacaacccagatacatatgggaacaactctatttatggtggaacatcctggaggttcccttcatctgaagttgacgtgccttctttcagtcatgatcttggaaatgttgatccgaatatgaaatcagacatatcagcaaattacatgggaaattattctgttagcaacaatca

SEQ ID NO: 64602 - DNA, 449 bp, Zea mays
  unsure at all n locations
  Clone ID: LIB3075-056-Q1-K1-H8
attggtaggcctcttgaaagtccgggtggtgaggggcatcaaccttgcctaccgcgacgcatgaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaggtgttcgacaaggacacgttcagcagggacgacccgatgggggacgcggagatcgacgtggcgccgctggtggaggcggcgaacgcgagcccggaggcgagcctgaggaacggcgccatcatcctgtcggtgcggccgagcgccacgaactgcctcgccgacgagagccacgtgtgctggaggaacggcaagttcgcgcatgacatgatcctncggctcatgaacgtggagagcggtgagattcatc

SEQ ID NO: 64603 - DNA, 240 bp, Zea mays
  Clone ID: LIB3075-056-Q1-K1-E2
cagagctgcgacatcgttgccttcaacaagatctaggcgtgactttcgatcagtccttcccctggggtgctggcgatggtggtggctgggcaatgcaccagcctaatttttccatagctatatgtctgctttgtgtggccagtgatattgccgtgagtatttttggatcctattcgagtcgaatgtaccagtaccagagttaatttgctttaattcgaaacaccgttccggttggaattc

SEQ ID NO: 64604 - DNA, 436 bp, Zea mays
  Clone ID: LIB3075-056-Q1-K1-E3
aaagagacaaaacctcgttttttcttgacccatgcttggctaaaaaaagaaaccaagaaacgccatgtctgatccccccggcgagacggaccataaccatcgcgatggaaagcaccggcgatcgcacctccaccacctgaatgtgcaggtccctcccgtcgccagcaacattggctgcttcgccggctgcttccgcccgtccccgacatcatcgtcttcccccgccgcgcacggcaccaactgccacggacacggacacggacacggacaccggcacgcggaccggccggcgttcccgtctctgatccggtcgccgtcggcgtggatcaaagcgaatggccagagcctcgggtctggcaggcacgcgcgccgtcggtcccaggacttccagtacgacgcccttagctacgcgcgtaacttcgacgagggctggagc

SEQ ID NO: 64605 - DNA, 443 bp, Zea mays
  Clone ID: LIB3075-056-Q1-K1-E4
cttccgttacctctccaggcagctcctctccctctctgtcgccgacgactacgccaggtcttcttcggggcccaggtcgctgccgcctacatcaggggccccaagttttcctacttcctaggacccctcgccggcgacgagcaccaccagcttggttcactcccaacaaaatgtcagccaatgtgggtgaatcaactagcggtgtcagcagcagcgatgcagctggggggagctttgagtgcaacatatgcttcgagctgcctcaggagccaatagtgactctctgtggccacctcttctgctggccgtgcctttaccggtggctgcacattcacgcacactcgccagagtgcccagtgtgcaaggccctcgtggaggaggacaagctcgtccccctttatgggcgtggcaaggatcgcgtttacccgaggtcgaagaacatg

SEQ ID NO: 64606 - DNA, 375 bp, Zea mays
  Clone ID: LIB3075-056-Q1-K1-E5
ctgtttttatgttaattgtattttgcctgcgatcatgcaatgtattttcttttctgaaatagctttggttattacagaactttttggtagacttaaagggtcctaatttggcctttctaccattactttcatttgaaggcggttcattggagaaacatacccaagttcaagattggtacattaatatatgctcgagtggtgaaagctaatagtatcatgaatcccgagctctcatgcatggatggtacgtcttttagtcttcagctcaatgttcatgctccttacttgatcatgataacttcagaagtatggcttaccaaattttattcgtcttatcatatttatccttattacctgtgctaacctgtgagcttg

SEQ ID NO: 64607 - DNA, 439 bp, Zea mays
  unsure at all n locations
  Clone ID: LIB3075-056-Q1-K1-E6
ggagcaggttatattggccttgagatgggttcagtctggaaccgccttggttcagaggtcactgttgttgaatttgccccggatatagtaccatcaatggatggcgaggtcaggaagcagttccaacgcatgctagaaaaacagaaattcaagttcatgctcaagacaaaggttgttgggtgtgataccagtggagatggcgtaaagctgacactggagcctgcagctggtggtcagcagaccatccttgaagcagatgttgttcttgtctctgctggcagaagcccatttacttctgggattgggcttgaaactcttggtgttgagacagacaaggctggcaggatccttgttgataagcgcttcatgaccaatgtgaagggagtctatgcaatcggtgatgccatccctggtccccatgctgcccatanagctgaaa

SEQ ID NO: 64608 - DNA, 298 bp, Zea mays
  Clone ID: LIB3075-056-Q1-K1-E7
tcgcggactcgtgggcactgcttatagctttgatcattcaaattatgtatcgatgtgacaaggatacctctgcttatggtttctacttttgatgcactctgtgactcttgagtgcttggcatgatccctgcttaacacaatataaaaattgtgacagataagacggtaaactgaggtggggatactaacgtattagtgggaagagtgctacactggatgattgctatgatggaaatcttactgcaactgatggacaagctattatcctgttcgatgtctttcacggtcatggtggatc

SEQ ID NO: 64609 - DNA, 398 bp, Zea mays
  Clone ID: LIB3075-056-Q1-K1-E8
tcgagtcattgaccgatttgttgtaatatctactcaccaacagatattctttaagccaggattctctctccttgtgaatttaaccaaaggaaagggtatttctttggcaaattgtacatgttgatggtggaagaagaagatgatccatgaactgagatctggggtgccattgctcacaatttttgcagttgtgactgagaaattgaaggtcctgcttgaccaagctcggctccggctccggcttttggattctcctgcgaagaagttgttgccttctcgcagaagctgagagccgaacagtgtatttggtttgaattgcagcctatagtataatttgattcacccgtactgactgtcacataaagccgtaaagggagggtagcttcttttgttgagtc

SEQ ID NO: 64610 - DNA, 444 bp, Zea mays
  Clone ID: LIB3075-056-Q1-K1-F1
cccactcgtccgcagcagtacttctcaaataccatatctcggctcttgctacctgttgatggtgctcatccgtctgcttgtgaagatatggggtcagcagtatcagtagttgaggctgctgctcacaaaggactgctacaatgtattgatactgttatgtctgaggttgaaagattgttgtcttcagaacagaaggctacagattatcgaacaccagatgatggagctgcaccagatcatcggccaactaatgcttgtataagaattgtagcctatctctctcgtgttcttgaggttgcattcagtgcccttgaaggcctcaacaaacagtcctttttgactgagctgggaaatcgcttgcataaggggctgcttaatcattggcagaagttcacatttagtcccagtggtggcctacggttgaaacgtgacataactgaatat

SEQ ID NO: 64611 - DNA, 301 bp, Zea mays
  Clone ID: LIB3075-056-Q1-K1-F10
tcgcgatgacgtgggacccctgcgcggcctcttcgtgctatcccgcgaccccggagcgcatgaatcagtcgtcgccccgggtgcgtgttggggggttccatggggagccacctgtgtcgccgttcctcgcctctgtcgacggctcggaatccatggaattgatgcggagcttcgactggacacggggaagctatcctgaccgtcaatttgatgaacggtcagtcggaactcgggcaatggctcaccggaggtgtggcgttcgtcgcgggccgcgttccatcgtgggcgttcgttttcgtgc

SEQ ID NO: 64612 - DNA, 446 bp, Zea mays
  Clone ID: LIB3075-056-Q1-K1-F3
cggactcgtgggcgagtggccgaacgagttccagaggctgtacgggaccattgacctgtactggatcgtgagggacgggggcctgatgcttctgctgtctcagctcctgctcgccagagacggcttcgagagctgcaagatccaggtgttctgcatcgcggaagagggcacggaagccgaggagctgaaggctgacgtcaagaagttcctgtatgatctgaggatgcgagctgaggtcatcgttgtgaccatgaagtcgatggaagcgcactctgagatcagccccaacgctaagaaggatccccaggaggagtacgcgagcgcccaggatagaatcagagcgtacctgtcgcagatgaaggaggatgcgcagagggaaggtcggccattgatggatgatggcaggcaggtcgtggtcaacgaagagaaggtcgagaagttcctct

SEQ ID NO: 64613 - DNA, 433 bp, Zea mays
  Clone ID: LIB3075-056-Q1-K1-F4
tcggccttggaacgggctccgccagtgacatttcctcgcccagaggggaagatcaagaatctggtgcttcctgaggatgtgtatgtcaggaagttcaacagaatacatccagattcgctttaccatgatgcaatcaagataagtggatttgatccaccgtcagctcgagtgtttgcttggcgtgtcctggagttgaaagagcaaggagtcgatgaagatgttgcaatggctgtagcagataacgagtaccggacagagaagaaggcaaagaagaaagcgtacaaggagctgaaagaaatcgcccgcagcgaatggaggaagccacctccgaatccatacccgagtgccataaaggaaatacaagcggaggaaaagaagtatgtcatggaccgtttgcataacccgaaggtaatcgagattgcgaacaagatga

SEQ ID NO: 64614 - DNA, 437 bp, Zea mays
  Clone ID: LIB3075-056-Q1-K1-F5
gcaccatgtcctcctggagggtaccctcctgaagcccaacatggtgactcctggctccgactctaagaaggtgacacctgacgtgatcgcccagtacaccgtccgtaccctccagaggaccgtgcctgctgctgtgcctgctgttgtcttactctgcggtggtcagatcgaggaggaggccaccctgaatctgaatgccatgaacaagctcatcaccaagaagccatggtccctgtccttctccttcggccgtgccctccaggcgagcaccctcaaggcctgagctggcaaggtggagaacgtggagaaggctagagcggccttactcgccaggtgcaaggccaactccgaggctacattctgcacctacaacggtgatgctggcgtcgacaccgatagccttcacgtcaaggactacaagtactgaattgcttctc

SEQ ID NO: 64615 - DNA, 433 bp, Zea mays
  Clone ID: LIB3075-056-Q1-K1-F7
ggatgtcgtggcagacatacgtcgatgagcacctgatgtgcgagatcgagggggaccagctgacctgcgctggcgtagtgggccacgacggctccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagccctgcgctgtcatccgcgggaagaagggatctggaggcataactgtgaagaagacagggcatgcgatggtggtcggcatctacgacgagcccatgacccccggtcagtgctacatggtggtcgagaggcctcgggactaccttgtagagcaagggccgtgaatggatttaattaacctcgctcgcttgtgcatggt

SEQ ID NO: 64616 - DNA, 406 bp, Zea mays
  Clone ID: LIB3075-056-Q1-K1-F9
aaacaaggagagtctgtaccagatatgttattcatgtcttgagtcactggttgatctctttgaagaggccagagaaccaacagattatacaggtcagattcttgtagttagagggagtaaaccactgattgagcgagtctctaggcaaacagagaacctcagttggctcttggatattctagtaaacaatgacattgcagaagaatttgtagaactgtgggcgaagcaagacaggctcattaggatgcacgagcaagcgtcagcgatggtcaggtatgagctaagccgaatatcagccgctgtgttcattgcacttggtaaaggaaaagttcagtgtcgtggcgatgtacgaagcctcgtctttcgtggatggttcagcacgatgttggtgggatttggctggctt

SEQ ID NO: 64617 - DNA, 359 bp, Zea mays
  Clone ID: LIB3075-056-Q1-K1-E12
cccttccctccctcacacgatctctcctcgacggctaacccggattgccgtctcaggctcgggatccgggcgctcgcggcgatggacggcggcggcggcggcgctggcggcgcggagggggagctcacggcgcaggagacagcgctctacgaccgccagatccgcgtctggggcgtcgatgcccagaagagactaagtaaggcgcacgtgcttgtgtgtggcatgaacggaaccaccatcgagttctgcaagaatattggtctagctggagttggaagtttatccttgatggatgataatgtagtcacagaggaggatctgaatgcaaatttcctaattcctcctgatgagagcatata

SEQ ID NO: 64618 - DNA, 446 bp, Zea mays
  Clone ID: LIB3075-021-Q1-K1-E6
gtgagtcaagctgcagacttctcaatcaagaagtgcatatccattattggtacaatggaagttacaaaggaggaaaaagcgaaagcctacaatgtcttcaaggaccttgacaacaggcaaattttcttgagtgcatgtgatgatgatgccgagcctacactgatttggctgagaaacgagatggcttagctggtggagtcgtctgaattgcttgctggatagccagtatgttatgttgttcaaatgaaaaattagctctctccctttggtttgttcttaatctaaatgcacacactctattgtaatgtaataagagacaaatgagtggccaacttctgattttgatgcttcaaatttcatccgcttcatagacctaatatgatggacactgatctttttatatgcatgcaacaaattaatgtatccatgtggtgtaaccaaacaat

SEQ ID NO: 64619 - DNA, 448 bp, Zea mays
  Clone ID: LIB3075-021-Q1-K1-E7
ctcaatcaccactcgcccatcgtgggcgccgcccttctccccaatcctgatcctcgtaggaccgccgccgagaacgctaccgccgccaagagcagcacaagcacccgtcgcatcaccgtcttcaatgaattcctctgtctactcgcctaccccgacttcacttgatagcccgccagacgcatctcgatgcttctgctccctggttcttagggcctgtggatgagaccgtgtccctgccgtccaaaaatcagcaggccctcatgctcatagcgttcatggatccaggaaaaggagacgccggtgatacttcaaccaccagagagcgtcggatggggaccaccatcgtacgggtccgctgggaccgctgctagcctactagggcagcaacgaattgacaggtatgattgcgcatggccatcactgcgagacgtaaccacattaaaccttt

SEQ ID NO: 64620 - DNA, 450 bp, Zea mays
  Clone ID: LIB3075-021-Q1-K1-E8
gttccccatggtcagaagccgagccaagaaccacccttcaaaggggtgtcccaaagccgtgaccaaacacctcaagatgacctcttctcaaagaatacaagcatcgccaatctcttggcatccattagtgacaggaatatctcagtatctctcacgaagtctattcattccaccaccaactcattttccttgtttgcgtgttttttacttctcttcttttgctgaaccccctcagtaggctctggtctcttctttggctctttgccctgaagaagatgtgcaaggagggcgcatattgggggactgttgctggcgtctacgtgggcgtggtgtatggcgtggagagggtccgtgggcgcagtgactggaagaacgcgatggtcggaggcgccttgtccggcgcgctggtctccgccgccagcagcaaccacggagacaagatcgtcaagg

SEQ ID NO: 64621 - DNA, 364 bp, Zea mays
  Clone ID: LIB3075-021-Q1-K1-E9
gcaaattaccgcgatggctcccaagatcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgtcattcttcccacgctgctcttcgtcaccgacaagaaactc

SEQ ID NO: 64622 - DNA, 444 bp, Zea mays
  unsure at all n locations
  Clone ID: LIB3075-021-Q1-K1-F1
tcggccgcacctagggtttggattggcgccgagcatggcgtacgtcgaccacgccttctccggctccgacgaggacgacctcgtcggcggcgccatggggggcccgcgcggggcgcccgtgaaggagatcgccttcgccgccgcgctgctcgccttcggggcgctcggtaccatcggtggcctgctaatggccgtcaaccgcgtcggaggggaccgcgcgcacggaattttcttcatgatgttgggcattgtaatgttcatccctgggttctactacacaaggatcgcctactatgcttacaaaggttacaagggcttctctttttcgaacatnccaccgatctgaaggagtgtgctgctgcctgctggttatgaagtggtgtcgctggtttaagagttggtcgactctgtcgaatggctctgtagacacccttgttctacatc

SEQ ID NO: 64623 - DNA, 350 bp, Zea mays
  Clone ID: LIB3075-021-Q1-K1-F10
gtcgtggccgtctcccataccgtctcccctttctcgcctccggtgcccaaagccaggccaacagttttgaggtggtaatggcgggccaggctaaccaacccactgtccttcataagctaggtggccagttccacctgagctccagcttctctgaaggtgtacgggcccgtaacatctgcctttctttctcatcttatgaaaggagatttgccacgaggaactacatgacccatagcctttggggcccttcaatgtctgttagcggtggcattaatgtttcagtgatgccgactccgctttttgccaatgctccatccgagaaaggtggcaaaaacttcatgattgatttc

SEQ ID NO: 64624 - DNA, 363 bp, Zea mays
  Clone ID: LIB3075-021-Q1-K1-F11
cacgacgccaagtccgcctccgccgtcatccgctacgccggctccagcggcgccccgccggcgcccaacatgaccgagccaccggccggctgggcctggtccatcaaccaggccaggtcgttccgctggaacctgacggccagcgccgcgcgccccaacccgcagggctcctaccactacggccagatcaacatcacccgcaccatcaaggtcatggtctcccgcggccacatcgacggcaagctccgctacggcttcaacggcatctcccacagggacaccgagacccccctcaagctcgccgagtactttaacgtcaccgacggggtgttcagctacaaccagatgggcgacgtgcccccc

SEQ ID NO: 64625 - DNA, 403 bp, Zea mays
  Clone ID: LIB3075-021-Q1-K1-F12
atgggtggatgtgacaagcaaggcttcccaatgaagcaaggagttttgacttctggtcgggttcgtcttctgctccataggggcactccctgcttccgtggttatggcaggcgtaatggtgagcgcaggaggaagtctgtccgtggttgcatcgtgagccaagacctatctgttatcaacttggtgattgtgaagaagggtgagaatgatctgcctggtctgactgacactgagaagccaaggatgaggggtcccaagagggcctccaagatcagaaagctgttcaaccttaacaaggatgatgatgtacgcaagtacgtgaacacataccgcatgacattcactaccaagaacgggaagaaggtcagcaaggcacctaagatccaacggcttgtgacaccct

SEQ ID NO: 64626 - DNA, 460 bp, Zea mays
  unsure at all n locations
  Clone ID: LIB3075-021-Q1-K1-F2
gcgatcgtcggagcagagagagacttcctcgcctccatcccatcccgccgccgccgtcgctacggtcgctgataagcagccgcatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgcttccgcgcattcccgatgcgtgggcgtgctctgattgggcacggcggtggcagtggcacaccttcgtcttccttttgtttggttntttttccttcctctttctacttgattntcatttaacga

SEQ ID NO: 64627 - DNA, 455 bp, Zea mays
  Clone ID: LIB3075-021-Q1-K1-F3
cggacgcgtgggcgcctgcgatctccgtagcctccgtcgcgtcgagcatcgatcatgtgggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgacgttgttggcactgataaggagaccaccacccaaggccatgacgaccttggcaagcgctgcgccaagtacta

SEQ ID NO: 64628 - DNA, 463 bp, Zea mays
  Clone ID: LIB3075-021-Q1-K1-F4
cgacgaaagctatagccagctagtaacaagagcaaaaacaccatcatctcatccgcccggctcaacgccaccccaatggcccagagcacgaggatggtggcgctggccctggtggtcctcctggtggcggcgacggcgtcggtgcccacggccaccgcgtacggctgctacgacgactgctacgagcggtgcgccaacggcaagaaggacgaccccgcctgcaccaagatgtgcaaccaggcgtgcggcagcaccgacaagggcgccgtcgtcggcgcgccggcttgatcgacccgggcttcatcggcgcgcgggctcagctcgatatcagcatcatatacaatcgctgctccgtcgctcacgtcagcccatgcatgatctctcgacccggcccattgaatcttctccttctactatagtatatctttgttgcaggtcttcgttctcatacatcgatccactc

SEQ ID NO: 64629 - DNA, 440 bp, Zea mays
  Clone ID: LIB3075-021-Q1-K1-F5
tcgaccatccctgcaaattaccgcgatggctcccaagatcctagtcagccttgtgttcgtcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgtcatccttcccacgctgctctccgtcaccgacaagaaactcggcgtcctcaactacaccatggccgacgacgggcagatgtacttcggcgctcccggcgccccct

SEQ ID NO: 64630 - DNA, 437 bp, Zea mays
  Clone ID: LIB3075-021-Q1-K1-F6
gcgcctctacatttcttctctctctgctcctccgcctacgcctgagggatccaagacagggatcgccatgtctgactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgttaaccgtactgagtatcagctgattgatatttctgaggatggatttgtgagccttcttacttcagatggcaacactaatgatgatcttagactcccaactgatgagactc

SEQ ID NO: 64631 - DNA, 435 bp, Zea mays
  Clone ID: LIB3075-021-Q1-K1-F7
tcgatcacgacaagatggcgtgctcaaacaatgcgatgagagccttgttcgtcctggtcctggtctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcagcgtgcggcgtcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggc

SEQ ID NO: 64632 - DNA, 377 bp, Zea mays
  Clone ID: LIB3075-021-Q1-K1-D11
cgcgtgtctaggtttcctctctcaccatagcgcccgctctgtcgcccttcgttcacctgtccttcctctcctccctgcctgccagggagaggggaagtcagaggcacggagtggcgcagagcagacgcccgtgaaccattgtagctgtccctgtcgtcgtcatcgtcgtcgtcaacgaatccgcacaaggaaaagatggagaagaagccgaccatcctcatgaacaggtacgagctcgggcgcacgctcgggcagggcaccttcgccaagggggtacccggtcgggacctcgcgttcggcgagagcgtggccatcaaggtcatcgacaaggagaaagtgatgcgcgtcggcatgatcgaccagatcaagcgcgagat

SEQ ID NO: 64633 - DNA, 226 bp, Zea mays
  Clone ID: LIB3075-021-Q1-K1-D12
cccacgcgtccgaccagcttgtgaagtgaataagaagctctaaatcaagaaggatatttactagaccagaagcatggtttgggtgggatatctctacatgattttgttgctgttctgactttgtttgtgctcccgaacttgagtttgcaatcaaattatgataatggtattgactctcatatgaaagcatggcatatggaatttaatactgtgtatgactgtggac

SEQ ID NO: 64634 - DNA, 440 bp, Zea mays
  Clone ID: LIB3075-021-Q1-K1-D2
gacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacaggtgccggtcccgacgataacggtggctgctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgatttagcatgcacggcgttc

SEQ ID NO: 64635 - DNA, 459 bp, Zea mays
  Clone ID: LIB3075-021-Q1-K1-D3
cccacgcgtccgcccacgcgtccgaccaaatcgaatccgtggtgcactgcccctccccggccctcacaagccgccgccgccgtgaggactccggcgaatggcgtcccgcgtcgcctcgggccttctccgtcgtcgcgccgtcgccactctagggctactaaggagtcatacacatgtcagaaactacagcagtcaactttcagctttgattccagctacttctcaatgctcaaatctgacaagaagacgctattacttacctaatccatctctgtaccaagtttggagtaggtcatttgcctcagacagcggagacaagttcgaggctgttgtgcccttcatgggtgaatctgtaactgatggaactcttgctaacttcttaaagaagcctggagacagagtcgaggccgatgaacccatagcgcagattgaaactgataaggtcactatagatgtcgc

SEQ ID NO: 64636 - DNA, 453 bp, Zea mays
  Clone ID: LIB3075-021-Q1-K1-D5
gctggttcgtggatggcggtgccacaacctctcctgctgtcgctgctggtcgccgtgcgagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacggtgaccgacctgtgccctgccaaggaccagtggtgcaagccaccgcgggagcacttcgacctcagcatg

SEQ ID NO: 64637 - DNA, 447 bp, Zea mays
  Clone ID: LIB3075-021-Q1-K1-D6
tcgcattccgcttggttaccacgaacatctatgggatggcggtgatggccgtcggggtgtagtgcgcgagcaggtatgcagctgatattggcaaccgccgtgatgtggtgaaaatggaagtcgaggacctgacggccggactggccagcggcaggatatgtgctgtggagaacatcgcccagctggtggctccggaggcagaaggcccggccgatgccacggccacggccacgctggctgcttaacggaccattgtgccattgttgctgtgagagagatgtgcgttcagccaacatgtgtgctattgctttggcttatttgtgttcagaatccacttaaactcggtcgaagtgagctttccgttcggcaacgtctgtactcttacgaatctcgatcgtgtatgtctttaagtattgtgttgtgtttcaaagataaaaaaaggtgacc

SEQ ID NO: 64638 - DNA, 459 bp, Zea mays
  Clone ID: LIB3075-021-Q1-K1-D7
tcgacggcatcacgcgaagcaaggagaaagaaaatggcgcagctggtggagacgtacgcgtggtcgccggcgacggaacgcgggcgtggaatcctcctggccggggaccccaagacggacacgatcgcctactgcaccggccgcagcgtcatcattcgccgcctcgatgcgcccctcgacacttgggtctaccccgaccacgcctaccccaccaccgtcgcccgcttctcccccaacggcgagtgggtcgcctccgccgacgcctccggctgcgtccgcgtctggggccgctacggcgaccgcgcgctcaaggccgagtttcgccccctctcgggacgcgtcgacgacctccgctggtccccggacggcttacgcatcgttgtctccggggacggcaagggcaagtccttcgtccgcgcattcgtatgggactctggcagcacagttggtgagtttgat

SEQ ID NO: 64639 - DNA, 447 bp, Zea mays
  Clone ID: LIB3075-021-Q1-K1-D8
cattcgacaaaatatatcttagacatgttgagtttgacgataatggattcaagatatgggaccctatgcattttcttaggacttgccttacatggagatactactttggcagaaacttgcaggcagtatgttgaagggcagccattctgctttaaagcaatgtgcaaggcaaattgttttatggagggaaaattctctgatggttcttatgtaaagggttacagatgtgaatcaggtggattccactcggtgtgtgtttgccttttgtgcaaaaattagttgtctaaagacaaggggagatatcttcttatgtttctatccattatttaagaatattgtctaaataattatacgatagcttagttaaatagtttgtttatttatagacaaatgtagcgctagttaactagttgtgatttttaaaatttctcagctatatgttaggaa

SEQ ID NO: 64640 - DNA, 408 bp, Zea mays
  Clone ID: LIB3075-021-Q1-K1-D9
cggacgcgtgggctgcagtcatctcctccaccaccaccaccaagctcaacaacagccaggtcgcgaaaataatgaagagccgcagcatggcatcatcggccgcgctcttggtgctagccctcgcgctagtggcggccaccgccccacaggtagcggaggcaaagaagaagagagcggcggatagcggcgaggcggcggaggcgaaaaagatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaagggcatcacggcgccggccatgaaggtctgccaggaggagtgcgacaaggcgt

SEQ ID NO: 64641 - DNA, 206 bp, Zea mays
  Clone ID: LIB3075-021-Q1-K1-E10
gcaaatcaccggcaaggctaccaagatcctatgtcattcctgtgttactctccgtggtcgggggggctttttttggccgcgggtggtgagatagaaaagctaaacgacatgcccacgtactccaccttccctaagctgctccatgacaccaacgacttgggcgcctccaatcatgtccagacagacacgcctctggctgttcccga

SEQ ID NO: 64642 - DNA, 349 bp, Zea mays
  Clone ID: LIB3075-021-Q1-K1-E12
aaagcaatcacagccggacgatccgagcagagaaggggaggtacctgctacgactagctagattccacgcgcgatggcgcccaccaggatccgcgtggccttgctgagcttggcgctggtggggctgctcatctgccacctcgccaccaccgccttcgccggcaagaacagaatccgcatcctcgacagcgtcgacgactcggccggggacaacaacagctccgacgcctcggccggggacaacagcaccgactccgagtcggaaggccgcgtcgtctattccgacatgaagctggctgatgagacgggatctgcgccggctccggcaccggcgccggggccgacgacc

SEQ ID NO: 64643 - DNA, 457 bp, Zea mays
  unsure at all n locations
  Clone ID: LIB3075-021-Q1-K1-E2
ttccactcctgaagcatctttctctccagaaagatgtcagacctgtattgcatgaaagggttcatatgccagaatggttccaaaagcatgggatcccccaaactaatcagtctgttttaactggcaggatcatcgacgagcggaggaggaggttgaagtctgatgtggttgagatgttgacatgcattaaaaattgggaggatgctgaagcaaggatgcaacacatggtggatgacaaagagcttgaagaaacatttgaaaatgtttatcttgattagtctctttgtgaccatttgtgcaatgggactgtaatattatgcacctgaactttgtttattgtaaggacagtgaactctttaatgagttgcgttgtactctntttttctgtctaaggtttctcacaagggtgagctttacctagacaggtttttaacgaggcagccattgcactacagct

SEQ ID NO: 64644 - DNA, 458 bp, Zea mays
  Clone ID: LIB3075-021-Q1-K1-E3
gtttaaataaggagacaggctgtgtagtgtagtctagtgctaccaggatcggatcagcggctgctgcgcttcagttgccgccggcggcatgagggtggtggtgacgggcgcgacggggtacctgggaggccgcctgtgcgcggcgctggccggcgcgggccacgccgtgcgcgcgctcgtccgccactccagcgacgtctccggcctgccccgcgacatcgagatgacctacggcgacgtcaccgacgccgagtccctcgccgtggccttcgacggctgcgacgtcgtgttccacgtcgccgcggccgttgagccgtggttgcccgacccctccgttttcttcaaagttaatgtacgtggacttgagaatgtgttgaaggctgtcaagagaacaccaactgtgaagaagataatctacacatcttctttctttgcaattggtccaactgatggttatg

SEQ ID NO: 64645 - DNA, 454 bp, Zea mays
  Clone ID: LIB3075-021-Q1-K1-E4
cggacgcgtgggaaataattgggaataaatagttcgtgaatccctgaagcgtgcatatggatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatcttgttcatgtatgctc

SEQ ID NO: 64646 - DNA, 427 bp, Zea mays
  Clone ID: LIB3075-021-Q1-K1-D10
tcgcccacgcgtccgcccacgcgttcgcggacgcgtggggtcctccttctcctcgtcggaggagaactgtccgctgtcgtgactgacgttggggaggtcggcctcattcttgatggggcgcagacctgggcgtcgcgcagccgcctctcccacgtggcgacgttgcgggagcagtgcgggagacgacatcaggagtgcggaaggtggaggggaatcaaccactgcattggtgtagattggcgggcaacctgtccgggctgtcatcgtcggacggcgaccaaatctatgcagcccgggtgttggtggcctccaacgaggcctctcctcgactgacgtgggggacgcgacagccatcgagcgcaaggtggagataatggggttctcgaggatcctcgcgtcgcgcaggacacatagttaatctaaatct

SEQ ID NO: 64647 - DNA, 394 bp, Zea mays
  Clone ID: LIB3075-021-Q1-K1-B6
cagagccagtacgtgcgaagcagcacgcacgctgctggtccgcgtacgcgagacgacgggcaggtcggccggtgcctttgagtttggaataatgacggcgacgacgacgacggccgtcggcggcggcaaggtgcagccgcgcgggctgcccgcggcgctgtccctgctgctgctcctggtgttggcagcggggctgggcggtggcgccgaggcgcatcagacgtgcgcggggcagctgcgcgggctggccccctgcttgcgctacagcgtgccgtccttgccggggcaggttccgtcggcgcccgggcccgagtgctgctccgcgctggggggcgtgtccagggactgcgcctgctgaacgttcagcatcatcaacagcctgccggtcaagtgc

SEQ ID NO: 64648 - DNA, 451 bp, Zea mays
  Clone ID: LIB3075-021-Q1-K1-B7
cgtgaagaacgctttcgtgctctatacaaagggtggcttccatctgggatcggcgtcgggccatatgtgggtctcaacttggctgtatatgagtccctcaaagactggctactccagacaaattcatttggccttgcaaatgacaacgagctgcacgtagttacaaggcttgggtgtggagctgtggcgggaaccattggccagactgttgcatacccgcttgatgtcatcaggagaagaatgcacatggttggttggagccatgctgactctattgttactgggcaaagcaaagaagcactccagtacaatggcatgatcgatgcattcaggaagactgttcgtcatgaaggagttggtgctctgtacaagggtcttgtgccgaactcagtcaaggtggtgccctcaattgccattgcatttgtgacttacgaggttgtgaaagatgttc

SEQ ID NO: 64649 - DNA, 443 bp, Zea mays
  Clone ID: LIB3075-021-Q1-K1-B8
tcgatcgatcgagctttcgttatcctcctcgatcttaattacaggtcatagctaagcaggtgtgacaggatgtcgtggcagacatacgtcgatgagcacctgatgtgcgagatcgagggccaccacctgacctccgctgccatagtcggccacgacggctccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaagggatctggaggcataactgtgaagaagacagggcatgcgatggtggtcggcatctacgacgagcccatgacccccggccagtgcaacatggtggtcgagaggctcggcgacta

SEQ ID NO: 64650 - DNA, 70 bp, Zea mays
  Clone ID: LIB3075-021-Q1-K1-B9
gataaagcaaaggttactcttgaacacacctctcttctgttatccaatctttactcatccacgcggaggg

SEQ ID NO: 64651 - DNA, 412 bp, Zea mays
  Clone ID: LIB3075-021-Q1-K1-C1
gtcatcgatctcgtttcaaatccatccatcctcgtttcctccgtcccgcagcatctcaggcccatggccaggatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgggtttggctgcaggaaccctgaagagatcccgtggggttcggttggtgctgaaatatgtgttgagtctactggtgttttcactgaccaggagaaggctgcagctcacttgaagggtg

SEQ ID NO: 64652 - DNA, 433 bp, Zea mays
  Clone ID: LIB3075-021-Q1-K1-C11
gctgcgcgtcacgctggacctcatcaccgaggcttccggctccatgtcggccgaggtcgcactgccgccgtcggacgcgccggcgccgttcggagggtacggctcgtcggctggcgcccccgcctacggcgctccgtctcctgatgccccatcttatggcgccagcgtaccatcaccgacctcggagcagagtactgcttcgactgcatgagtgatatcgtggcggcacacacgcatcttggtcactcctatccatgggtcgaattaccgaccgaaaagtctggttcctcggccaatttctcgttcccggtcagctaggggaagcatttctcggcccggtatcacattttaaaaatatgaaagtcaattttttttgttcaaaacgaaactttggaacagtgaatcgaaaaagggaagcctgttgcttactatg

SEQ ID NO: 64653 - DNA, 305 bp, Zea mays
  Clone ID: LIB3075-021-Q1-K1-C12
gaaaatagtgggatcgagttgtttcactgcacgagcacatcctccggcgaccaccggcctgcctctccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgacgagccggggcacctcgccccgaccggcctgatcctggg

SEQ ID NO: 64654 - DNA, 386 bp, Zea mays
  Clone ID: LIB3075-021-Q1-K1-C2
tcgcccactcgtccgcccacgcgtccgagctcagccaccctaatgttacaaagtttgttggtgcatctatggggaccacagaccttaagattccatcaaacaattccaatggtgctgcacgtacaaatttgccagcaagagcatgttgtgttgtggtagagtatcttgctggaggaactttgaagcaatatttgataaagaatagccgacggaagcttgcttataaagttgtggtccagcttgcattggatttggccagaggattgagctatctgcactccagaaagattgtacatcgggatgtgaaaagcgaaaacatgctgcttactccacagagaaaccttaagattgccgatttcggtgttgctcgtgttgaggctcagaat

SEQ ID NO: 64655 - DNA, 376 bp, Zea mays
  Clone ID: LIB3075-021-Q1-K1-C3
cgttactgtttttagtcgttggcatttcaatggctctgacaccatggttagctgctggagggcagtttctggcatcaaaatttgagcagcatgatgtgaggagtttattgcctgtggaaagtgagactgacgatttgcacgaccatattattatattaggctttggacgtgttgggcagatcgttgcgcaactcctgtcagagcggttaattccttttgttgcccttgatgttagaagtgatcgggttgcagttgggcgtgcacttgaccttccggtatattttggggatgctggaagcagagaggtactgcacaaagttggagctgaaagagcttgtgctgctgcaattactttggatacccctggtgcaaacta

SEQ ID NO: 64656 - DNA, 429 bp, Zea mays
  Clone ID: LIB3075-021-Q1-K1-C5
tgatgctatgctctgttcagtttaaaactctggtgaaggtccttgaggtgaggtatgtgatgacttatgagtagaagatgacaaatatgctctttccctatgatggaagagtatattctgtaacagacaagcctggaaaccccactcaggtgaaatgtgccagagtaaattgaaaggggatcatttatgatgtgttctgatgcaatcctaatgtggtgaatggggaaaacctcttctgtggctcttcaactggggtcttaactctcatctcgtgctgacttcctgaccttccagtttaacatggtgctgggctgcctctacgtcaacctggttggtccaggctgtgcagtctccaaccatggttgtctccaaaggatgtgcagctgacgtgatggtgcttatcaccacaccctcagagctcatcaccac

SEQ ID NO: 64657 - DNA, 425 bp, Zea mays
  Clone ID: LIB3075-021-Q1-K1-C6
gagcaagattggctcgtcggactccggcgctgccgccaccggctcggcagccgtcgccggtgccgtcgccgctgtggggtcggttgcggcgctgggcggcggcatcccggaatcggtcaccgtggcatgccccgaccacctggtgatcgcggacctacccgtcgcgaagagcctcggtgccgtcacgacctccgctgccgccgtcacgcgcgccatcggccgtcgctcccgtcgcccgctcggggagcgcgtccacatctgctcccgctgcgagttccccatcgccatctacggccgtctcatcccttgtgaacatgccttttgtttaacctgtgcaagaagtgattccagctgctatctttgtgatgagcgcattcagaagatacaaagtgtgaaaatgatggaggggattttcatctgtgctg

SEQ ID NO: 64658 - DNA, 452 bp, Zea mays
  unsure at all n locations
  Clone ID: LIB3075-021-Q1-K1-C8
gccagctatcacattcgctagatcacaccaatgataaggaacaggtcaagccctacaagggctacatncacaacgttccgaggggactacacgcacattcacaacgccgcagctaatacagcaccaataccattcccgcgacaacaaccatcggctggaaccgacacctaagcctcgtactgtcgtgacccgacgatgaccaccctgaacctacccgactacccgaatcaatgaccgactccaactgcgacacactaccgtgcacgccttacgtgacacaacgaccacgcgagtaccatcgtgtgtcgccaaatgagactcatggactgcaacgcactatcggctcccatacagctcggacctcaccataggccatcgtcacacgacgcaaccgtgcatctacacgatcgaactaaaagacagccacgatgaggacatatactcactagtgc

SEQ ID NO: 64659 - DNA, 360 bp, Zea mays
  unsure at all n locations
  Clone ID: LIB3075-021-Q1-K1-C9
gtcaattgagcaagcatcgacgagaatagggaagaagtacatgaatcaccgcgggtccatgcggtggcatggttgggagctctgcgctgggtggattgcgcagtgcggacacgaggatctgaggaatcatcctggtacctggaatctcaagtcccaggagaagaacaggtggttcaagaggatccacacagtgaggagttcgatttgatctaggtggcgtctcccagttgactttatgacgccaaggatggactttagtttgatctatatttatattttattttggaagactaccactatgtaataagtactctgatgatattgtgacatttatctctcanaaaaaaaagatacaataac

SEQ ID NO: 64660 - DNA, 343 bp, Zea mays
  Clone ID: LIB3075-021-Q1-K1-D1
tcgcgatgcacaagcggagacggtcctcgagaggcgcgtggaggtggcagttcctgagatgggctgaggcggcggttctcgaggggcacgcgtggtggcggctccgcaaagggcacacggtggcggtggccccctaggcgtgcgacggcggctttatgcacattaggggtgccactgcccgtgcatgcctctggccaacgtcgctcgtgcctcccgaggacgacattctccgatccggaggctttggggcatcctcctccgacgacctcatctgctccatgcgttatgcattctataatatttttatgtcgaccggtgcaattttaatgcattccatttgagt

SEQ ID NO: 64661 - DNA, 451 bp, Zea mays
  Clone ID: LIB3075-021-Q1-K1-B5
ctgggagtccaccgtcaggaacgtcaagttcgtgtcggacaagacggggaagccggtgtgcattatcacccccaccgaggccgcgcacattcaggccaccgtggcgtgcgggcgcaagcacgggctgcgggtccgcgtgcggagcggcgggcacgactacgagggcctgtcgtaccggtccgccaagccggagacgttcgccgtggtggacctgtccatgatgcggcaggtgcgcatcgacggcaaggccgccacggcgtgggtggactccggcgcgcagctcggcgagctctactacgccgtggcgaagatgacccccagcctcgggttcccggcgggcgtgtgcgccacgatcggcgtcgggggccacttcagcgggggcggcttcggcatgctgctgcgcaagtacggcaccgtctgtgacaacgtcatcgacgccaaggtggtggac

SEQ ID NO: 64662 - DNA, 434 bp, Zea mays
  Clone ID: LIB3075-021-Q1-K1-A11
cggacgcgtggggtgctcaaggcggccatggccatcaatgccaactgcctcatggagatgagcatcccggacacgtatatagacacgctccctaagaacgggagagccagcctcggggacgcgctgtaccgaatcatcacagatgtggagttcgacccggacgacttcctgtcgacggtggacctgacgtctgagcacaagatcctggacctcaaggaccggatcgaggcatcggtcatcatctggaacaggaaggtgcacaacaaggacggcaagtcctcttggggctccgccgtcagccaggagaagagggagcagttcgaggagcgggcgcagacactgctgctcatcatcaagcacaggttccccggaatcccccagtccacgctcgacatcgcaaagatccaagagaacagggacgtcgggtttgcgct

SEQ ID NO: 64663 - DNA, 399 bp, Zea mays
  Clone ID: LIB3075-021-Q1-K1-A12
cgcctaagcagctatcaaccaaccctagaaagctagacaccgtacccatggctcgcgctagcgtcgtctttgtcattgccgctctcctcttcgtcgccatggtcgtagcaccgatggccgaggcaaagtccgccgatgcccctgtggctgacgcgccagccgatggacctagcgggccggctgctgcacctggcccccagggtgtcgaaggcctgtcaggcaatgaggatgacaatgatgacttcaccaattgaggccacacacgtcggcccggttaaatttggaacaagacatggaagaaaaatgagagcaatgtctttaaaaccatgataatgtgtggtcatccactcatccatggatacatccttgctctccctctttttctttctggttgatttt

SEQ ID NO: 64664 - DNA, 459 bp, Zea mays
  Clone ID: LIB3075-021-Q1-K1-A2
cgacgagtgagcgcgatggaggcggcgctgcgcgggatcagggccaagctgacggagcagcgggagaaggtgatcagcggtctgctgctgggctcggcggtggcgctggggtggaagtcgtcggagcagcagcgcgagatccagagcctgttggccgagaagagctctctccgagccaccaacgcctctatgtccgccgccatgtgggcctggcgggaggagctcttcgccctcgccgccgcgccctcctcccccatttccgcgtcccggctccgccacatctacggcgaggaggagcccgcgccgctcgcgcccgcgcccgcgccgtcaggagcaaatgatgggaaggaagaggaaccgatctccatagcctgaactctttccgcacttttttccagtcgagcgtgtgccgtccgtgtacatcatggccggctccctgaaggctaggaggatgctttg

SEQ ID NO: 64665 - DNA, 419 bp, Zea mays
  Clone ID: LIB3075-021-Q1-K1-A3
gcaagggctgcggctcatgctacgaggtgagatgcaaggaaaaacctgagtgctcgggcggtccagtcacggtgtacatggctgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctc

SEQ ID NO: 64666 - DNA, 407 bp, Zea mays
  unsure at all n locations
  Clone ID: LIB3075-021-Q1-K1-A4
gcaagggctgcggctcatgctacgaggtgagatgcaaggaaaaacctgagtgctcgggcggtccagtcacggtgtacatcagtgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggngcgccatctggaggatggacact

SEQ ID NO: 64667 - DNA, 421 bp, Zea mays
  Clone ID: LIB3075-021-Q1-K1-A5
tcgcggacgcctgggggccgtccgtgatgaatgcaagctcaagttccaggggctcaaggcggggaggagcttgcgcttcatcgggttcaagatcaacgagaacgtgcagcaggtggtggtggacaggctacgggagccaggcgagagctacgacgccttcacggcctgcttacccgacaacgagtgccggtacgccgtgttcgattttgacttcgtcactgacgagaactgccagaagagcaagatcttctttatctcttgggccccggatacatcgagggtgagaagcaagatgctgtacgcgagctccaaggaccggttcaagagggagctggatggcattcaggtggagctacaagcaaccgacccgagcgaaatgagcatggacatcgtcaagtcgcgagccctctgaaacagcccc

SEQ ID NO: 64668 - DNA, 439 bp, Zea mays
  Clone ID: LIB3075-021-Q1-K1-A6
cggacgcgtgggcccatcgcgtgccctcgccgcagccatcttccatgggggaccagctgacggacgagcggatcgcggaggtcaaggaggccttcagcctcttcgataaggatggcgacggctgcatcactaccaaggagcttggaactgtgatgcgctcccttggccagaaccccactgaagcagagctgcaggacatgatcaacgaggttgatgctgatggcaatgggaccattgacttcccagagttcctgaacctgatggcaaggaagatgaaggacaccgactccgacgaggagcttaaggaggcctttcgcgtcttcgacaaggaccagaatggcttcatctcggctgctgagctccgccatgtcatgaccaacctcggcgagaagctgactgacgaggaggtcgacgagatgatccgtgaggccgatgttga

SEQ ID NO: 64669 - DNA, 448 bp, Zea mays
  Clone ID: LIB3075-021-Q1-K1-A8
cccgccccagccctaggtcccggcgtcctggcgtccagccggcgcggcaagccggtgcggccagcccagcgtggcggcctgacgcggctcgccagcatggatgcctcaccgacgcgtccccgcacgcgcccgatcattgcgtggaggagttgcacagcctcgccatcggcacgccgatcatgccccaccatgcacggccgtcgtcatcaggaggagagacgcggtgagcatgcgcatcaccttcgtcgtgcgtccaagcctcgccatcatcgagctcgtcgacgccttcgccctctcgccatcgaggagggagccacgccacgttcaccttatggtagtttgtcgcggaggactgcgatccatttccgagcttcgaggaatcgaagatcaaacttcggcgaccaaatgacctagttcttcgagttccacgagattgaagaccctaagc

SEQ ID NO: 64670 - DNA, 407 bp, Zea mays
  Clone ID: LIB3075-021-Q1-K1-A9
cacctcttggggatgtagcggcacaggttaatgtgcttccagccactgatgacctagatggacaacagcctacagaagagatcgatactgatcaggcacctgagccaatggtagaggttgaggcaacaagggaagaggatgggggtgataaagatgactctggagatgcatcaacggacatcaaaggccaggatgctgatgctaatattgacgcaaatgcaattcctttagaagaagagcatgtagtggcaaagtcagaggcaataattgaatcatttgatgatgaccggaaaacagaagattcgaaggaagatgctcagcgtactactgcaactgatgttgatgatgacatggaggagggagagttggcaaaagaacctgaagacaagagtgacgttgatatgtca

SEQ ID NO: 64671 - DNA, 287 bp, Zea mays
  Clone ID: LIB3075-021-Q1-K1-B1
tcgggcggcggaagcggaagcggaagcggaagcggaaggaagtaggcggccaccatggtgaagggacgcacggggcagcgcgtgaggctctacgtgcggggcaccatcctcggatacaagaggtccaagtcgaaccagtacgagaccacgtcgcttgtgcagatcgagggggtgaacaccaaggaggacgtcgcgtggtacgctggcaagcgcatggcgtacatctacaaggccaagaccaagagcagtgagacccgctacaggtgcatctggggtaaggtcacccg

SEQ ID NO: 64672 - DNA, 292 bp, Zea mays
  Clone ID: LIB3075-021-Q1-K1-B10
cccactcgttcacccactcgttcgttcactctttcggaatcatcaattaccaattgaggggctctgtattgctcaatggagtgctgtttctaattttaccttaaagtatgctttctctatcattcatttgcatatatatgttgtcatatatttgtttcacactcatattattctgatatctagttactattatctatgcaactgactttttaatcacatgattatgtattactatcttcttgtgttttaacacactttatatctgatacacactttaaatttgattttctaa

SEQ ID NO: 64673 - DNA, 426 bp, Zea mays
  Clone ID: LIB3075-021-Q1-K1-B11
gctggttcgtggatggcggtgccacaacctctcctgctgtcgctgctggtcgccgtgctagcggtggccgccgatgtcgccaacgccggccacgccaagcccctaacgcctggcgggcgcgtggtacacgacaaccacggcaagttcacggccgggccgtggaaacccgcccacgcaaccttctacggcgggcgtgacgggtccggcaccacggcgggcgcgtgcgggtacaaggacacgcgcacgcaggggtacggcgtgcagacggtggccgtgagcactgtgctgttcggtgacggcgcggcctgcggagggtgctacgaggtgcggtgcgtggacagccctagcgggtgcaagcccgacgcggcagcgctggtggtgacggtgaccgacctgtgcccgcccaaggaccagtggtgcaagcca

SEQ ID NO: 64674 - DNA, 452 bp, Zea mays
  Clone ID: LIB3075-021-Q1-K1-B2
tttttccttagctatgcagaggaaaaatgatgctgttcgtcccagtttaaacaaagggacggtggtttatgatccacattcgacacatcagatgaaaaaatgatttggtctgggaacaaaggccaccaaagattttttatcggctacaataaatacaaatgttgagacaagctcaatcttcctcctcacgaatcagcgcgaaggagaatggggcaaacttgtagccatcaccttcatagaacttgttctggaactccacccagtgaagcctcagcgcgtgaaggaatgcactcagggtctccataacaagcaagacaccaatcgtggcaaagatgaagatgacgacaccaataataaggatgaaaacattgttaaacccatatgccgtcattagtactttctcgtagaatacagtggacaactcatagtgtgcaagactcagagcccaaaga

SEQ ID NO: 64675 - DNA, 437 bp, Zea mays
  unsure at all n locations
  Clone ID: LIB3075-021-Q1-K1-B3
cgacaagacgagacaagagaatgcctgtgagcaggatcgccgtgggcgctccgggcgagctgtcccacccggacaccgtcaaggccgccgtggccgagttcatctccatgctcatcttcgtcttcgccggctcaggatcgggcatggccttcagtaagctcacggacggtggcgccgccactcctgccggcctcatcgccgcgtctctggcgcacgccctagccctcttcgtggccgtctccgtgggtgccaacatctccggcggccacgtgaaccctgccgtgaccttcggtgcctttgtgggcggcaacatcagcctcctcaaggccctggtctactgggtggcccagctcctgggctccgtcgtcgcctgccttctnctcaagatcgccacgggcggcgcggccattggcgccttctcgctgtcggcgggcgtc

SEQ ID NO: 64676 - DNA, 315 bp, Zea mays
  Clone ID: LIB3075-021-Q1-K1-B4
cccacgcgtccgggtggctgttgtctgctcctggtcttcagaagatattgttaaaatatgatggttcataggatatctagtgtatagtcttcttgcagcaaagaagataatgttttgctgtttcagcaaacatctgaagtatgagtcttattattaagaggtcttttctttaacttatggcgagtttagcatcggtcagttatcaaacagttaaagcgttttctgaaatcttgtttgaatatccgcagtcctttttttggtttggcatgcagaattattctgaaacgtttagtaccccgttgttcgtaaaataaa

SEQ ID NO: 64677 - DNA, 308 bp, Zea mays
  Clone ID: LIB3075-021-Q1-K1-A10
ggcagttgatgatctagacttggttatcaaaacccttgaggaaaacggctttaaagatcggttttatattcattgtgatggtgccctttttggattgatgataccatttgttaagaaggcacctcaagtgacatttaaaaagcctattgggagtgtcagcgtctctgggcacaagtttgtcggatgccccatgccatgtggtgtccagataacaaggttggagcatataaatgccctttctagcaatgtggagtatctggcgtcaagggatgcaacaatcatgggaagcaagaatggccatgccccta

SEQ ID NO: 64678 - DNA, 460 bp, Zea mays
  unsure at all n locations
  Clone ID: LIB3075-020-Q1-K1-G3
ggggatgttccagagccaatcatgctcaaggaaggtcaagagttcaacttcacgattaaaagaggggtgagcactgaagacactgtcagcgtgaactatgatgacttcataaatgatgttgaagctggcgacatactattagtggatggaggaatgatgtcgcttgctgtgaagtctaaaacagccgatacagtcaagtgtaaagtagttgatggtggggaattgaaatcacggcgccacctaaatgtccgtggaaagagtgctactttgccatctatcactgagaaggattgggaagacataaaatttggtgtcgaaaacggcgttgatttctatgcagtttcctttgtgaaggatgccaaagttatccatgaattaaaagactaccttanaagtgctaatgccgatatacatgtcattccaaaaattgaaagtgcagattcaataccaaacctgcagt

SEQ ID NO: 64679 - DNA, 459 bp, Zea mays
  Clone ID: LIB3075-020-Q1-K1-G4
cggacgcgtggggcaaagaaaaacaatgttaatacttctgcactgacacaatctgaaatgcgggatatcattcttggcgctgaaattgctccaccatcacagcagaggcaacagattgctgaaattgagaaacagtcaagagagactactcagttaactgctgtaaccacaaggacgacgaatgtgcacggagatgaactcattatcacaaccacaagtccatatgagcaacaagcattcgcatcgaagactgattggcgtgtcagagccatctctgccacaaacttgtatctacgtgtaaatcacatttatgtcaattctgatgatataaaggaaactggctacacttacattatgccaaagaacatattgaagaaattcatatgcatagcaaatctgcgtacacaaatcgctggattcttatatgggctgagtccacaagacaatcctcaagtcaaa

SEQ ID NO: 64680 - DNA, 355 bp, Zea mays
  Clone ID: LIB3075-020-Q1-K1-G5
aaaaaaaaaaaataataataaaagaaaaaaaattaaatcaacttcacaaataaaaaaaggggagagcactaaagcacactgtcatcatgaactataaattacttcctcaaccatgttaaagatccaacacttactatcacttgcattcaagaattatgctgctttatattaacaccaaaacaaaactaactaaccaacgttttaaaacatcttaattggaaaaacaaataaccttccccacctaaatttccttgaaaaacatccacctttcacctattgcctttataaaaattagaccacatccaatttcctttccaaaacagtgttcatccttatttaaaaatctgacccaccc

SEQ ID NO: 64681 - DNA, 169 bp, Zea mays
  Clone ID: LIB3075-020-Q1-K1-G6
tcgtaaaattctgtgcatctgtcattgtttctgtttcttaccatcgttttttactatcaggttcaggggttctaccatacacatttcataaatcaaaccagtggttacttcttcatcaatttaatacataggtttccccacctcacccgttaattaatgcttatacccc

SEQ ID NO: 64682 - DNA, 246 bp, Zea mays
  Clone ID: LIB3075-020-Q1-K1-G7
tctccccaatcgcttcctaattgcagcacttgcatatttcacctttgacctatatacatgcggcatggctctatcatcattcttactccatactatatattttactctatcaccagaaatcatgcactcatacatattactttcctaaatgaactctatctcttacaacaacatattttcactcccattcctaactctcctcactatatcaacatgacaattcgaagattctcttacacatttatc

SEQ ID NO: 64683 - DNA, 405 bp, Zea mays
  Clone ID: LIB3075-020-Q1-K1-G9
atcaaaatcactttgcgtgcagcatcgattgggtcggaaatcgagggtttggtaagcgagatcggcgccggtgacagctgacagggacgagatggacgccggcggaggcggcgtcttggtcgccgttctctgcatgctgctggtcttcgccatcttccccctcctcctctggcgccgccgctccgatgccgccaccgccgataaccaccgcgttccgccccagcccctccaggaggatcatgtgctgcacggtcgcgcggcggcgcgacggatgcgtcggaggcctggggctgccggagcaagctcctctactgcgtcaactaaccgcaatgctgtaaaggacgacgcggagagtgacgatgaagaggtccccgaaagtcgcaacgtccccaaatccttcaaaaa

SEQ ID NO: 64684 - DNA, 412 bp, Zea mays
  Clone ID: LIB3075-020-Q1-K1-H1
atggggttattcttattcctgagggccttgtggagagtattcctgaactatatgctctgcttgaggaaatccatggcctccatggcaaaggtgtttctgttgagaatatctcttctcagctttcaccttgggcatctgcactctttgagtttttgcccccttttatcaggaagcagctactactacatcctgaatctgatgattcagctcaactttcccagattgagactgaaaagctgctagcccagttagttgagactgagatgaacagacgtttgaaggagggcacttacaaaggaaagaagtttaatgcaatctgtcacttctttggctaccaagctaggggagcactgccttcaaagtttgattgcgattatgcctacgttttggggcatgtgtgctaccacatcat

SEQ ID NO: 64685 - DNA, 466 bp, Zea mays
  unsure at all n locations
  Clone ID: LIB3075-020-Q1-K1-H10
aaaaaagggacgggcggggcgtacgcangaagatnctatatnatttaaaaatgcggttgtcttacaaacaaaaacttgaactgnaagtgtaacattttaaagggaatctggacgtataaaaccatattggaaaggaagatgcaaaatcgaaggaaatgctcgataagttgcatgaagcactgaaagagaaagatgaagaaatggatcatattgattctataaaccagacccttattattaagcaacgaagaaccaatgatgagctggaagaagccaagaaagaactgactactgacctacttaatatgtcatcagctcgatccattgttggtgtcaaaaaaatgggtgagcttgacaagaaagctttcattgtctcttgcaaagagaaaacatcagacgagttgtcattgtcaattctgtgctcgaaatgggaagatgagatcatgcaaccagaatggcatctttt

SEQ ID NO: 64686 - DNA, 395 bp, Zea mays
  Clone ID: LIB3075-020-Q1-K1-H11
cgtccggcgaccgaaccgcggatttcacccctgccttttcttctccccgtgtccaggccctggtgcccgcgcgttcccgtgcggcaactggccgccgccgccgcactacgccaggtgcccaattcctcgtcgggtcctccgccggcgacgagcacccaccagaaaactggagtggactctacatgtcaagacagtatggcgccaggaagcaaggcggagaggaaagcagcactagacgctggcgcatggatgttcaatgtcggcacatccgttggtatcatcatggtcaacaaagccttaatggcaacgcattggtttagtttcgctacaacgttgaccggacttcatttcgcgatgacgaccttgatgacattagtaatgaaatggctggatat

SEQ ID NO: 64687 - DNA, 364 bp, Zea mays
  Clone ID: LIB3075-020-Q1-K1-H12
gaaaaaacagaacgacccacgcgtacgccgacgcatcctcatatatctcccctcactttttttgacagcctgtccacacactaaggacctctggttttcatacacaacgctgtccgtctctttttcattctaaccgtgctataatccttatgcacacctaacacgacaacaaccaacaacgaagaaactgcagcagactctacatgcgcttatagaatcaacccaggaaccttcgacatctgcaaactcggatcgaacactgacgcttagacgtactatacaaagacattccatgacaccttgacgttaaacaacgaatcgatcgcaacccccactgttattatccctacagccgactacctac

SEQ ID NO: 64688 - DNA, 414 bp, Zea mays
  Clone ID: LIB3075-020-Q1-K1-H2
aagaaactatggataccaacggctgtaactcagttttgagaatggagtctccctgtaacaccggggacagtaaatcattatccagagtggaccctccacaagtggagttgacttcctgcagtgatctggagaaggtgaaagaaactatggataccaatggctgtaactcagttttgagaatggagtctccctgtaacaccaatgacagtaaatcattatccagagtggaccctccacaagtggagttgacttcctgcagtgatctggagaaggccactgaaaatattaagatggacgaagttgatgagaatgcgttgagtctgacagaagatgtaagcacattagtacatgcaccactaagcaatgataatgtaaataaaaatatgccaaagccagtgagaaattttgatcgag

SEQ ID NO: 64689 - DNA, 397 bp, Zea mays
  Clone ID: LIB3075-020-Q1-K1-H3
gtgagtctcatgccggtggctccttcactgtcacacgtgatacctctggggagcaacttggcgggggtgcaaagatgaccctttacctcaaggatgatcagttagagtatcttgaggagcgccggctgaaggatctgatcaagaagcactcagagttcatcagctacccaatctctctctggatcgagaagaccactgagaaggaaatatctgatgatgaggacgaggaagataagaaggacgaggagggcaaggttgaggatgttgatgagaaggaagaaaaggaaaagaagaagaagaagatcaaggaggtttctcatgagtggcaattggttaacaagcagaagcctatctggatgagaaagcctgatgagattaccaaagaagagtatgctgc

SEQ ID NO: 64690 - DNA, 414 bp, Zea mays
  unsure at all n locations
  Clone ID: LIB3075-020-Q1-K1-H4
gacatcttanataagtagtaaggctctaaaatccacaaggccctcaagtagtagtagtaggtggggtacgctagttagcacgaactggatagatcatgcgagggcgttgacgacgacggggcttctgacatagtgggtcccgtctgtccagacgagcctcccaaagacgtagcccatcccgagcttgtcctgctgcgacgtcaccgtcaccttgaactccttttcctcaccgaccttgctgaactcaagcaccctcggcttcacctccatggtgatcccaaccggcgcgcgccaggacgcgcccacgcgttcgcaccttaccacgcagcgttaccggccgtactactatatctacatacgaccgtgggacaacgtcgaccggagctcgatcggcgcagttgccgcatgggcgtg

SEQ ID NO: 64691 - DNA, 180 bp, Zea mays
  Clone ID: LIB3075-020-Q1-K1-H5
tttctccttcactgtctcacattttacctctttgtatcaacttttcagaggtagatatatttccctttacctcaaagatcatcacttatagtatctttaggaacgccttcttaaagatcttatcaataaacactcatattttatcatctacccaatctctctctttatccataataccac

SEQ ID NO: 64692 - DNA, 323 bp, Zea mays
  Clone ID: LIB3075-020-Q1-K1-H6
atctataggagaaccatcagcctccaattttagccagccagagaaactaataagactctggccgcctccatccgagcgaacaaaccatccgaccccgtccccaatgcaatccgtcttcgacgtaccaccaccaccgcatgagcgagatggagatgaagaggatcctcttcgccgtcctcgtcttcatcgacgcctcggccaccgtaatgctgtccttcaccgaggccttcgtcgagtgcaccccaactgcctccaagtcgttcgccgaggctaccgcttgcgctgtcgcttgcgctgccgcttgcgccgtctactctgagccc

SEQ ID NO: 64693 - DNA, 350 bp, Zea mays
  Clone ID: LIB3075-020-Q1-K1-H9
caggaagatgctatatgatttagaaatgcagttggcttccaaacaaaaacttgaactggaaaggggacagttgagggggaatcttgaggtatggaagcatatgggaaaggaagatgcaaaatcgaaggaaatgctcgataagttgcatgaagcactgaaagagaaagatgaagaaatggatcatattgattctataaaccagacccttattattaagcaacgaagaaccaatgatgagctggaagaagccaagaaagaactgactactgacctacttaatatgtcatcagctcgatccattgttggtgtcaaaaaaatgggtgagcttgacaagaaaactttcattgtct

SEQ ID NO: 64694 - DNA, 477 bp, Zea mays
  unsure at all n locations
  Clone ID: LIB3075-021-Q1-K1-A1
aatcgggcgtaccccggtgcccgttcaccgtcgttcacgccgcgtgtgcgctctggctgtgccgctctctctgtctctcctgcgcgtggcgcagctgccgtcctataccaggcgcccaggtctagcctcgtcggtgccttcgccaggtctttctcgggcccttcgccaacgacgagcgcccgctaggttagaaggtatgcattcgtgttcataatattgtatttgactaaaaagactgggcctacgcatgggggctccaaaacagaggtggacttctgaggaagaggctgctcttagagctggagtagccagacatggagttggaaattggcgcatgatattgaatgatccagaacttagctccacattgcgctaccgctcgaatgttgacctaaaggacaaatggcgcaacatgaatgtaattgtcacttcatcgagtactcgtgacagggggagaacttncacgaggagaacccc

SEQ ID NO: 64695 - DNA, 398 bp, Zea mays
  Clone ID: LIB3075-020-Q1-K1-G2
gaaacttttaaacatttgcccatgtatgttttagaaagtttaatatttgcatgccttctatatgattttgtatatttttcccatattattcattttgcaaattaagtttcaaacgagtacttaggaggttaatgacacagttgtatgattgtatatcttaatggaagatctgttaatttattaatgtttgcttgcataacatgtgcatgatgtcttttgtgtacagtttatcttaaattgaactatataaagatttggtttgatacttctgtatcttttgatcataaactcctatgttggaggccatagacagaactatcaacttaccctacttctcgcatggctaacgttatagatgctagtaaggttctggtgtgcagcttggggttttaaacact

SEQ ID NO: 64696 - DNA, 451 bp, Zea mays
  Clone ID: LIB3075-020-Q1-K1-F1
catcaaactctctgcagggccccggatacatcgagggtgagaagcaagatgctgtgggcgaggtccaaggaccggttcaagagggagctggatggcattcaggtggagctacaagcaaccgacccgagcgaaatgagcatggacatcgtcaagtcgcgagccctctgaaacagccccggccgctgcacctgcacgctgcaggggcgcatcggctcctgcatgcccgtgggtcgtcgaatccttgcttgtgtgttgggaacggtcttgtgttttcgtgtccttgttttcctggaagcaaaagccctgcattctatatgagactgtatgccattttccatctttttctctccccatatctctgccctagtcctgctaccgctgtagactagaacttatttggtgtttgatctcgtggcattgtcgagtcttttatgtgtctatgcaatgctag

SEQ ID NO: 64697 - DNA, 412 bp, Zea mays
  Clone ID: LIB3075-020-Q1-K1-F10
gggacaggtcgaccaagagggggttcgtcgtctgggaccccctcaccggcagccggcagcacgggggcatgcccagcgctagctacccgtcccactcgtgccgctacacctcctacaccggggccgtggtgtgtgccaaggccggctgcgacgacgaccacctcgactgccaggccggtccgttccgcgtggtctgcgtagagaccaacctcctgaagcctgtattcgcgtgcgcgaccagctactcgtcagtgaccggcgcgtggagtgctcccgtgcccaaccatgacagccacgacttcaactactactgcttgagaagctatggcaagcagagccttcttgtcggcgatgccgtctacttcctcttccaggatgaccaaagcatcctcacgtacgacctgggtaggca

SEQ ID NO: 64698 - DNA, 418 bp, Zea mays
  Clone ID: LIB3075-020-Q1-K1-F11
cggacgcgtgggcgaagccccacacacacaaaagcaaaaagcatcatcacaataatggcccgcgcgtgtgtgttcctcgtggtgctcctcctggccgccgtcgcggtggcgccgtttgcgggggctgcgcgtgtggatgtcgtggagggcaggtccatggcgtccgccgacgcgcctgaggcggcggctgacgcgcccgctcccggtcccgactccgcctcatacccggactcgccgtcggaggcgccctccagcagcagctcattcgactagccgcgcacaacgcagttcttgtcatgatctatctagcaaataaaaagatcatatgtctcgtttgattctctggaataactaatagtatatatgctgcgcccggatgatatataaatatgtgcatcaaatgcgtgcggcaaacgca

SEQ ID NO: 64699 - DNA, 440 bp, Zea mays
  unsure at all n locations
  Clone ID: LIB3075-020-Q1-K1-F12
cgccatacccttcgacgagctcaaaaggatcaccaacaacttcagcgaccgcgccctcatcggggagggctgctacgggcgcgtctacaacgccacgctcagcgacggccgcgccgccgtcatcaagaagctcgacaccagcgcctcgcaagactccgacaccgacttcgccgcgcagatcgcgatggtctccaagctgaagaacgagtatttcctggagctcctagggtactgcttggaagacggcaaccgaatgctaacctatcagttcgccacaatgcgttctttgcacaacatactacacgggaagaagggagtccagggcgcggagcccggtcccgtcctcaactgggctcagcgagtcaagatagcctacggggcagcgagagggctggagtacctgcacgagaaggtccagccgtacatcgtncaccgggaca

SEQ ID NO: 64700 - DNA, 325 bp, Zea mays
  Clone ID: LIB3075-020-Q1-K1-F2
gcgcgccgcctcgctgccggctgccggcactgggacgggagccgctgccgccatgccggtggggtactgttactactacggcggctcattcgccgcggtggagacggcggccttcttgaaggcgtgcggccgatgcagccgtcgcctcgggcccggccacgacaccttcatctacaggggcgaggtggcgttctgcagccaggagtgccgggagaagcggatcgagtacgacgagcgcatggagaagacctgctgctcactgacctccatcaaggaggccccgtccgtgtccggcgccagcggctccgaccagtccggcagcggc

SEQ ID NO: 64701 - DNA, 415 bp, Zea mays
  Clone ID: LIB3075-020-Q1-K1-F3
cattctggaaggagcttgatggtgtcaagcaggtatggaagaacaggaaggacctcaaggttgaggaccttgggattgcgactttatttggagttgagctttatgcatggttctgcgtaggcgagattgttggcagaggtttcaccttaaccggctataaggtctagttgatttccagtgatttaagacctgctttataaatcgacactttagctgatgcttgtcgaaacgacgatgatacctgccttccttcacaattttgtttcttgtaagagtctacctagtgctgaatgccagcaaagacgggcacatggttgcaacattgcctcaataatttgcccgcgcaattcttgattttgatgcatgtaattctttgtcagttgcatgtgctgcagtccctgcgtgcagactcaaa

SEQ ID NO: 64702 - DNA, 458 bp, Zea mays
  Clone ID: LIB3075-020-Q1-K1-F4
cggacgcgtgggcggacgcgtgggcaaaacatcccctcgaaccatggttgttttgcgacctcgaaaggtggtaataactaacttggaagaaggaaaagtactagaccttgatggcaaaatgtggcctgatgcttctgatactgatgcttcctcccactataaggttccgttctcaagaactgtctacattgagaaaactgattttcgcctaaaggactcaaaagactactatgggctagcccctggtaaatctgtcatgctaaggtatgcgttccccataaaatgcacagatgttatctctggtgatagtcctgatgatattgttgaaattcgagctgaatatgatcctttgaagacttctaaactgaagggtgttcttcactggattgctgagccagcacctggtgtagagccattgaaggtggaagtaagattattcgagaaattgttcatgtcag

SEQ ID NO: 64703 - DNA, 420 bp, Zea mays
  Clone ID: LIB3075-020-Q1-K1-F5
cgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatcttgttcatgtatgctc

SEQ ID NO: 64704 - DNA, 398 bp, Zea mays
  Clone ID: LIB3075-020-Q1-K1-F6
gtaaagatgataagaaggggcatgatgatcagctagaaataccagaacctgcataaggggcaggtgaagatgagttagaaattccagaacctgccgaagaaaattatggtggttatcattcagaagttgaggatgataggcgtaaatatgaagatgaagagttttatcatgagtcagaagatgaatatgttgacgactatgatgagcatgttgagtcctacaaatctgatgatgaccaaaaagatttaactgagccaggacatgcatcgtggttggacaaagttcagcagactgtacaaaatgttttccaaaaattcaacttttttaagacccctgtacatttgtcagaggcttctcatgttcgtaaggagtatgatgatgctagctcaaagctttca

SEQ ID NO: 64705 - DNA, 444 bp, Zea mays
  Clone ID: LIB3075-020-Q1-K1-F7
gagacaccaatcatcaaacttgtcatgcagctttcaaccaacccattatagacaccggacccagggctcgcgctagcgtcgtcttcgtccctgctgctctcctcttcgtcgccatggatgtggcaccgatggccgaagcaatgtccgctgatgccccctacgacgatgcccgcggactcgctgctgacgcacctgtcgatggacctatcggaccggcaggtgcacctggtccacagggcgtagagggactatcggccattgaggacgacgacgatgactccaccaactaaggccaagcacgtctgtccgattgcatttggaacatgatatgaaagaaaagtgagagcaatgtttttttaaaccaaaaatccataataatgtgtggtcatccgtgatatgtaattgatctccctctctttctttctgtttgatttcgatgtgtta

SEQ ID NO: 64706 - DNA, 461 bp, Zea mays
  Clone ID: LIB3075-020-Q1-K1-F8
ggtgaccgccgccgacctcaagccccgggccacgctgacgtgctctcccaagaagcgcatccagcaggtggtgttcgcgagctacggcaaccccatgggcatctgcggcaactacaccatcggcagctgccacacgccgcgcgccaaggagctggtggagaaggcctgcctcggcaagcgcatctgcacgctgcccgtgtccgccgacgtctacggcggcgacgtcaactgccctggcaccaccgccacgctcgccgtgcaggccaagtgctccaagaggtcgcccagagccgcgcagtaattcggtagtcgtcggcttcggcctcggcttgctacctcccgtcgtctttcattcttcattgctgatgctgctgctgtaccatgggaccattatctgaccggagacgtcgattcggatttcggacccatccatgcgtggctgggtggggaaacagattgtc

SEQ ID NO: 64707 - DNA, 332 bp, Zea mays
  unsure at all n locations
  Clone ID: LIB3075-020-Q1-K1-F9
cggagagatctggtctgccattcccacgctccttcccgtgaaccacaaacctaacgcggagcggggcgggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgcanggagcacgccgaggccaaacattccaagacagacgtgt

SEQ ID NO: 64708 - DNA, 465 bp, Zea mays
  Clone ID: LIB3075-020-Q1-K1-G1
aacgtgtcccacgccatccaaggcgcgacggtggagatggagtgccgccacttcgagtcgcaggaggtccgcgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcccgctcacccgcaacgacggcatcaagcagagcggcgtccgctacgccaaccccatcgccttcctccgcaaggagccgctccccaactgcggcgagctgctccgcgcctacgacctctacaacgagacgtccgagaattcctaagcgtccaaacaaaagttctctcgctcgctttttttttaaaaaaaaaatcccatatacatatagcacatttgtttcggtttgttgatgcgcgcatgcatg

SEQ ID NO: 64709 - DNA, 463 bp, Zea mays
  Clone ID: LIB3075-020-Q1-K1-G10
cccacgcgtacgaagagcaatggcctttaggtcatccatcttgcttgccacggtggcgctagcgacgctattcgcggtcggttcgtgcaccaccccgctcaccttccaggtcagcaagggctccaagcctggccacttggtcctcacccccaacgttgccaccatctctgacgtggagatcaaggagcacggtggcgacgacttctcctttacgctcaaggagggtccgactggcacctggacgcttgacaccaagaccccgctcaagtaccccctctgcatccgcttcgctgtcaagtccggtggctaccgcatcgccgacgacgtcatccccgccaatttcaaggccggcaccacctacaagaccaccctcaacatgtaattagcctcttatgacaaataatattttgagagagctcatctggaccaagtgccagcgagctaaatattaaattttttcttt

SEQ ID NO: 64710 - DNA, 405 bp, Zea mays
  unsure at all n locations
  Clone ID: LIB3075-020-Q1-K1-G11
tgagatcacattctctgaggcacctgtctttgtggaccctcatgggcgtggtttgcgtgccctggccanggcccagattgactctgttctggatcttgcacggtgcacaattgtgtccgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagacagccccccacaggagcttctctgaggaagttgctgcacttaaccgctacttttgcggcctgaaatctggtggtaatgctta

SEQ ID NO: 64711 - DNA, 351 bp, Zea mays
  Clone ID: LIB3075-020-Q1-K1-E9
cagagcggcatttcggataacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtcctcatcttcaaggacggcaagggctgcggctcatgctacgaggtgagatgcaaggaaaa

SEQ ID NO: 64712 - DNA, 378 bp, Zea mays
  Clone ID: LIB3075-020-Q1-K1-D4
cccacgcgtccgaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccatcagtccaacctggtgctgtacggcaggatccagtgcaagggcaagtgcaccgagcagaatggcatcacggcgccggccatgaaggtctgccaggaggagtgcgacaaggcgtacgtggtg

SEQ ID NO: 64713 - DNA, 228 bp, Zea mays
  Clone ID: LIB3075-020-Q1-K1-D5
gttcatgaacgataaaatctactcaagacaacttattttcacatcctcatacatcggggttcggtttttttttttattttcatccaactttaatttatttgcccttttttcatagcacactactgttcatataatctctttacccaactcaaaatgctatagggtcatttctctttcaccagctagaataccatagattacgtgtacacttgaatactctacccaaca

SEQ ID NO: 64714 - DNA, 452 bp, Zea mays
  Clone ID: LIB3075-020-Q1-K1-D7
tccacgcgtccgtgacattattctgaggcagctctcatctaagcagggttgcctattagtaaggcaatcattcttccacaacaatccttccaattttgttgacctgggtggtggtgtaatgggctgtagaggttttcattctacctttcgagcaacccagagtggactttcactcaatatcgatgtgtcgactacaatgatagtgaaacctggtcctgtcattgattttctgcttgacaatcagaaagttggtgatccaagcatgattgattgggctaaggccaagcgtgcactgaagaacttgaggataaaaataagtccagcgaaccaacaacagaagattgttggtctcagcgaaagaacttgtcgtgagcaattattcacactgaaacataaaaatggtaacaatggtgactctgaagagatcactgcttatgattacttcgtaaagc

SEQ ID NO: 64715 - DNA, 455 bp, Zea mays
  unsure at all n locations
  Clone ID: LIB3075-020-Q1-K1-D8
ggatcggcgacggcgaaggtgaagagctggacaagggcggcggcggcggcggcggccaccacaagcacgagggctacaagaacaaggatggcaagggaaacctgaagccctctcagtgcggcggggagtgccggcggcggtgctccaagacgcaccacaagaagccgtgcctcttcttctgcaacaagtgctgcgccaagtgcctgtgcgtgccgcctggcacctacggcaacaaggagacctgcccctgctacaacaactggaagaccaagaaaggagggcccaagtgcccgtgagaagatggcggcccaatacgcggttttcccggcggctacgcgggcgggccgtcggcccaacgtaacctaccaccgtagttggaagcgtcgtangttaggttaggaataacagnnctctcttttttttctctcctcgttccgtggttgtttgggccgggc

SEQ ID NO: 64716 - DNA, 271 bp, Zea mays
  Clone ID: LIB3075-020-Q1-K1-D9
gccaaataattaactttagtgctgacaatactttaagccgacctatgctagctatactagattgggttggatcccaagcaatgcattacacatgcatgcattggaccgtgatatctatttgctaccactaccctattacgacagtgatgctggcgccaacaatgatggtgtcatcctccttctccatcttcttcatctccatatatagctagagtgagacttcgctgttgtttaaaagagaagagttaagaaatggattgacacgttatat

SEQ ID NO: 64717 - DNA, 416 bp, Zea mays
  Clone ID: LIB3075-020-Q1-K1-E1
cgctccgctcctgcttggtcgagatcacttcgccgccgccgctttcgagatctccgggtggagcaagcgagcaaaggcagcagccatgtcgctccgcgtgctgaaccctaacgccgaggtgctcaacaagtcggcagcgctgcacatgaacatcaacgccgccaagggcctccaggacgtgctcaagaccaacctcggccccaagggcaccatcaagatgcttgtgggtggagctggtgacctgaagctgacgaaggatgggaacaccctcttgaaggaaatgcaaattcagaacccaactgcaatcatgattgcgaggacggctgtggcacatgatgacacaagtggtgatggcacaacctccactgtgctatttatcggggagctaatgaagcagtctgagcggtgcatcgatg

SEQ ID NO: 64718 - DNA, 402 bp, Zea mays
  unsure at all n locations
  Clone ID: LIB3075-020-Q1-K1-E10
cagaacggnattcaatattacacaggtgagcgttacgatgggatccctcgataataacatcatgagcgggggcgccgttcttttggcgctcgacaaccaagggtcggaccgacccccgaaggaaccacccggccccaacatcaacaccaactacaacggcaattgactcaccgctagggccacactggactgtcagcccaacggtgccggttctcctgacaactgcgtaacgggcgggatcaagaacgcgaacctgccatcctacagaggcatgactgcgtgcggccacttccacaatttctaggacgacaatgactgcggctcatgctacgatgagtgatgcgaggaacaacctgagtgctcgggcactccaatcacggcgtacataactgacatgaacta

SEQ ID NO: 64719 - DNA, 442 bp, Zea mays
  unsure at all n locations
  Clone ID: LIB3075-020-Q1-K1-E11
gcaaagggccatccgctgcggtcagtgtaggtttctgaatcatagcttggcgatgcctgaggctggacaaatactgagctagccttcagaaaaaaaaagaaaagaaagagattgagaagcagggagaaaaaatggcactggcccattgaggaagcttgagaaccagttaacaagaattgccaacatattcttggacaatcttgttaacagagttttaaggtttcccagcagacatttttcgagtccaggaagagcgcgtgcaaccaccacattcatataattaataagcaaggtttagagaagaggcaacatgggcacaaagatgaagaangggatcctgaagccgttccgctatatctcaaccatcatggatggtaaggaggctgaaatgcaaattgggttcccgacggatgtaaaacacgtggcacacatcggttgggat

SEQ ID NO: 64720 - DNA, 452 bp, Zea mays
  Clone ID: LIB3075-020-Q1-K1-E12
cggacgcgtgggcggacgcgtgggcggacgcgtgggggccgtggcgcacctcatcgccctctggggcgacttctccgacgccaggttcctcgaggtcaagtcctggctcacctgcacgctcggcggaaccgacacctgcgaggacgcctgcaaggacgcccccgtcagcgacatcaagaacgtctgcataaccaagagcttcgagttcgagaagctgctgcgcgtcacgctggacctcatcaccgaggcttacggctccatgtcggccgatgtcgcactgccgacgtcggacgcgccggcgccggtcggagggtacggctcgtcagctggcgcccccgcctacggcgctgcgtcttctgatgccccagcttatggcgccagcgtaccagcaccgacctcggagcagagtactgcttagactgcatgagtgatatcgtggcggcacacacgca

SEQ ID NO: 64721 - DNA, 391 bp, Zea mays
  Clone ID: LIB3075-020-Q1-K1-E2
ccacggcagaattccgattccggccgcctcctatacatagccagccttccaccctctcccctggcccaacacagagcagcgagccgcgcgcggaggcgaggcgttcgcacacctcgcccgcgccaccaccaccgctccgttgcgcccgccagccgtcacgcgtgacgtttcccggggggccgggggagagagaggcagaaggaggaggcacggagaggacgagacaggatgctcgggttcaggcagatgccgtggtcgtcggcgcatgagcaggagcaggcgccgtcggagcagctgtgcgagggggtgtcggccgtcgtggcggcgcgccaggggatggagaagccgctgacggctgtggcggaggcgttcgatgagctggcgcgcggca

SEQ ID NO: 64722 - DNA, 190 bp, Zea mays
  Clone ID: LIB3075-020-Q1-K1-E3
gatggacattatctccgttgactcgcaatgacctcagtgaccacgggactactacaatcgaatggcgaacgattgggtggacacacattctaataccacactcatgatggatctacgtactgagcagtggctaccaagccacgtgctctctagatatccaatgacatccattgagagagtcaaagaagat

SEQ ID NO: 64723 - DNA, 447 bp, Zea mays
  Clone ID: LIB3075-020-Q1-K1-E5
gtttgctctagattatgagttctacaggtgccaaaggttcacaacaaaccaatacaaagtcaaaagaaagggttcaaatcaaaggagcaaagtaacgcaccggacagtgtccggtgcactaggaagatcgactctgaacttgccagtttcgggaatttgagaggccgctcctctataattcaccggactgtctggtgtaacactggactatccggtgtgccagcggagcaacggctacttcgcgccaacggtcgtctgcagagaacattaaatgtgctacaatgcgtgcctgcgcgcgcagaagtcagtgcaggcgtcagaaggcgaaccggacagtctacaggacctgtccggtgcaccaccggactgtccggtggccccaattgtcagagctccaacggtcggaacccaacgaccaagtgatgtggctagcgcaccgcacagtgt

SEQ ID NO: 64724 - DNA, 432 bp, Zea mays
  Clone ID: LIB3075-020-Q1-K1-E7
cccacgcgtccgcccacgcgtccgcccacgcgtccgcccacgcgtccgattctggaaggctaggagaggatgaagctaggatatactttcatcaacttataaatgcggttgattattgtcatagccgaggagtgtaccatagagatctgaagccagagaatctacttctggactcacatggaacccttaaagtttcagactttggcctaagtgcatttgcaccacaaacaaaagaggatgggcttctgcatactgcctgtggaactccaaactatgtagcgcctgaggtgctcgctgataaaggctataatggtatggctgcagatgtatggtcctgtggcataatcttgcttgttcttatggccggatacttaccttttgatgatgccaatctgatgagactgtacaaactgatctgccatgcaacttttt

SEQ ID NO: 64725 - DNA, 432 bp, Zea mays
  Clone ID: LIB3075-020-Q1-K1-E8
gttctagatcgcgagcggcgcccttttttttttttttttttttaaaaaaattgcctgcgaaaatggcatgtatatttaacattttgcttgttttccactctttggaattcggcatacatgattagaattgcctcctaaacccaaacaaaaggattacatatactagaattcagaagtctcagtagtatatatggttagcggtgcatgctctctcatgcaatatatataaacttaattagcttgctgctgcaggtccatagcccaccgcgccggatgaatcgaagggaattcaaagtctagtagaattggacgttggaagtgtagacggcatcgggtctccagttcggcgggatgacgtctttggcgatgaccttcttgccggactcgctggtgaggcggatggagaaggggcccttgagcgccttggcagtg

SEQ ID NO: 64726 - DNA, 446 bp, Zea mays
  Clone ID: LIB3075-020-Q1-K1-D3
gtgatattcctgaaaagcaaaaggaaaagaaaaggcaggagaataacgaagcaagatctgccgcggctccattttaactggtcggcgcctccgccgctgccgtcttccccctctcccctccgtaccactcgtcttcgtctagcctcccgcccgcagccaccatggcacccggcctctacaccgacatcggcaagaaaaccagagatttgctgtacaaggactacaacacgcaccagaagttctccctcaccacctgctcgccccatggcatcgcaatcacagctgcaggaacaaggaaaaatgagtccacctttggcgatcttcacactcaaattaagaacaataaattgacggtcgatgtcaaagcgaactcagaatcagatcttttgacaacaatcacttgtgatgagattggtactccagggctcaaatcaattctcactttg

SEQ ID NO: 64727 - DNA, 424 bp, Zea mays
  Clone ID: LIB3075-020-Q1-K1-C1
actgtatgttggaagagcacaaaagacgtctgaaagagagatggagttgaaggagaaattcgaaaagaatattcaagaggtagctgtgaagttccaaaacactaacttgtatctgaagaacttagatgataacattgatgatgaaaagttgcgtgaaatctttgctgagtatggcaatattacttcttgcaaggttatgcgggattcttatggtgttagcagagggtatggattcgttgcattcaaatatgctgaagatgctaaccgagctcttaccgagatgaatggcataatggttggaagcaagcccctttatgtagctcttgcacagcgtaaagatgacagaaaggcaaagctacaggcacagttttaacatatgcgtcctgttgcaatggcaccttcagtatgtcctcgcatgcccatg

SEQ ID NO: 64728 - DNA, 375 bp, Zea mays
  Clone ID: LIB3075-020-Q1-K1-C10
caagaggagatctgcgatgtggtgctggcccggagccccaacccggggtgcgcggagatcgaggagttcctggaccgtgcccgcgtcccgctcacctccaacaacggcataaaacaacagggcgttcgttacgccaaccccatggccttcttccgtaaggacccgataaacgattgccgcgccctactatagacgaacgatctaaaagacgcctccgaaacaccatgatcagcctgcgcgctgggcatacctgtatccattgctgccctgcccgctcacccaagaattgaagatggtagctgcactacgcgccatctgtatagtgatacactatgcactgcatgcgaaggcatgagataatgggtctgacctcat

SEQ ID NO: 64729 - DNA, 360 bp, Zea mays
  Clone ID: LIB3075-020-Q1-K1-C11
cggacgcgtgggtgctgaccctcgccacggtcgctacctcacggcatctgctatgttccgtgggaagatgagcaccaaggaagtggatgagcaaatgctgaacgtgcagaacaagaactcttcctactttgtggagtggatccctaacaacgtgaagtcgagtgtgtgtgacattccacccatcggcctgaagatgtcctccacattcatcggcaactcgacctccatccaggagatgttccgccgcgtcagcgagcagttcactgccatgttcaggaggaaggccttcttgcattggtacacgggtgagggcatggatgagatggagttcactgaggcagagagtaacatgaatgacct

SEQ ID NO: 64730 - DNA, 418 bp, Zea mays
  unsure at all n locations
  Clone ID: LIB3075-020-Q1-K1-C12
cggacgcgtgggcgcataagctggacatcagcgatgagttcaagcgtgtgatcgggtctctcggcgggcatgatgacaagatacgcatagttctcaacaaggccgaccaagttgatgcacagcagctgatgagagtgtacggagcactgctgtggtcgctcgggaaagtcctgaacacaccagaagtcatgcgtgtctacataggttcattcaacgacaagccgatcagggagacagcggctgggccgctgggcatggagctgttccagaaggaacaagatgacttgctctcggacctgaacgacatccccaagaaggcctgcgaccgtcggatcaacgagttcgtgaagcgggcgaaggcggncaaggtccacgcgcacataatcagccatctgaagaaaagatgcctgcgctgatg

SEQ ID NO: 64731 - DNA, 395 bp, Zea mays
  unsure at all n locations
  Clone ID: LIB3075-020-Q1-K1-C2
aactgccactggtgctattgtgagttgggcatctcaaaagttctccactgctgtctttttcttgtatgagcagattcatcctgatgatgcatttggggagcaaatgattagaaatcttgagagtagaggatgcccccttctcggtataaatgctacaccaaccctgagtcacaaggagaaactttttcttggcaatggatggcagagagccgttgcatgggatatgctgaaaatctataatgacttcattgacagtcaagaaagacgcaggatcgaacggttagaactgtttgatgagtttgaagagtggtatatgatgcangaacactactgtgtggcctatggaatcaacgacgccgagggcatatttgacagtttttgatttggggagacat

SEQ ID NO: 64732 - DNA, 332 bp, Zea mays
  Clone ID: LIB3075-020-Q1-K1-C3
tggatcgaccggcgcgtccaaactggcacttgtgctattaacaattgggcatttcaaattttctacactcctgtctttttcttgtatgagccgattcatactgatgaaacattttgaaagcatacgattaaaaaacctgaaagtgaagaaccccgaacgttcgcattaccggactcatgatacatatcttccagatgagaaactttttcttagaaaccgatagaagacatccgatacatagaatataatggaactctataaagaccacattcgctaccgggaacgtcatcgtattgaccaggtcaaacttcgtggtcaggactattattgat

SEQ ID NO: 64733 - DNA, 336 bp, Zea mays
  Clone ID: LIB3075-020-Q1-K1-C4
gcgattcttggtagatcgtcatccattgtcatcatcttctggatcggtcagcaaaacatgggagtggtctctattatcattatcaagcagctcgccgagccctcttcctgaaagaatgttgtacatattatcatttgaactctgtccagtatctacgaagaagttgggtgctgtttaattcaccaaatgtaacgtaaagggtaatggtcactgtttacactctattacagacggttacaaacttgaatagtccgctataaaaactcattatcgtatctgattaccgttgtactaaaacaaacataatgtatcgatatcacttacccatcaccctac

SEQ ID NO: 64734 - DNA, 450 bp, Zea mays
  Clone ID: LIB3075-020-Q1-K1-C5
accagcagcctccaataaaagccagcacatccaaataaaaccgagagacctcagccgtcaggcaagccgaccgccgacgtaccaccgcgccaacccgagagaaagatggagatgatcaagaggatcctcatcgccgcgctcctcgtagtcgccgtctcggccaccgcagtgctggcctccaccgaggccgccgccgccggcgccccagccgcctccgagtcgtcggcgtccgccgaagcccccgctggcgccgccggcgccggcgccggcaccggcaccgccgcggggccctccgccagcggcgccgcgcccgccctcgccgccgcgcccgccgcgctcctcttctccctcctcgcctactacctgcactaagcggacggacggacggacgcgcgcatggcattggcatgcatggactgttgaacatctatgcatgcatggacgacgtca

SEQ ID NO: 64735 - DNA, 368 bp, Zea mays
  Clone ID: LIB3075-020-Q1-K1-C6
attcttggaagatcgtcagccattgtcatcagctgctggatcggtcagcaaaacataggagtggtctctattatcattatcaagcagctcgccgagccctcttcctgaaagaatgttgtacatattagcatttgaactctggccagtatcgcggaagaagttgggtgctgtttggttcacgaaatgtaacgtaaagggtaatggtaacggtttacactcgattacggacggtaacaagtttgaatagtccggtatcaaattttagtatggtatctgattacggttggactaaaacaaacatgatttaacgttatcacttacccattacgttacaaatatttgaatcaaacggtaccttggtgtttaac

SEQ ID NO: 64736 - DNA, 457 bp, Zea mays
  Clone ID: LIB3075-020-Q1-K1-C7
ctagggagcaacaacaaggtggacgccctagatcagaagagcctcggagggatgatcgtcgtgccgatagggatcgtgaaaaatctcgtgaaagggtacgggaaagagaccgtgaggagaggacccgtgaacgttcgcatgaccggactcgtgatagagatctacgagatgagaagcatcaccatagagaccgtgagaggactcgggatagggagagaggaaaggaccgtgaaagagaccacggtcgtgaccgggagcgtgatcgtcgtgacagggacaaggatcgtggtcgggactatgatagagaaagggaccgtggtcgctctcatgatcgccatcgtgagagaggcagggaccgtggtgaaagagattatgagcgcaccatccatgaacgtgaccgtggtcacatgcatgagagggatgcagactatggcaatggtgggacaaagcatgacaa

SEQ ID NO: 64737 - DNA, 453 bp, Zea mays
  Clone ID: LIB3075-020-Q1-K1-C8
cggacgcgtgggcggacgcgtgggatcgcatcgcagtcgcagcgcacgccatcagctagcagggagcgcgctcctcgagcccagcagagaaaggccggcctacccactctctctctctctccagtctccaccggcagcgccaatagtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccggcgaccccgccgccgcggcggccatggtggaccgcatgctccgcctgctcgcctcctacgacgtcgtccggtgccagatggaggaccggga

SEQ ID NO: 64738 - DNA, 354 bp, Zea mays
  Clone ID: LIB3075-020-Q1-K1-C9
agatggaggactcgggctaccccatcatcatcgacatgaagtactgccccaacaagttatgcaccgccaatggtgcctccaaggtcaccgtcaaggacgtcaccttcaagaacatcaccggcacctcctccaccccggaggccgtcaacctgctctgctctgccaagatcccatgcaccggcgtcaccatggacgacgtcaacatcaagtacagtggcaccaacaacaagaccatggccgtatgcaagaacgctaagggcagcgccaagggttgcctcaaggagctcgcatgcttctagaaccaccatcgacccatctctctagttatacaatgtgtttggttgttggatgctg

SEQ ID NO: 64739 - DNA, 456 bp, Zea mays
  Clone ID: LIB3075-020-Q1-K1-D1
gtcacaccctgttcttctgacccgccataatccagactccctggacgagtctgtcctgtggacagagagcagggacgttggggatgggttccgctgcattaggatggtcaacaacatctacctgaactttgatgctttacatggagacaaggaccatggtggtgtgcgcgacgggacggcccttgtgctgtgggagtggtgcgagggagacaaccagcgctggaagattgttccctggtgaacaaggaaatgtgtgaccgagcccgcaccaaggaggagctcctgccgtaataagtgaagtgattggtactgaagtttctggaaataagaggctcttctgagatgcctgtttgtgtgagtatttgcgtttccattccgttttcatgataataaaacgcattgattattaatatatgtaatgtgatgctacactgagtggcagcgttggtatatatt

SEQ ID NO: 64740 - DNA, 351 bp, Zea mays
  Clone ID: LIB3075-020-Q1-K1-D10
gccggactggaaattgccatgaggctgctagagcccatcaaggagcagttcctcatcctatccgacgctgacttctaccagcttgctggagtcgcggcagtcgaggtaaccggcggacctgatgtccccttccaccctgggaggcaggacaagcctgagccttcaccggaaggccgtctttctgatgccacccaatgttctgatcaccttaggcaggttttctccacacagatgggttagagcgaccaggacattgatgcgctttctggtggtcacaccctgagaagatgccacaaggacatgtctggatttgagggagcctggacggccaaccctgtgatctttgacaac

SEQ ID NO: 64741 - DNA, 345 bp, Zea mays
  Clone ID: LIB3075-020-Q1-K1-D11
atgttcttcaccgtgacttgaagcctagcaatcttcttttgaatgcaaactgtgacctcaagatatgtgattttgggcttgctcgcaccacctcagaaactgattttatgactgaatatgttgtcacaagatggtatagagcaccagagcttttgttgaactcctcagaatatactgctgccatcgatgtgtggtctgtgggctgtatatttatggaactgatggaccgcaaacccttgtttcctggaagagaccatgtccatcagctacgtcttctaatggagctcattggcacgccaaatgagggtgatcttgattttgtaaatgaaaatgcaagaagatata

SEQ ID NO: 64742 - DNA, 428 bp, Zea mays
  Clone ID: LIB3075-020-Q1-K1-D12
tgacaaggggaacgatcattgaggttaatgtcagtgagcttggtctggtaactcccgctggaagaggtgattgggggaaatatgctcaagttacaaacaacccggagaacgatggctgtatcaatgctggtttgctagtgtagatccatagtgagattttgttgatggaggagaatcgtcccatttgtatctgctccgatatgctattttttgaccatgtcatggctaataccacgagtttgttgtgcaccatgggcataatgagcattctgtattctcgctgtgtgctacaaacatatatggaggaatataaattagcagtatttgttttttttttttttgagctccccccacttcctcaaaaccctagacagtccttacctggaaaatttccacatgtacaacccttaacaattgacctggtggaa

SEQ ID NO: 64743 - DNA, 230 bp, Zea mays
  Clone ID: LIB3075-020-Q1-K1-B9
agaggatccacacagtgaggagttcgatttgatctaggtggcgtctcccagttgactttatgacgccaaggatggactttagtttgatctatatttatattttattttgtaagactaccactatgtaataagtactctgatgatattgtgacatttatctctatacactctgttactatatgtgttgtcttctttggcgcatatatgagatgcacccgactttatccttt

SEQ ID NO: 64744 - DNA, 348 bp, Zea mays
  Clone ID: LIB3075-020-Q1-K1-A5
cccacccgtccgcggacgcgtggtggtataaaagttgcttcctactaattttcaactttaacatgtattcctcgagagatcgtgtataatgttgctaaaatccaccttctacatcttccacggatcatcgaaggtgctacagatggaaagggcacaggaagacacggtatcatcacagctaggacatgcaacgatattttgattgctcttgctgccgtataaccaataactcacaagcgtcttattgagaaggagctcgaaggatttgccattatgttgaacaaaacaccacccactttgacttttataacaaaggacaagggtggaatcaacttctcatcaacagtg

SEQ ID NO: 64745 - DNA, 447 bp, Zea mays
  Clone ID: LIB3075-020-Q1-K1-A6
gggcggtccaaaggcgttcccccctggaatccatgagatccatcagtttcttgaccgcttctacatgtcaaggattgggatccggatgctgatagggcttataaacacaaaaatgtcacccatgacagttgctcgaattgctagtgaagatgcacgtgctatttgcatgcgagagtatggatcatctcctgatgtcgacatatatggtgatccaggttttacatttccatatgttacaccacatctacatctcatgattttcgagctggtgaagaactcccttcgtgcggtacaggaacggtatatggattctgataagcttgcacctccagttcgaatcatagttgctgatggagcagaggatgtaactattaagattagtgatgaaggtggtggaataccaaggagtgggctctcaaggatttttacgtatctctatagtacagc

SEQ ID NO: 64746 - DNA, 408 bp, Zea mays
  Clone ID: LIB3075-020-Q1-K1-A7
gggaggaggcgaggtgagagaggacgaagagggcgcatcgtgggttgggtgatcacggcctgatggggtcgtggcgcaaggcctacggcgccctcaaggactccaccaaggtcggcctcgccaaggtcaacagcgaattcaaggaattggatattgcaattgtgaaggcaaccaaccatgttgaatgccctcccaaggaacggcacgtcagaaaaatactcttggcgacctcagcaaaccgccctcgcgcagacctctcgtactgcatatacgcattgtcaaggagattgtccaagacaaagaactggatagttgcgctcaagacattgatagtggtgcataggcttctgagggagggcgatcccatgttcaaggaagagttcctggcctactcatccagagggaaca

SEQ ID NO: 64747 - DNA, 190 bp, Zea mays
  Clone ID: LIB3075-020-Q1-K1-A8
cggacgcgtgggattattattatggtataataactttgctcgcgagacaaatggaggttctctaggtagtgtctctaacctgtcgtactgacttctgtcgatagaagagaatggggccagatgctgcttaggtgtgatctatcctatccatccatggataataaagaagtttgtggattgctgttttatt

SEQ ID NO: 64748 - DNA, 455 bp, Zea mays
  unsure at all n locations
  Clone ID: LIB3075-020-Q1-K1-A9
aaggacttagagaagcctttgcggagtttggtgaagttttgcatgctcgagttgtgaccgatcgtgtcagtgggttttctaagggatttggctttgtaaggtatgctacgaccgaagaggcagccaagggaatagagggaaaggatggaaagttccttgatggatgggttatttttgcggaatacgctaaacccagaccaccaccggaggaaacagggatgaattcgcagccccagcagtcatggggagctccatcaggttcctggggtgcacagtagatgaagtgatattgtgagagcccctccctgtcccagccctaaggctcgtagcggatcgtgagggatgattttgtgtggtgtgtcgcacgtgtgaaatgcctttgttgtcccaatattcctaccgtgttgggggtggtcgcttgctcgcgtncacgtctttcacatgaaattggtact

SEQ ID NO: 64749 - DNA, 423 bp, Zea mays
  Clone ID: LIB3075-020-Q1-K1-B1
cgccagccagccatcgtcacactggtgagctctgcagtctgcactctgcttagctccgagcttgagtgcggtcgttgttagctgttagctccacagtccacagttccacacacacgtgcagctgcactgcaccaatggccgccgtcgaggtccaggtcccgactgccgctcccgtcgaggaggctgctgctgctgctgcagcgggagtggaggctgcccagctggccgccgtcgagaccccgaacgaggagaccgctgctccggcggcggagaccgaggtcgtcgccgctaatgagccggtgtcggccgaggccgagactgagtccaaggaggtcgaggtcgaggccgaggccgtagctgaggctgagccgaccgaggcagagcccaaggaagcagagcccgaggccgccgcgcccgcagcag

SEQ ID NO: 64750 - DNA, 474 bp, Zea mays
  Clone ID: LIB3075-020-Q1-K1-B10
cggacgcgtgggcggacgcgtggggccatatttgaaacaggtaagaattcatatataagagtgcgtatatatatatataattctgccaagacaaaggtaatggagtcgtcacgcatgttccagccggccatcatcctgcttctcctgctcattgtgaccaccgatgtggcgcaggcggcgagggaatgcgagaaggacagcgagcgattccttggggcatgcatggcgtcggacaactgcgccaacgtgtgccgcggtgagggcttctccggcggcaggtgcagcaccttccgccgccgctgcatctgcactaagccgtgctaaattaacctactcccggcagttcgatggtggacgtttattctatttattggcttacttgattttttttgccctaacaataagaaaacgcacgtgctggcatgtacgttgtgttgtatatgcttttcttgctggcttcatttgctgattact

SEQ ID NO: 64751 - DNA, 398 bp, Zea mays
  Clone ID: LIB3075-020-Q1-K1-B11
cactgggtgaggacggactgctaccaatctcttgacgaagcatatgaagatgggacaaatcggcttgaatctttgctatcaaaattacattgcttcaacgtcccaacgctttcttctggttctataaaacttaatgttggaggctttggatcggcgacgctaaagtcaaacatgtcaaaagaagagtataaaaatatcgttgtccaagctaaagaacacatcttggctggtgacatttttcaagcagttctaagccagcgcttggagagacggacgttcgcggacccctttgagatctaccgtgcgttgcgcatcgtgaatcctagcccatatatggcctatctacaggcacgaggctgtattctcgtggcatcaagcccttgaattcttacgcgggt

SEQ ID NO: 64752 - DNA, 372 bp, Zea mays
  Clone ID: LIB3075-020-Q1-K1-B12
cactgggtgaagactgactgataccaatctcttgacgaagcatatgaacatgggacaaatcgtgtggaatctttactatcaaaattacattgcttcaacctcccaacgctttcttctggttctataaaacttaatgttggaggctttgaatcggcgacgctaaattcaaacatgtcaaaagaagagtataaaaatatcgttgaccaagctaaagaacacatcttggctgatgacatttttcaagcacttctaaaccatcgcttggatagacggacgttcgcagacccctttgagatctaccgtgcgttgcgcatcgtgaatcctaaccaatatatggcctatctacaggcacgaggctgtattctcgtggca

SEQ ID NO: 64753 - DNA, 425 bp, Zea mays
  Clone ID: LIB3075-020-Q1-K1-B2
cggacgcgtgggcaagcagcaacgtctcgaccgtttacatctctgtcattgatgacgtcatctgcaaggtccgcgaggatttcatcacctacggagtcggtgacgccgtcctaaacgagctccaggctctctgggagatgaaaatgctacactgtggcgcgatctcggggaacatagaccgaaccaaggctgctgccgcgtccgtcggaggcaccaccggcacgacaccgtccgtgcacgacctgaacgtgccgtacgaggccacatctgaggagtacgccaccccgaccgctgacatgttgttcccgccgacaccattgcagaccccaatccagactcctctgccagggacagacacagcgatgtacaacatacccactggcccttccgattatgccccctcaccgatcagcgatgtcaggaat

SEQ ID NO: 64754 - DNA, 340 bp, Zea mays
  Clone ID: LIB3075-020-Q1-K1-B3
gccggcacatacatgcgtacatgcatctgaaaacaagattagtgaatcacataaaaagaaagtggaacaccgaacccaacgcaagcacaaatcaagaaagaaacaaaggaactttgacagccacgcccatgcggcaactgcgccgatcgagctccggtcgacgttgtcccacggtcgtatgtagatatagtagtacggccggtaacgctgcgtggtgaggtgagtggcctataagcatggatgtggaacatcacccgtgtgcgggatcagttgcgcttgcgcccttgctgctgggcttcttctcgctgtatgcggagttcatgctgaagctgctgagagt

SEQ ID NO: 64755 - DNA, 454 bp, Zea mays
  Clone ID: LIB3075-020-Q1-K1-B4
attgaccgatccatccacgcgttcggttccagtttactgtagaaagtttcttgcctattcctcatactcgttcaattcctggaactccgggagattaaatctatacaccttctccttctttacctgaacatatataaaacctcttgttttgtgaaagcaaaggtgagtacacatcaacgtactcaccaaacgttctgtttagctaaagcgtactaactttatgtgttgtgaagctccactagttgcttttagcttgtcagatatttactattagcataagccaaattttatcaataaccaacccatgaaccgttttcttatcgatgaacatcattatcattatcgtatgcaaatccattaattgaaccatattatcttgaaccattcttatctctaaccaaacaatcttacaatgctgctcataaccgtgagcacgacttatatattcttttct

SEQ ID NO: 64756 - DNA, 457 bp, Zea mays
  Clone ID: LIB3075-020-Q1-K1-B5
aatctctacatgcaagctggcagtgagtatgtcagacagatttctaagattctgaagagccaggttacgatgttgacatccacatcatctacatctttgccggaagaaatgttcacatgcactctagaactgcaaagttcttgcaaaggtcataagagagattcaatttctccacaatatttgaagccagggactggtgaatctcaactctttcactgaaggagtttgtatttggacaaatttgaaaagcagcaggatgaaatcatcaggtggtggcctctatatcttgatgatcaagattgtgtcggaaaagttcagcttggtatgaatttatccatgtcttccaataactatgggtccgaaaagatgctgcaaggtggccctgcagtggataccatcatatatgacatggttctggaagcggcaatgagggctcaaaatttcaacagcaaaatgc

SEQ ID NO: 64757 - DNA, 322 bp, Zea mays
  Clone ID: LIB3075-020-Q1-K1-B6
ctcctgttatgtagtaaagatgtgacattccttccacaaaattattaaaataatatggagatggtataaattatttaataacaaattataataattatcaccataaataaataaacaccttgctctcttttaatattaaaatgctgtcgtgcgtctcttatgtccctaattttcttccccttccttgctccttcttttcttttttttatggaccctttatttcatttcacttgccgtcgttctaaactttccagactgtgaaaccccttacgtttctccccttctttcctttgtcatattttcccctttcgccactttgctt

SEQ ID NO: 64758 - DNA, 391 bp, Zea mays
  Clone ID: LIB3075-020-Q1-K1-B7
aggcaacccaccactgagaggcacgcagaggttcaggaagccggagaccaagatgtggtcggtgttcagcggcgatgagacggcccccttcttcggtttcctcggcgccgccgccgacctcgtcttctcatgcatgggcgcagcgtacgggaccgcgaagagcggcgtcggcgtggcgtcgacgcgtgtgatgcggccggtgctcgtcatgacgtccatcgtgcccgtggtcatggctggcgtgctcgctatctacgggctcatcatcgccgtcatgatcagcactggcatcaaccccaaggccaagccctactacctttttgatggctacgctcacctttcgtccgggcttgcctgtcgccttgctgggctcgcagctggcatggccatc

SEQ ID NO: 64759 - DNA, 428 bp, Zea mays
  Clone ID: LIB3075-020-Q1-K1-B8
gtgccagctgactgggggaggtcgctagcctaatcctcgaactcgttgaagtccttgaactcctggagattcgcctcgacaccttctccttctttacctgagcatatgttgcacctgttgttttgtgaaagcaagggtgagtacacatcaacgtactcagcaaatgttctgtttagctaaggtggactaactttatgtggggtgaagctccagtagttgcttttagtttgtcagatatttattattagtagaagccaaattttagcaataaccaacccatgaaccgtttcctcatcgaggaacatcattatcatcatcgtaggcaaatccataaatagaaccatagtatcttgaaccatttgtatctctaatcaaagaagcttacaaggctgctcataaccgtgagcacgactgatatatcggcttct

SEQ ID NO: 64760 - DNA, 423 bp, Zea mays
  unsure at all n locations
  Clone ID: LIB3075-020-Q1-K1-A4
ccgaagagctagcgcgcgatggccaacaacctcctccgtccgctcgcgctcctcctggccgtcgtcggctgcgcgctgtgtccccgcgccgatgccaccgcgttcgaggtcggcggcgacgacgggtgggtcgtgccgccggccagcgacggcggcaggtacaaccagtgggcatccaagaaccgcttcctcgtcggcgacgtcgtccacttcaagtacagcgaggactcggtgctggtggtgacggaggccgactacgacagctgccgcgcgtcgcaccccgtcttcttctccaacaacggagacacggaggtgacgctggaccgtccgggccccgtctacttcatcagcggcgagaccggccactgcgagcgctggcagcggatggtcgtcagggtcgccggncagggcgcacccccgccg

SEQ ID NO: 64761 - DNA, 327 bp, Zea mays
  Clone ID: LIB3075-022-Q1-K1-H3
gcgtaccaagtgcacaaatggctggcagagcacatccatcgaatgatacggtcacaccttcccatgtgccactgattgttccatctgctactccaacacatcaaatgtctcatcctttagggggttcatctgctccaccacttcctctccatgacacaaatccgcatgccagtcagtctgcaaatcttctaacaccagctttctttgcaccaccaccaccctcttcaacatctgtgacaccacctgcttcatccatgatgcctacagcaccacctcttcatccgacttcaacagctgctcaacatccttcatatggcactcccttac

SEQ ID NO: 64762 - DNA, 325 bp, Zea mays
  unsure at all n locations
  Clone ID: LIB3075-022-Q1-K1-H4
gaggagagtgagatcaagtgggcatcacgttgggacacctacctgttgatgactgatgatcagattcattggttttctattgtgaactctctcatgatcgtgctttntctatctggcatggttgccatgataatgcttcgcactttttacagagccatttttggatccattcagctggaacctcaggaggaaccgcaggaggaaacaggctggaagcttgttcatggggacgtattccgtcctccaacccactctgacttgctctgtgtttgtgttggcactggcgtccaattctttggcatgctcctagttacaatgatcttcg

SEQ ID NO: 64763 - DNA, 270 bp, Zea mays
  Clone ID: LIB3075-022-Q1-K1-H5
cgaataacacagttgagcgcgacgatgggatccctcgctaataacatcatggtcgtgggtgtcgtccttgcagcgctcgtcgccggcgggtcatgcgggcccccgaaggtgccgcccggtcccaacatcaccaccaactacaacggcaagtggctcaccgccagggccacctggtacggtcagcccaacggtgccggcgctcctgacaacggcggtgcgtgcggcatcaagaacgtgaacctgccaccctacagcggcatgacggcgtgt

SEQ ID NO: 64764 - DNA, 427 bp, Zea mays
  Clone ID: LIB3075-022-Q1-K1-H6
gcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaaaaatgctgagagtaacgcttatgtgaaaggcttggatgtggaccaactttattgtttaaaacatccagttaaatcaagcccaaaaccagaggcgccgaacttacgcggttacagggcgcatcaatccctacatgtcctaaccttgccacattgagctgatcttgtcagagaaggaagagcctgtgaagaaagaggctgacaacattgtcgcagcaaggaagcaatgaagtatatcagcatgctgat

SEQ ID NO: 64765 - DNA, 300 bp, Zea mays
  Clone ID: LIB3075-022-Q1-K1-H7
atgtggtcgtcgatgcgggcacaggttgcgatggttgtggcgttggtgttcttggtgagcggggcatgttgcggtcctcccaaagtccccccaggcaagaacatcacggccacctatggcaaggactggctggacgctaaagcgacatggtatggcaagccgacaggtgccggtcccgacgataacagtagcggctgctggtacaaggacgtgaacaagccccccttcaatagcatgggcgcatgctgcaacatccacatcttcaacgatggtctgggttgtgggtcctgcttcgagatc

SEQ ID NO: 64766 - DNA, 279 bp, Zea mays
  Clone ID: LIB3075-022-Q1-K1-H8
gcaaaagggtggatcacttcagtttctcatcgcttgctctgtttttcctggcactctcatgcttcatcgccattggtgttaatctgagccaattcatttgtattgggcgcttctctgctgtatccttccaagtcctaggccacatgaagaccgtacttgttctgtcccttgggttcctattctttgccaaggaggccctgaatctccaggtagtccttgagatggttctggccgttcttggaatgatatggtacgggaacgcatctgccaaaccaggcg

SEQ ID NO: 64767 - DNA, 304 bp, Zea mays
  Clone ID: LIB3075-022-Q1-K1-H9
ctcggcgtgcgtgctcgtgctgctcttgatcttgcacccgcgtgtccatgccttctacctgcccggcaccttcatgcacacgtgactcccctggagaggtgatctcggccaaggtcaactcgctcacctctatcgagaccgagctgcccttcagctactacagcctgtcatactgcaagcctctggatggcgtcaagaagagtgctgagaaccttggtgagatcctcatgggggaccagatctacaactttgcataccgctgccaatttaatgccattgagcaatgatacctttgccccacgga

SEQ ID NO: 64768 - DNA, 420 bp, Zea mays
  Clone ID: LIB3075-023-Q1-K1-A1
caagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgtcatccttcccacgctgctctccgtcaccgacaagaaactcggcgtcctcaactacaccagggccgacgacgggcagatgtacttcggcgctcccggcgccccctgcgtggccaagctcgtgaaggtcgtcgcagcgcggccgtactctgtgtccatcatggagatcagcgagcccattttgccggcgcgttgccctccccg

SEQ ID NO: 64769 - DNA, 281 bp, Zea mays
  Clone ID: LIB3075-023-Q1-K1-A10
ggccagcagcgccagaacaaagcttcggcggggaaaaaggtaaagaagggcggcggcagcggcgggagatggccggcggtcaagcccaagaaggatctccagatcaatcgcctcatgggcacccacctcctctccattccagacttctttacttctgcggaggcgaaggctttcattgatatcgcttagtcgatgggctttacgcaccatggcagtttggggccacttaacggggaggcttacatagacaacgatcggatatttgtgacggatccattgct

SEQ ID NO: 64770 - DNA, 180 bp, Zea mays
  Clone ID: LIB3075-023-Q1-K1-A11
acgatcgcggtcaatactgcaggggcgcgaccatttggatttgttcgtgaccatatatgaaactggattcgctcacgtgaagacagtaacggcaaccatatgctaaatagactagcgagactagtcttggttcttctacagatcctcattcgaggcaggatcatggatgtgcacgatctc

SEQ ID NO: 64771 - DNA, 418 bp, Zea mays
  Clone ID: LIB3075-023-Q1-K1-A12
atcacgacaagatggcgtgcacagacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggcgacttccttgtcggacaactcaacttcacaggcccttgcaagggcgacgtgaccatccaggtggatggcaatctgctggcgaccacggacctaagccagtacaaggaacatggtaattggatcgagattctacgcgtggataacctggtcatcaccggcaaggg

SEQ ID NO: 64772 - DNA, 217 bp, Zea mays
  Clone ID: LIB3075-023-Q1-K1-A2
cacgcccacgtacttcacgttcctgaagctcttgcaggacacctaggtcgtgggcgagtcgagtcacctcctgtcggcacacgctactggtcgaccgcgacaaacttgccaaggctctggcgtcggtgaccaccgataacgtgctgtcatccgtggagaaccacgtccttgtcagctacttcgaccgcatcaagctggacgacttcaacacacacag

SEQ ID NO: 64773 - DNA, 428 bp, Zea mays
  Clone ID: LIB3075-023-Q1-K1-A3
gatctggaaaggttgagcttcagtatttgcatgattatgctggagttaatgcaagcgttaggctgacagccaatcctgtagccgacctctctgctgcctttggcactaaggctctcgcagttggtgcagaaatctcatttgattctgccactgggaacttcaccaaatacaatgctggattgatgttcactcatgaagaccttatcgcatcccttaatatgaacaacaagggagacaaccttactggagcttactaccacaaggtgagcgaattgacaaacacagctgttggggcagagcttacccacagtttctcgaccaatgaaaacaccctcacctttggcgggcagcacactctggacccactaaccgtcttgaaggcacgcatcaacaactcgtgcaaagccagcgccctgatccagcatgag

SEQ ID NO: 64774 - DNA, 377 bp, Zea mays
  unsure at all n locations
  Clone ID: LIB3075-023-Q1-K1-A4
aatacacaaggcgcctttgatagcacttggtttccctgttgggatttttagcttgtcttaatatccaacttacaccaccatctgatatctgatcctgacaacaggctaggaggcttaactgacggtttcgaccttgggatgaacatgctgttgggaggagacaaggaagatgatggcggttcaagcaagtcgcatggcaagagcggaaaccgaaagaagcacctgaagaacaacaagaagaggaagaggcattagccctggactcacactcctgtatcacttcaacatacttgagtgtgtgacatgtcagttattttacagatatgttagttntaccatagtattgttcgatgtgatcctagcatgcccgtgaatgc

SEQ ID NO: 64775 - DNA, 190 bp, Zea mays
  Clone ID: LIB3075-023-Q1-K1-A5
tcgcgagaggagatccagcagccgtccaataagagccagccagagaaactaataaaactgtagccgtcgccatccgagcgagcaagccaaccgtccccgtccacaaggcaatccgccgtcgacgtaccatcaccaccgtaagagcgagatggagatgaagaggatactcttcgccgtcctcgtacgtatc

SEQ ID NO: 64776 - DNA, 423 bp, Zea mays
  Clone ID: LIB3075-023-Q1-K1-A7
tcgcgactgcgtatatgataatgcatattcagtcgcgtagctccttccatgccccctgagctgactgcgcgactacctcggagagcaaggcctgtgaatggattcatttaacctcgctcgcttgtccatggttcgcagcaacgataccaacacccgcattatttaattggtagcctcctctagctacgcacgcatttttagtctcctacacgcccttggattgtgcgtggctctgttaatcatctctcatccttcgtctgccatttctcccctgagatttttgttccttgttggtaccatgcattttggcaaataattttgtgattccactccccaaattaaagtttggctgtcgtatgggttgtaaacccagatcaatatatatatgtgcgtgattgaactgctccaaaaaaaaaaatttaa

SEQ ID NO: 64777 - DNA, 367 bp, Zea mays
  Clone ID: LIB3075-023-Q1-K1-A8
gacgaagtgagagctgaagccatgagagatcttttgaagtgcattgttgaccacagaaatgctgccaagtcattatccacacctgaaagagatgctgttgacaatgagtgcaataaagctgagcagtggctaagggaggggtcccaacttcaagaatccttgcccaagaatgtggacccagtactttggtcctgtgaaatcaagagaaaggaagaagagctggatacgttctgtcgaaacataacaaggcacaagggctctccagcaaggacagatggcagcaggggttcagattacatgcctacacctgatagagattaaatattttcacgatcacgaggtttctttactgtacggtcacacatgt

SEQ ID NO: 64778 - DNA, 287 bp, Zea mays
  unsure at all n locations
  Clone ID: LIB3075-022-Q1-K1-H2
cagttagctcacctcccccgccagttcccgtgagctcagcacccccatttgcaaaatcccgaccggcacagttcaaatcacctgcaccaccaacttcgagaagatctccacctccactggtgaagcccccgtcaccaccgtcacttgtaagctctccaccactgccaccaatgaccttcccaccttcaccagccgtcccatcaccacctncacctgcaccatcatcacctncaccgtcggcacctgaggagttcatcttgccaccaatcatggcgcagcagtatgcg

SEQ ID NO: 64779 - DNA, 342 bp, Zea mays
  Clone ID: LIB3075-023-Q1-K1-A9
gtcctcgaccatccctgcaaattaccgcgatggctcccaagatcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgtca

SEQ ID NO: 64780 - DNA, 408 bp, Zea mays
  Clone ID: LIB3075-023-Q1-K1-B1
agcgatggtggtcggcatctacgacgagcccatgacccccggccagtgcaacatggtggtcgagaggctcggcgactacctcgtagagcaaggcctgtgaatggattcatttaacctggctcgcttgtccatggttcgcatctacgattccaacacccgcattatttaattggtagcctcctctagctactcacgcatttttagtctcctacacgccctttgattgtgcgtggctctgctaatcatctctcatccttcgtctgccatttctcccctgagattctcgttcctaggtggtaccatgcattctggcaaataatcttgtgattccactcccacattaacagtttggcgtcgtatggtttgtaaacccagaacaatatatatatgaggtgtgattgaactgct

SEQ ID NO: 64781 - DNA, 355 bp, Zea mays
  Clone ID: LIB3075-022-Q1-K1-F11
tgtgacatcagcaagctgaacatggccgactccatggccagggccaaggtcctagactttcacctcctatcaccgaattctgttttatggcaagctccatcagcccaggcacgaaggtgttctgagggctttcattgacgaacgggacaccctcgtggacacaggctatcgcatacaaggtggatggccagatctctgcttcgttcttgtccaacgaagccaggagctcgtccatggtgtccttaagccctgcaaccacgttgctgtacctttcggagttcgtcgtacacatgacgactaccttgttcaccttgtttttttccttgaactccttgatgtccttctttgactggtt

SEQ ID NO: 64782 - DNA, 78 bp, Zea mays
  Clone ID: LIB3075-022-Q1-K1-F12
cctgtaaccagatctgaacccgcggcgacagaaacaaacgctcgctcgctcgttcgttgtccgttcattgtcttcgcc

SEQ ID NO: 64783 - DNA, 302 bp, Zea mays
  Clone ID: LIB3075-022-Q1-K1-F2
tcgtctcggctctgaggtagactgaacgcagcttgctcgatcggccgtactcgactggtcgcaagaagttctcggagggtagcaagggccagtctagcagctcgatcgtgcgcacctcggacgtcggcggcacgactgactggggcctgcaccaatggctacgaatcgttcaagcatttgtctcgcacgatcgacacccttgagtggtcatcgcgccgtcacccggccgtggcacctcgacatgcctgtgtcctcgtaatcatccagagcgcttggccgtcaatcctcctcgccaaggttca

SEQ ID NO: 64784 - DNA, 268 bp, Zea mays
  Clone ID: LIB3075-022-Q1-K1-F3
gcaagccctcgcctgtcctcactcctaaccctcgcccgactcagatctatctgccccgcgccgacggcgccatgccgatcactccgggtccctactctggcgtcagcaccctcgcccttgtagcgagggcatcggtcttcggcttcggtgtcgtctacgggagcatcaagctctcaatcctcaaggcaacatagcctagaaaggcagaagcgcatgctcatcactaaggacgacagggctgctacatgtcaatttctatggaaggatg

SEQ ID NO: 64785 - DNA, 385 bp, Zea mays
  Clone ID: LIB3075-022-Q1-K1-F4
gattgatcccaagctaattggtcgcttggaggtgggaagtgaaacagttatagacaaaagcaaatccatcaaaacttggctgatgcagatttttgaggaaagtgataatactgacattgaaggtgttgactccagcaatgcatgttatggtgggacagcagccctactgaattgtgtgaattgggtcgaaagtaactcctgggatggccgttatggtcttgtcgtttgcacggacagcgcggtttatgcggaaagaccagctcgttcaacaggaggtgctgctgctatagcaatgctcattggtcctaatgctccgatttccttcgagagcaaatatagagcttctcatatggctcatgtttatgatttctacaaacctgatctt

SEQ ID NO: 64786 - DNA, 324 bp, Zea mays
  Clone ID: LIB3075-022-Q1-K1-F5
cccacgcgtccggctccatgaggacgagtgtgtaggcggcctcgaggtcctggacccgggcaccggcgagttcgtgcccgtggaccccgtcgcgggctccttcctcgtaaacatcggcgacgtcggcacggcgtggagcaacgggaggctgcacaacgtgaagcaccgggtgcggtgcgtcgcacccgtgccgcgcatctccatcgccatgttcctgctcgcacccaaggacgacagcgtgagcgcaccggcggcgttcgtggacgcggaccacccgcgcaggtacaaggtgttcaactacaacgactatcggaggctcagact

SEQ ID NO: 64787 - DNA, 261 bp, Zea mays
  Clone ID: LIB3075-022-Q1-K1-F6
gtcttcttcatgcccgacttagcgcacgctaagttcggcgcggccaccgccaccgccgctggcgctgctgggagcaacagcgcccaggccaagggggccgtcaccaccaccgatgttgcacagaagattgttaagcaggttgagtatcagttcagtgacatcaacctggtggcaaacgagttcttgctcaagattatgaacaaggacacagaaggctatgttccgttgtcagtcattgcatcctggaagaagatcaagtct

SEQ ID NO: 64788 - DNA, 379 bp, Zea mays
  unsure at all n locations
  Clone ID: LIB3075-022-Q1-K1-F8
cacatcctctcttttctaccaatactgctctagccgtcgcaaaacctcctgacttcccccagatccagatcgtttccccagatccagatcgcaggcgtgaagggcaactgttaccagattatgatccgttttcgagcttcgaggaatcgacgatcaagcttcggtgaccaagtgacctggttcttcgagttctgcaaggttgaagaccctgagcatctatttggtgaagaaattgctgttttcacgtgggaacatggttggtaaagatcatcctgtgcctacaatttccaaatcagagttcactggtatttgtgacttcccatcagagataacattgatagcanatgaaaatgaaaaccgacttgatatattggaagct

SEQ ID NO: 64789 - DNA, 400 bp, Zea mays
  Clone ID: LIB3075-022-Q1-K1-F9
attcttcttgcttcacgcccagtctggtttcatctacaccgtcaaggacacggaggcctagagctgaacccctgaagaaaccatcacttccacagctcgttgttgagcctacggaagcaaggtcaaattcgtttgttgggacccatgaatatcttgccccagagatcattcgaggagatggccatggcagctcggttgattggtggactcttggaatcttcctttacgaattactctatggcaagacaccattcaggggaccggataatgacgaaacactctcaaatgtgatctcacagggcttgaagttccctgacagtccagcattaagcttccacgctcgagatctgatcagagggctgcttgtgaaagaaccggagtaccggcttggctcgtcgag

SEQ ID NO: 64790 - DNA, 140 bp, Zea mays
  Clone ID: LIB3075-022-Q1-K1-G1
tgcaagaacatgctgatcaaggacgtgaccgtgacggcgcccggggacagcctcaacacggttggcatccacatgggcgaatcatccgggatcaccataaccaacaccggcattgccgttgccgacaactgaatctccat

SEQ ID NO: 64791 - DNA, 226 bp, Zea mays
  Clone ID: LIB3075-022-Q1-K1-G10
cccaagtccctgttcaagggtgctggtgcttacattcttcgtgccattgctggcgctggtgtgctttctggctacgaccaggtgcagatcctcttcttcggaaagaagtactgctccggcggtgctttaatggagaaaaatgatgacgaacaagagcagttcgcttccggtccaacccaggcaagatctgggcaaggttttggctttcatatcgaagaaaataata

SEQ ID NO: 64792 - DNA, 381 bp, Zea mays
  Clone ID: LIB3075-022-Q1-K1-G11
ctatcatcatcttctccgatccatcaacaatcgccgagagcgatcgagagataaataaagatgaagaaagtggcatcatcgggagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaagagtcctgcgacctctcacagcgcttcaacctggtgctgtacggccggatccagtgcaagggctagtgcaccgagcagaatggcattaccgcgccgcagatgaaggtgttccaagaggcgtgcgacaaggac

SEQ ID NO: 64793 - DNA, 383 bp, Zea mays
  unsure at all n locations
  Clone ID: LIB3075-022-Q1-K1-G12
gggctcaccggtcatcggctcgagatcgatggattaggtgcaaaagtggatcgcgggccgacgccagtacagttgtcagctcggcccaccttctcggcccgacgccctgattccgctcctcttgctctcgcacccttcccactgccagcggcggctgaaggcggcgcggtatcagcttggtgatttgtgagcgatggcgccgccggggtcgcggcggtgggcttacgtgcgcgtgatggccggcaccatcctcggtggcgtacttggattctacgtcatgcaccgcatcgagacctcgtacaaggcgaagatggaggagaggctgcngaagtaccaggcgcatatgctcggcaaagccaaagagtcgcagcatttgcaggacg

SEQ ID NO: 64794 - DNA, 265 bp, Zea mays
  Clone ID: LIB3075-022-Q1-K1-G2
gtattttatgatgccccatctgattacaacttggtggatggaaaagatgacttcgtatatctgaacgacattctgaatgagccacttggaaatgaatcgctctttgatggagatgatatgatggcttactttgatgccacagagaatgatttcaagtatgacattttgggctctggtcagggtttggattatcacactcgcacacatgccgtaaaactttgcccaaaagagtcacagggaacacatgttcacattcaaggggatc

SEQ ID NO: 64795 - DNA, 236 bp, Zea mays
  Clone ID: LIB3075-022-Q1-K1-G5
gcgggccaactactgtttctctcaagagcagagcccctcttgagaacgcgaatggtaccatgcaaggatcatggaacggctatgtcaatgatgatgacagagcacttttgaaggttattaagtttgcctcaccaacttctgctggagctgactgcattgaccctgattgtagctgggttgaacaatgggtgcaccgtgctggtccacgcaaacaaatatattttgagcctcaatat

SEQ ID NO: 64796 - DNA, 147 bp, Zea mays
  Clone ID: LIB3075-022-Q1-K1-G6
gggcatcgtaaatccatagtggtacttcactgttttcaggtggcgccattccagattctttggattcatgttcctgcagttggccacgccagtttttctttttatatgtggtggtgctttggtggacttggaaaagactatttttga

SEQ ID NO: 64797 - DNA, 198 bp, Zea mays
  unsure at all n locations
  Clone ID: LIB3075-022-Q1-K1-G7
tcgatcgtcactcactgcatcgttcgttcatccatcaactactggaaattagagagccggatctcttggtcggagaacctgcgaggaaggactaaggagtcgaagatgactgcggcggtgctgtccgtgcgcacgacgacgacgtcgctgctagcagcagtcatnctgtgcctctgcatcgtctccctctccccccgc

SEQ ID NO: 64798 - DNA, 177 bp, Zea mays
  Clone ID: LIB3075-022-Q1-K1-G8
gcatcggcatcatcgcccagccaggaggcagtcagaaggatgaggacgccgtcgcgtgctggaacaagtatggtgtgtcgctcgtgctcaccggcgtcaggcacttcaagcattagccgtcatgccccatggctggtcatcttagcttatggagttacggtgaaaaaaaaacaagct

SEQ ID NO: 64799 - DNA, 320 bp, Zea mays
  Clone ID: LIB3075-022-Q1-K1-F10
gcgcaggcggtagtggagttggtgcctgctgatgataatatcgccgccgccgctgctggcacggcggtggacgatggcgagccgcctcagcagtgcgcgaccccggtgagcgtggaggaggcgtgccgcggcgcgtccgatacgcacgccggcgtggcctacgaccactgcatggcgtcgctgggcgccgacccgcgcagcatggaggccggctacaagaacatgcacgggctggcggtgctggccaccatgatggccatcgaccacgccgtcagcaccgagtccaagatcgtcgacctcctccgcgacgcgctggacaa

SEQ ID NO: 64800 - DNA, 246 bp, Zea mays
  Clone ID: LIB3075-022-Q1-K1-H1
cgaacagtccagaacccactgctcgaaaccgtagccactggccagtcgatgcccatgactgcggtgcccaggaccggccccggttgcctggggtcgccgccggctcaggctctgtcgagctcactagccggggttcaaggcgccccgaagcgactgggcgcatcgaagccgtcgtggatcgttcgcactgagtcaaacgtgaggagggagagagcaaaacgacctgatcctccttgcaccatctgc

SEQ ID NO: 64801 - DNA, 369 bp, Zea mays
  Clone ID: LIB3075-022-Q1-K1-H11
gcaactgaaaacagccgagcgatctcctctccctctccctctccgatccattctccagcgcgagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaatgacttcgacgagccagggcacctcgcgccgacaggcctgttcctcggacctaccaagtacatggtcatccaaggcgagcctggtgccgtcatccgtggcaagaagggatcaggaggcatca

SEQ ID NO: 64802 - DNA, 207 bp, Zea mays
  Clone ID: LIB3075-022-Q1-K1-H12
ccggttcgggttcgggttcgtgaggttctccggggttcggtttcgtgggtgagcggatcgagatggcggcgtcggatgttgagtaccgttctttctccgggggcctcgcctgggcaaggaacgaccactccctccacaacgccttcagcacctacggggaggtcctcgagtccaaaatcatcctcgatcgggagacgcataggtccc

SEQ ID NO: 64803 - DNA, 432 bp, Zea mays
  Clone ID: LIB3075-022-Q1-K1-D11
ccaacatcgccgccgagtgcctgcggtacggcctggacatcacccggcagcccatcccggtggtcccggcggcgcactacatgtgcggcggcgtccgggcagggctgcagggggagaccaacgtgaagggcctctacgtggccggcgaggtcgcgtgcacggggctgcacggtgccaaccggctagcaagcaactcgctgctggaagcgctggtgttcgccaggagggcggtgcagccgtccatcgacctcatggtggatgccgacggagatgccagaccgtcgctggcggcgaggtgggcacggccgacgctgccgcggtcggtgctgggcgacagcgtgctgtcggacatcgtggggcggacgaggcatgccaagatggagctgcaatcagtgatgtgggagtatgtcggcatcgtgcgctcgacggggc

SEQ ID NO: 64804 - DNA, 366 bp, Zea mays
  Clone ID: LIB3075-022-Q1-K1-D12
cactgatatcggtgggggatggcagcttgcttggaaatggtcagagaaggaaggtgagaatggtagaaaggaaggtggtggtttcaaaagagtctacttgcaccaagagggagttcctggctcaagaaggggctcaattgtttcacttcccggtggtggcgatgttcttgagggtagtgagtttgtacatgctgctgctttagtaagtcagtcagcacttttctcaaagggtcttgctgaaccacgcatgtcagatgctgccatggttcacccatctgaggtagctgccaaagggtcacgttggtaagatttgtttgaacctggagtgaggcgtgccctgttagtctgtgttggaattcaaatcct

SEQ ID NO: 64805 - DNA, 284 bp, Zea mays
  Clone ID: LIB3075-022-Q1-K1-D3
gttctagatcgcgagcggcgccctttttttttttttttttttttttttttttttttttttttttttatggcaccatttgagaacattcagtattcatagagaacgcaaaaagtcgcaacactgtatgttttttgcctcaaaacggtatcaaggtaagcaaagtacaaaactatccagcagcacatgaggctcgaaaagaacaagcatgaaaatttgagcaaaccgtatggaaacacctctctcctcttcatacaacactagcacctagaaggttctgggacacc

SEQ ID NO: 64806 - DNA, 376 bp, Zea mays
  unsure at all n locations
  Clone ID: LIB3075-022-Q1-K1-D4
gccagagccaagcagctagctagtagcggccggcagcatcgcgtagtagagtgtgctcagagcagcgcgcgcatgggacccttgggccccaccgtgagcttcagtatcatggtcatggccaggctcagcggcgccgcccagcagcagccggaggatgagagggagaggaaggagggcgggagtgggtgcggcttccggatgccgctgcactacccgcgctacaagaaggcggactacgaggccatgcccgagtggcgcgtcgactgcctgctccgcgagtacggcctncccgccgacggcgacctcgacagcaagcgccgcttcggcatgggcgcctttctctgggccgaccagtactgatctgatacaattcaac

SEQ ID NO: 64807 - DNA, 158 bp, Zea mays
  Clone ID: LIB3075-022-Q1-K1-D5
tagcggcgccctggcagcttgcttggaaatggtcagagaatgaaggtgagagtggttgcaccgattgagaacgttcacttttcatagcgtacgcaaaaagtcgcaaccctgcatgtgttttggcttaaaacgggattaaggtaagcaaagtacaaaac

SEQ ID NO: 64808 - DNA, 95 bp, Zea mays
  Clone ID: LIB3075-022-Q1-K1-D6
tgcctttttttttttttttaaaaaaaaagcgagctcgcgtacttgggcttggacgcttaggactggttcgtggtgtcgttctagcggtccttttt

SEQ ID NO: 64809 - DNA, 299 bp, Zea mays
  Clone ID: LIB3075-022-Q1-K1-D7
tctggttatcaatgagaaaacgcagcagggtagtacatgatcgccgcgacaaacagtggcgcgtcgaagcacgtaccaccaccaccacgcgcaaatgttcgtcgcggcgatcgtcgactacatagatacgcacgctcgtcgacacctaagacaacgcacacatcgcacgggctggactgacgcgcgccagaccggacgacatatattttggagcatgaaccacgtatccagcgcggatctagcagaagaggtagccgaaggcggcagacgcgaaggaagccgtagtgaagggtacgggt

SEQ ID NO: 64810 - DNA, 422 bp, Zea mays
  Clone ID: LIB3075-022-Q1-K1-D8
cggacgcgtgggttgttgagcagatcaccatgtatatgtacctcactgggagggtggatatgaggcagattgagaagacaattcagtatcttattggctctggaatggatcctaggactgagaataatccttatcttggtttcatctacacctccttccaagagcgggcgaccttcatctcacacgggaacactgctcgtcacgccaaggactttggcgacttaaagcttgcacaaatctgcggcatcatcgcctcggatgagaagcgacatgaaactgcgtacaccaagatcgtggagaaagctgtttgagatcgaccctgatggtaccgtggtcgctctggctgacatgatgaggaaggaagatctcaatgcctggccaacttgatgttgacgggcaggacgaacagctgttcgagcact

SEQ ID NO: 64811 - DNA, 420 bp, Zea mays
  unsure at all n locations
  Clone ID: LIB3075-022-Q1-K1-D9
agcacaccgccttcgccgcggacgacgcgatcatcgccgccgccgccgtcatcacgtcgcagcccggccggcggttcacgtcgtacccgccggcgagggcgcgcggcggctgcaggctggccccggcggcggcggcgcgccaggccacggacgatcccggcgccgctgtgtcctggccagaactagtcgtgccgcggcacgccgacttcgacgactggatggagaagcacccgtcggcattggccgcgttcgagtcggtgctggccgccgccaaaggcaagaagatcgtcatgttcctcgactacgacggcaccctgtcgccgatcgtcagggaccccgacagcgccgtcatgtccgaggagatgcgggacgcggtgagaggcgtggccgagcacttnccgactgcgatcgtgagcggga

SEQ ID NO: 64812 - DNA, 299 bp, Zea mays
  Clone ID: LIB3075-022-Q1-K1-E1
cggacgcgtgggatcgatcacgacaagatggcgtgcacaaacaatgcgatgagagccttgtgcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcac

SEQ ID NO: 64813 - DNA, 402 bp, Zea mays
  Clone ID: LIB3075-022-Q1-K1-E10
tgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcatggcccagccgtgtggagcaagaactcctgcaccaagaagtacgactgcaagatccttcccaactcgctggtgatggacttcgtgaacaacggggaggtgtccggggtcacgctgttcaactccaagttctttcacatgaacatgtaccggtgcaaggacatgctgatc

SEQ ID NO: 64814 - DNA, 383 bp, Zea mays
  Clone ID: LIB3075-022-Q1-K1-E11
ctagatcgttgtgggttccagaagaaccatcaaatgcggatgacataagaggtgcttgcatcgaggagtgcaccaaagaaaataaggctcctggcgacaagaagacatgcgaagtgttgtgcaccaagctcacaaaaaagcctagcgaagaaggcaaacatgattgatgaagtagcactccgataatatataccctagtggatgagtggtcatctttgtagccatgtctgccacacgatggccttgattatattggcttattgttttgtttttggtttccactagtatcctaattccttgttcatgtaacctaatgtcactcaaagcattttatatgcttcacttaattaaataaatacaaaggcaaaagcatgttctgtttt

SEQ ID NO: 64815 - DNA, 222 bp, Zea mays
  Clone ID: LIB3075-022-Q1-K1-E12
gcgcgacccgccgaccggctgcgccctgtttggcatctacaacggcatgttccgccgccgccgctccgcattcatgacctgcctccaccggatcaacggggccgaggccgaggccgcggtgccgccgaaccagaagcccgccgcgcaccgcgactccttcctcgcgcgccgtcccagcgccatgcccgtgccggcggcggcgcataacggcaggagcaggcc

SEQ ID NO: 64816 - DNA, 379 bp, Zea mays
  Clone ID: LIB3075-022-Q1-K1-E2
gcgggcggcgggcgcctacgggctcatcagcgtccacagccgtgacctgatcccggtccccttcgacacgccggccgacgacttcccggtcctcgtcggcgactggtacaccaaggaccacaccgtcctggccaagaacctggacgccggcaaggggatcgggcggcccgcggggctcgtgatcaacggcaggaccgagaaggacccttcgaacccgcccatgtccaacgtgaaggccggcaggacgtacggtttcggcgtttgcaacgtggcatcaaggcgttcttcaacattcgcattcagaaccacattatgaagcttgtggagatggaaggctttcacaccatgcgcaacgactacgactcgctggaccttcaca

SEQ ID NO: 64817 - DNA, 59 bp, Zea mays
  Clone ID: LIB3075-022-Q1-K1-E3
ttaaatcttcctcgcttggaatctaagccaacaactgcagaagtccagcccttaaacct

SEQ ID NO: 64818 - DNA, 260 bp, Zea mays
  Clone ID: LIB3075-022-Q1-K1-E4
cctttatatgtcatgggggacacacctgctattgaggcactgcagaaaatgatccaaggtaagtttagacaccttccagttgtagaaaatgggtaaggttttggcgtggtgggcctttccaaatggccttttggtgccatttccagacttggaaaggccgcagaaccagaaggtgcgcttgccgcttgttgtaaaaggggttgaccaacagttaggtggcaacttcttagttccacacattctcttgagactattagaga

SEQ ID NO: 64819 - DNA, 287 bp, Zea mays
  Clone ID: LIB3075-022-Q1-K1-E5
cgagagttctgactagccacatccagtcaagcagtaaaggcgcaccatggaggcggcggcggagaataaggaggccgagcaggaggagcagcagctaccgcacgcgcagaaggataacgcgcccgtcgccgccgaggaagacgaagcggattcggaggagaccgagcgccgcaaccgcgacctcaagtccggccttcacccgcttaggcacaaactcgtgctctggtacactcgccggacgcctggagcgaggtcgcagtcgtacgaggacatcatcgagaagatca

SEQ ID NO: 64820 - DNA, 328 bp, Zea mays
  unsure at all n locations
  Clone ID: LIB3075-022-Q1-K1-E6
ataaacaagcgcacacgaacaaatacctcgccgccaataatggcctccagatcctccattgtgctcgccacggcgatgctagctacactattcgcggttggtttgtgcaccaccccgctcaccttccaggtcggtaagggatccaagcctggccacctgatcctcaccccgaacgttgccaccatatccgacgtggagatcaaagagcatggtggcgatgacttctcctttacgctgaaggagggcccgaccggcacctggacactcgacaccaaggccccgctcaagtacccnctttgcatccgctttgctgtcaagtctggtggct

SEQ ID NO: 64821 - DNA, 433 bp, Zea mays
  Clone ID: LIB3075-022-Q1-K1-D10
gtcagaggaattcttcttaatgctggcatctgtcaactatgtagaggtgatcctattgccatcacaaattcattggagcgataccaggaaattgacccgactttctctgggacacgtgaatacaagcttttagctgatcttgctgcatctatggatgaaggggatgttgccaaattcactgatgcaatcaaagaatttgatagcatgacacgtctggatccttggaaaaccaccctgctgctcagggcgaagaacgagctgaagaaaaaggaggacgatgaggacgaccttacataagtattgtagtaaaaagaaatggtacgatatgttttggtttgtgcctccattgcattggaggcatcgtgttccttacaaacgagcatgatgaaattaatcgctggtctggttgtacagaacgtcaatttgggttcta

SEQ ID NO: 64822 - DNA, 410 bp, Zea mays
  Clone ID: LIB3075-022-Q1-K1-E9
gatggttgggttgcacctaaacttgcaaagcggatggacaagtttatgctatatctgataactgctggaaagaaggcattagaaaatggtggactcaccgaagaactaaggaatgagttggacaaaaccaggtgtggggttcttattggttctgcaatgggtggcatgaaggtttttaatgatgcaattgaagcactgagggtctcttacaagaaaatgaacccattttgtgttccttttgcaactacgaatatgggctctgcgatccttgcaatggatctgggatggatgggaccaaactattctattttcacagcttgtgctaccagtaacttctgtatccttaatgcagcaaaccacatcagaagaggcgaagctgacgttatgctctgcggtggttctgatgcacc

SEQ ID NO: 64823 - DNA, 253 bp, Zea mays
  Clone ID: LIB3075-022-Q1-K1-F1
cggacgcgtgggaacaccctgaatttgagggtattacaccgtcgatcatagtactggacccgggcgccggcgagttcattcccgtggaccccgtctcgggctccttcctcgtaaacatcggcgacgtcagcacggcgttgagcaacgggaggctgcacaacgtgaagcaccgggtgcggtgcgtcgcacccgtgccgtgcatcttcatctgcatgttcctgctcttacccaatgactacagcgtgagcgcacc

SEQ ID NO: 64824 - DNA, 239 bp, Zea mays
  Clone ID: LIB3075-022-Q1-K1-B11
cacaaaagcaaaaagcatcatcacaataatggccagtgcgtgagtgtgcatcatggcgccattcgcggccctcttcgtggtagcccttgctctagtggcggccaccagcccacaggtagcggtggcgaaaaataaaagagcggtgaacagcgtgctggacgacttggcgaagaacatccaggacaacatttgctcgacgctgttcgagggcaataaagggacggacctggtcgtgtgca

SEQ ID NO: 64825 - DNA, 200 bp, Zea mays
  Clone ID: LIB3075-022-Q1-K1-B2
gcgctccaaaatgctttccaagaatttgggcaggtcaaaaacctgcatttgaatttggaccgtcgtaccggatttgtcaaggggtacgctatgattgaatatgagaagtttgaagaagctcaggctgcaataaaagaactggatggagctgagctttatgaacaaaaaatgagtgttgattgggcctttagcagtggccc

SEQ ID NO: 64826 - DNA, 372 bp, Zea mays
  Clone ID: LIB3075-022-Q1-K1-B3
gggaaacatgttgtttttggtagagtgatgaaaggaatgggggtagttcgctctattgagcatgtttctgtcggagaagctgactgccccactcttgaagttaaaattgttgattgtggggagcttcctgaaggtgctgatgatggagttgtaaactttttcaaagatggtgatacgtacccagattggcccaatgatcttgaagagaagcctgctgaggtttcatggtggatggatgctgtggagtctgctaaagcttatgggaatgacaatttcaagaaacaggactacaaagcagctctcagaaagtacaggaaagctctgcgctacttggatctttgctgggagaaagaagagatagatgaagattag

SEQ ID NO: 64827 - DNA, 227 bp, Zea mays
  Clone ID: LIB3075-022-Q1-K1-B4
atcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgccttcggcaatggcaagacagacagcacgaaggctgtgcaggaggcatgggcatcggcgtgcggcggcactggg

SEQ ID NO: 64828 - DNA, 318 bp, Zea mays
  Clone ID: LIB3075-022-Q1-K1-B5
cccacgcgtccggtgaaggaccccatcccgagggacgtgtgggagaagatctacacctggctcgccaagcccggggccggtgtcatgatcatggacccctacggcgccaggatcagctccatcccgcaggatgcgacgccgtttccgcaccggcagggcgtgctgttcaacatccagtacgtcagctactggttcggcgagggcgacggtgctgcgccgacgcagtggagcaaggacatgtacgcgttcatggagccttacgtcagcaagaaccctaggcaggcgtacgccaactacatggacctggaccttggcgtt

SEQ ID NO: 64829 - DNA, 178 bp, Zea mays
  Clone ID: LIB3075-022-Q1-K1-B6
ctccaaaatgctttccaagaatttgggcaggtcaaaaacctgcatttgaatttggaccgtcgtaccggatttgtcaaggggtacgctttgattgaatatgagaagtttgaagaagctcaggctgcaataaaagaactggatggagctgagctttatgaacataaaatgagtgttgatt

SEQ ID NO: 64830 - DNA, 267 bp, Zea mays
  Clone ID: LIB3075-022-Q1-K1-B7
tgaaacatgtcgtcttggtagagtgatgaaaggtatgggggtagctcgctctattgagcgggtttatgtcggagaagctggctgccccactcttgaagttaaaaatgttcattgtggggagctttctgaaggtgctgatgatggactttgaaactttttcatagatggtgatacgtacccagattggcccaatgaacttggagagaagcctgctgaggattcatggttgatggatgctgaagactctgctaaagcatattggaatga

SEQ ID NO: 64831 - DNA, 419 bp, Zea mays
  Clone ID: LIB3075-022-Q1-K1-B9
aagacgaggtagaggagggggcgagcgacataggcagtggaggggcgcggtgaggaggccggcggcgcgcgcgcgcttgcggcgccggcggcctggcgatgggggaggtggccgcgctgcgccagctcgtcggccaggtccaggagctctgggacctctacggcgccaacggcaaccccgtccccaggtggtatttacctgacttcgaacatggttcaatcaaggatgattattgtgggggaagctcaggatacaactcggaattactgaagatcatggaaactaaccaatctcccccttgcaagcgaccgcggagagatcgaaaccgtgaaaaggcaccctcctcaaacaaaattgaagtcatggaacaagagatatggagagatttccctgaagatcttttcgaaactgtcatagca

SEQ ID NO: 64832 - DNA, 417 bp, Zea mays
  Clone ID: LIB3075-022-Q1-K1-C1
cgtggacgtggcccgcgtgcagtgcggcccaggccacggcatgagcgtcggcagcttgggtcgctactccggcgagggagacgtcacacgggtgcacgtccgcgacatgaccttcacgggcaccatgaacggcgttcgcatcaagacatgggagaactccccttccaagaagcaacgccgcgcacatggtcttcgagaacatggtcatgagggacttgaaaaaccccataataatcgatcagaagtactgcccctactacaactgcgagcacaagtacgtgtccggggtgactctcaatgacattcacttcaagaacatcaagggcacggcgacgacgccggtggcggtgttgctccggtgcggtgtgccgtgcaagggtctggtgctgcaagacgtggaccctaggtgcccgtgct

SEQ ID NO: 64833 - DNA, 307 bp, Zea mays
  Clone ID: LIB3075-022-Q1-K1-C10
gggaaattcaaatttagcccaatcagcgtgaatttcttgacagagattacaaaaattatgtttaccattgtaatgctattcatccaggctagacgtctaaaggtgggagacaagccactttttacagtttcaatatttatgcatgctgctcgcaataatgttcttctttcagtacctgctcttctctatgctatcaacaactatttgaagttcataatgcagttatattttaatcctgctagcgtgaaaatgctgagtaatctcaaagttctggtaatcgcagtgcttcttaaaatgataatgagga

SEQ ID NO: 64834 - DNA, 270 bp, Zea mays
  Clone ID: LIB3075-022-Q1-K1-C11
gaaacatttcccgacgggtgtttcccacgccggaatggaccagccggctccataagcccaagattcgtttgcattcagtaatgcctttgcctaaatcagacctggggtcataactctttagtagagaaccaagaagatgcatgcatctagggcaaggcttttcaaggagtacaaggaggtacagcgagagaatgtagcttacccttgttttcaaataatatgtgatgattctaacatatataagtggactgctcttatcaaagggccttt

SEQ ID NO: 64835 - DNA, 429 bp, Zea mays
  unsure at all n locations
  Clone ID: LIB3075-022-Q1-K1-C12
aaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcatgcgcgcaagcacgtcgcgaggtcggcccgcaccatcccgccgcagcagacgcaggcgctcacgttctgcgacaccatgtacatgaacacgcatgacaccatcggcgcggtgcatcgggccatcacgttcaaggacaccggcaccgncaagatcatgct

SEQ ID NO: 64836 - DNA, 262 bp, Zea mays
  Clone ID: LIB3075-022-Q1-K1-C2
gggcgagagaggaggagacatgggcagcagctcgcaccaggtatacctcaccttcccttcagagagcaccttcatggaggaagacgtggccaattacttcggtttgtatggttctgtgcgcgacgtgaggatcccatggcaggagaaacggatgtttggcttcttaagcttcaacattccgaaaacgttaacaacattcttacaatacgcattccacatattattggcgaaatcaagggtcctggtgaaacgttacatagag

SEQ ID NO: 64837 - DNA, 284 bp, Zea mays
  Clone ID: LIB3075-022-Q1-K1-C3
gtttagatcgcgagcgccgcccttttttttttttttttatagaagtatggttaatgaagcagcatcagatattaaagaaacagcatcagataacgaaacggtcaggtagaaaccagacacaacggacttcacaaggtaatacatgagttcaacagggcacaatggtcctcaaaagtccattcatacttgcgacttgactggttatttaggtgataacgatttggggtccggcacattcaccagtttggccagcttttagccttgcttctagcccatggcatact

SEQ ID NO: 64838 - DNA, 270 bp, Zea mays
  Clone ID: LIB3075-022-Q1-K1-C5
cggacgcgtgggcgcgagcgtccgccctttttttttttttttttttttttttttttttgtaacgttcaagtgagatattcaattgttcagatattcaaattctttgaaaaactcagcacaaacattcaaatgttcagatattcaaattcttcgaaaatgttcagactttagacaaaaagtaactctaatatagcagcttcacacacgcacaggggacaactccgaaactgagtgggcagaagacttaacacggtcgaaaagctaaagcct

SEQ ID NO: 64839 - DNA, 251 bp, Zea mays
  Clone ID: LIB3075-022-Q1-K1-C6
acgtgaagcggaagagaggaggaagagagaggaggctgaaaggaaagctaaacttgatgccatcgctgaaaagcagcgattgagagagatagagctggaggagaaggcaaaggcaacaagggagaagctcttaaagggatccgaggctgtgcgcgctccagattctgcacctgttgcacagccacctcgagagtcagcagcagcgcctgcagctgctgcggctgctcctgctcctgctcctagtaaatata

SEQ ID NO: 64840 - DNA, 167 bp, Zea mays
  Clone ID: LIB3075-022-Q1-K1-C7
cggacgcgtgggcggacgcgtgggaaaaaattaaaaaaaaaaaaaagataaaaaaaaagagaaaaaaaaaaaaaaaaaaaaggagtagataatagaattggaaatgttggtaaaaagtaacaagggacattgatcttggtcatatattaggctgtcttgggctattg

SEQ ID NO: 64841 - DNA, 316 bp, Zea mays
  Clone ID: LIB3075-022-Q1-K1-C8
agcaagaccacctaggaggcctctctctccctctccccagccacccccgtagcgagagggagggcggaagaggatgagcgcgtccaggttcataaagtgcgtcacggtcggggacggcgccgtcggcaagacctgcatgctcatctcctacacctccaacaccttccccaccgactatgttccgacagtgtttgataacttcagtgccaacgttgtggttgatggtaacactgtcaacctcggcctctgggacactgcaggtcaagaggattacaacagactgagaccactgagctatcgtggagctgatgttttc

SEQ ID NO: 64842 - DNA, 363 bp, Zea mays
  Clone ID: LIB3075-022-Q1-K1-C9
agcttgtgtagtagactcagcacctgttgctgcacctgatcctcaggtttgggctttgggcttctcggctgccctcatgaaaaaacgcagtgtcaccacgaagggactaggttcagatgattcaaggtctgatgtcctagttgtggagtccaacaaggagctcaagctgggggcaacagaggcggttatactgtcagcgttagagagtttctttgacgttgttttgaactatccaaagatcaatatgaggttgtgtgacgtgatggagctcttgtcctggaagcaacccaagtgcccccaattgtacatatacagctccgtcgacagggtgatcccagcgaaatcagtggaggcattcatcga

SEQ ID NO: 64843 - DNA, 250 bp, Zea mays
  Clone ID: LIB3075-022-Q1-K1-D1
gcgcgcaacctgtctgtcacattgttcattctgacggcctatgtcgccgcgacggcggcaccgaccgtctgtgcggtcaaatctccggcgagcacaacgaccacaaggaaacacgaagcagccaaagaagagacggatgcgcctgccaaggcaccagctgctgcagccaccgaggggcctgctgcgggagcgcccatgacatggccggatggcgggcctgagttcgtcaagatggtcatcaagaacccct

SEQ ID NO: 64844 - DNA, 437 bp, Zea mays
  Clone ID: LIB3075-022-Q1-K1-B10
aagaagctcaagccggaactctgcgccgacgccatgggcacgctcatctaccagtccgacatgcgcgcgcaggatcccgtcggtggctgctaccgcctcgtcctcagtctggagcgccagctcgagatcgatactgccgagctcaccgccgtgctccaccacttggcgttctgccgccaggctaccacgacaaccaccgtgatggcaccgcaacagcaaggcggtggcatggctgacctcgacgtcacgtcctccaaccagccgcttcttcccaacgagcagcaagaagtcgttgacgcactctacgtgaatcacgaagctcacaccgccatccttcaaaccgacgaggtcgtccaccgccacggtggaggccacagccccaccgatgatcatcacggtgagcagcaacagcagcagctcttcgactacttttatta

SEQ ID NO: 64845 - DNA, 441 bp, Zea mays
  unsure at all n locations
  Clone ID: LIB3075-021-Q1-K1-H5
gggcttcctgctgctggccctcatctggcggttcgacttcgcgcccgtcatggtgctcggcatcgccgtgctcaacgacggcaccatcatgaccatctccaaggaccgggtgaagccgtccccggtgcccgacgcctggcgcctccaggagatctttgccaccggcgtcgtcctcggcacctaccaagctctcgccaccgtcctcttcttctgggccgtccgcgacaccgccttcttcacgaatacgttcggggtgcaccacatcggggacagcacggaggagctgatggcggccgtgtacctccaggtgagcatcatcagccaggcgctcatcttcgtgacccgcgctcggagctggttcttcgtggagcgccctggcctgctgctggtggccgtcttcctggccgngcagctggtggcgacgctgatcgccgtgtacgc

SEQ ID NO: 64846 - DNA, 426 bp, Zea mays
  Clone ID: LIB3075-021-Q1-K1-H6
tcgcggactcgtggtcggactcgtgggctgacgcttgggctgatggcttggagaaaatcttggaatagcttggagatcggatgggtcgttttttatttgaacctatccaaggtgaaactggggtagtaatcccacctgatggctatttgaaaagtgccatagactcgtgttctaaacacatccttttcatgattgctgatgagatccaaactggcatacctagaactggtaaaatgctgtcatgtgactggtaaaacataccgcctgacatggtgattctaggcaaatgactcggtgctggagttgttccagtcagtgcagatcttgcagacaatgatgtcatgctgcgtatcagaccaggggaacatggaactacattcggtgggaattcgttagctatcgctgtggcagctgcatcactgaaag

SEQ ID NO: 64847 - DNA, 400 bp, Zea mays
  Clone ID: LIB3075-021-Q1-K1-H7
ggcagatcctgagcgagtctctcatcgtgctgggcgagatcggcggcggcgactacaggttttggttcgctgcccgtagggcccgcgagcaagccggccagttcatcccagacattgtcgcgaccattggctctgctgcccaggagctcatcggcatgggcgcgaaggcgatcctgatcccgaacaacttccctatcggctgcgtaccgacatacctgagcgggtacaggagcggcaaccgcgcggactacgacgagcacgggtgcctccggtggttcaacgacttctcccagaggcacaaccgggcgctgcgcggcgaggtcgaccggctcaaggcgcagcaccccggcgtgaagctcatctacgccgactactacggtgccgtcatggagttcgtcaa

SEQ ID NO: 64848 - DNA, 357 bp, Zea mays
  Clone ID: LIB3075-021-Q1-K1-H8
ctcacacgttcaccgattctgtcaccatacttgcctagatcggccacctgtattaccagctatactctgctgaacgcatggctccagatcaacctgctgttgatataacacacgttgatgcaaacattgattttactaaccataagcttctagacatcctcactaattcgataattaaaccgaacaaatctactctacactgcattcctcactaccttagcactatcgataacgatataccgacagactactagtagcacgaatgacctcagtcattaaatgactcttaccataatgctaatcacgatcttacataagtacgtccatcatctgagtcatctacatctattcttacat

SEQ ID NO: 64849 - DNA, 320 bp, Zea mays
  Clone ID: LIB3075-021-Q1-K1-H9
cgagaactctagatgccccgcgaccgctactagccatcctccgtgcgcgtctacaccgtctgcgactagtccaggtacctgatcgtgctcaacgtgccgtcactcggatgcggtgacgacctctccagtctcttctggacgtacggccctgtggaggagtgcacgcccatggattcataagactctgagccctacactgacgtcttcttcgtcaagttctcacaggtcaacaactccaggtttgcaaagaggaagctcgacgagtctgtgtttctttgcaaaccgctgcaggtgaactattcccctcaattttataaccc

SEQ ID NO: 64850 - DNA, 253 bp, Zea mays
  unsure at all n locations
  Clone ID: LIB3075-022-Q1-K1-A1
gccttgaggaggaggaagtgaggccagancgttgaatgcacatcttccatatttctacacaaaaacacaaaaacacaatgcacatcaactgacagaagtgcaataccctctcatatgcagagtttcggaatactgggctggagagatcagaggcgctgaaaaatgatctggaatggttcacgcaacagggccacacaattccaaaaccatcgggccctggcaccacatacgcttctctactggaagatctgtc

SEQ ID NO: 64851 - DNA, 428 bp, Zea mays
  Clone ID: LIB3075-022-Q1-K1-A10
ggaagaggttctcttccaatttgagaatagtggtggtgatgacagctatttcctgaacaacgctccaatcattgctgttgatcgggctccaaatgttattgctatcaatgtaagcccaattgaatatggacatgtgcttctcattcctcgtgttctggaccgcctgcctcagaggattgatccagagagcttcttgcttgcactgcaaatggcagccgagggaggtagcccatacttcaggcttggttacaatagcttgggtgcgtttgccaccatcaatcacctccactttcaggcgtactacttgtcagtgcctttccctgttgagaaggcagctacccacaagatcccactctctgaggacacgaagaagaatggggtgaccgtgtccaagctgataaattatcctgtgagaggcctggtatttg

SEQ ID NO: 64852 - DNA, 410 bp, Zea mays
  Clone ID: LIB3075-022-Q1-K1-A11
atcggctcactactgcagtagttttaccaccaggatttgttcatgactatatctcaaactgtattcgatcatgtgaagacattaaggacaagtatatgcaaaatagactagtgagactagtatggggttttctaccaaaccctattcggaacaagataatagatgtgcaagatctcttcgtggaggtgcaagcattttgcatcgccttctcgcgaataagggaggcagtggggttgttcaggctcctgaaatctctagaatgaagagcgctgcaccatcagttgggcgctggattctcagaacagaaattcccaaggtgtacatccatggctctgccttttgcttccaagctgctgaccctgcataggtctggactctgtagggcgtggattttgctggtatattggtta

SEQ ID NO: 64853 - DNA, 323 bp, Zea mays
  unsure at all n locations
  Clone ID: LIB3075-022-Q1-K1-A2
tcggtcccttgaagactacagttactggtgttgagatgttcaaaaagatactggaccatggagaggctggtgacaacgttggtcttcttcttcgtggtctaaagcgtggtgatgtcgagcgtggccaggtggtgtgcaaacctggtagtctgaagacatacaaaaagtttgaggcagaaatatacgtcctgacaaaggatgaaggtggccggcacactgcctttgtcacaaattacacaccccaattctacttcangactgctgatgtcactggaaaggttgagttgcttggtgagacgaagatggttttgcccgtgacaatg

SEQ ID NO: 64854 - DNA, 216 bp, Zea mays
  Clone ID: LIB3075-022-Q1-K1-A3
gggagctggcaccagcaccagcaccggcaccagcggctcttcccgtgccggatcagtgcaacgccggggacggcgaccgcgggaggaaggccggcgtcgctggtcccggcgtgtgcagcggggcgcggagacgggtggccaagggcgccggtggcccggcgagcaccaagttccgcggcgtgcggaggacgccgtggggcaagttcgcggcggaga

SEQ ID NO: 64855 - DNA, 325 bp, Zea mays
  unsure at all n locations
  Clone ID: LIB3075-022-Q1-K1-A4
cggacgcgtgggaaagacccaagggcacaagcagaagttgcggttgtacttttcttcctccggcgtcggctcagatctctgcgtgcgggctagcgatggcgtcgttctcggaggctcccccagggaacccgaaggcgggcgagaagatcttcaagaccaagtgcgcgcagtgccacacagtcgagaagggcgccggccacaagcaaggtccaaacttgaatggtctttttgggaggcagtcgggtaccaccacaggctactcctattccgcgggaaacataaacaaggctgtgatctgngaggagaacactctgtatgactacct

SEQ ID NO: 64856 - DNA, 345 bp, Zea mays
  Clone ID: LIB3075-022-Q1-K1-A5
gagtagagtgttgaaggcacatctccaatattcctacacaaaaacacaaaaacacaatgcacatcaactaacagaagtgcaataccctctcatatgcagagtttcggaatactgggctggagagatcagaggcgctgaaaaatgatctggaatggttcaggcaacagggccacacaattccaaaaccatcggcccctggcaccacatacgcttctctactggaagatctgtctgaggaggacccccaggcctttatctgccatttctataacatgtactttgctcatactgctggaggccgaatgattggcaaaaaggtttccaagaagattctgaacaacaaag

SEQ ID NO: 64857 - DNA, 346 bp, Zea mays
  Clone ID: LIB3075-022-Q1-K1-A6
ttcgttttcgtctgctccctcgtccaagtatatcaacgtagcaaggtggtttaatcacattgatgcgctcgtgaggctgagcggaattactgcagagggccaaggtgtgaaggttgaatcctcagcagttccttcagccccaactccagatgttgctgaagcacaggccccagctgctgaggaggaggacgatgatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatg

SEQ ID NO: 64858 - DNA, 447 bp, Zea mays
  Clone ID: LIB3075-022-Q1-K1-A7
tgcaattcgaagtttccaagaatatggtgtagagtttacaaatggtaggattgaatcatttgatgttgtgattcttgccacaggttataagagtaatgttccttattggttgaaggagaatgaatttttttcacagcaaagtggatttccaaacaaaccaaatgaatggaaaggaaaggatggactctatgctgctgggttctcaaggcgtggtctacttggtgtgtctatggatgccaccaaaattgcggaggatattgcgcagtcttataataatatatataagctacaaagatcataagaacaaatgatatttaactatttatcaataatttagctatcaccatttgagagttttgtaaatatatgtactagtctatttgcataaattataagagatggatatgctagattacaaatactaggctagcttatctatcaacgcac

SEQ ID NO: 64859 - DNA, 288 bp, Zea mays
  Clone ID: LIB3075-022-Q1-K1-A8
atcggccccgggagcaagatgatccgcatccatggcgtcaagtgcggcccaggccacggcatcagcgtcggcagcctggggcgctacaaggacgagaaggacgtggaagacgtgcaggtgacggggtgcacgatcgccggcaccacgaacggcctgcgcatcaagtcgtacgaggactccaagtcgtcgctcaaggccagcaagttcctgtacgagggcatcaccatggacaatgtctcctaccccatcatcatcgaccagaagtactgccccaacaacatctgcgtc

SEQ ID NO: 64860 - DNA, 446 bp, Zea mays
  Clone ID: LIB3075-022-Q1-K1-A9
aggatcctgatctccgacgcaaggagcaatgggaaaaatctcaggcaaacaagggacttaacttggctaacatgcttgggtttggtgatcttggcagtccaccattatctgctgctgaagaatattcacttcattcacgataccttgctaaagcgaattctatgaatctgtcagatgttgctgaaatgaaaataatttaccgtggaggagttgatagtgaagggcgtccagttatggtcattgttggtgctcactttcttcttcgctgcttggatctggaacgatttgttctatatgtagtaaaggaatttgaatctctgattcagaagccttacacaattgtctatttccactctgtggcatcattacaaccacagcctgatttaggattcatgaaacggttacaacagatactaagtcggaagcataaaaaaaatcttcatact

SEQ ID NO: 64861 - DNA, 143 bp, Zea mays
  Clone ID: LIB3075-022-Q1-K1-B1
cagacctgcatgcattcgccggctcgccatgtaagaaacaggggagttgaaagtgcgacacaccagagaacgtgtctgtgtatactgtgtaaaggtcctaaaggaaagagaagatgcacatattcaaagcctcggagcaaaaa

SEQ ID NO: 64862 - DNA, 438 bp, Zea mays
  Clone ID: LIB3075-021-Q1-K1-H4
gggaaatgcatcattctcacccaattaactcacgatcaagcgcaacgtccacatcttaagaccctcccaagcacacccttgatacttctcggaccacatagcaataccaattatctaccaacatcatcaacctacggcattataccatcatctacaccttatacacgtcactctctgcacatatagcacgcaatcttgatcatattgctatcattgtccaaacaagccaccgtcaacaagaccatctcgctatccatgctcacgatatccctcactatactggatatgtaatcaatactaatactaaccatgaacatcatgaccccgctttacacattcttgacatgaaataccatctcattctccatgacactcactatcctgtcaaagctggtcttgaagcttatcatacatctcacagagaccatcacaatctac

SEQ ID NO: 64863 - DNA, 235 bp, Zea mays
  Clone ID: LIB3075-021-Q1-K1-F9
cacgactccaagttcggctccgccgtcatccgctactccggctccagcggcgccccgccggggcccaacatgaccgatccgccgggcggctgggcctggtccatcaaccaggccaggtcatttcggtggaacctgacagccagcgtcgatcgccccaacccgcatggctgctaccactacaggcacatcaacatcacccgcaccatcgaggtcatggtcatccgaggacacatcg

SEQ ID NO: 64864 - DNA, 410 bp, Zea mays
  unsure at all n locations
  Clone ID: LIB3075-021-Q1-K1-G1
cccacgcgttcgggccctgccttttctcccattcccctcgccgcgtgacacgcgctctcgccctctctcccgagtcccgacgaccgggcaacagccgccgtcgccgctcagcctccgtcgggaccttcgccggtggcgagcaccatcaggtgtacatgcgtacgcccatgcccttggctgcgcccgcccctgcaagtggtttcctgctggtctgtgtggatttggctgccggaagattgattgatgcggccttcaggatcactgtagcctcgctgtgagattccaaggctgctcangtcatgttgggggaccagtgcatcatacaggcgttagactcggttagctcatcaagctctgcccctgattcgaccctctccggagagcttccagcangaactgtgtgattggga

SEQ ID NO: 64865 - DNA, 231 bp, Zea mays
  Clone ID: LIB3075-021-Q1-K1-G10
tggtcacctacgtgacagccatgtgggtcatgccccaccccttgcgcattgtgccgagcgagcggctccaggtgcgacccgccgtgaacgggccgctctactacctcacctgcctcatgaacggtctggggagcgactgtatcatcggctggcacatgctggcggtgctcaagatggacacccacgccatccgcggcttctactatgggcatgttcatcgggggcgcacta

SEQ ID NO: 64866 - DNA, 368 bp, Zea mays
  Clone ID: LIB3075-021-Q1-K1-G11
tctccaccttcatgtcaaccatgtgctccatttttcatcccatttcaatcattcccagcgagcgggtctatctgctaccagcgggtttatttcctctctccttccttttcttcctcaacaacgatctggtgtgcgattttatctattccaacctccctctgatgttgcaagagctttcacacccacgccacccgctcctcttctatgagcgtcttcctccgtgtgccctttccttgttaccctcctggtacatctatctcttccagcggggtattgttcccaatttattttgaatggtccccaatttacatgtggagtgaataagaatgaggaatcattcattggattatgtgtgcttcacaatgtgt

SEQ ID NO: 64867 - DNA, 445 bp, Zea mays
  Clone ID: LIB3075-021-Q1-K1-G2
tgctgttgggcctgtattagatggtgatgcagttgtcactatcaacttccgagctgatggcatggttatgcttgcgaaagcactagagtatgcagattttgacaactttgaccgtgttcgtgtccccaaaatccgatatgctgggatgcttcagtatgatggtgagttgaagcttccaagccgttaccttgtttccccaccagagatagatagaacatctggggagtacttggtgaagaatggcatccgcacctttgcttgcagtgagacagttaaatttggccatgtcacatttttctggaacggtaaccgttcgggatactttgatgcaactaaggaggagtatgtagaagtacctagtgacagtggtattacattcaatgttgcacccaatatgaaggcgcttgaaattgctgagaaagccagggatgctctcctaagtgga

SEQ ID NO: 64868 - DNA, 436 bp, Zea mays
  unsure at all n locations
  Clone ID: LIB3075-021-Q1-K1-G3
cagcaagaagacgacccttggtacttggtaatagatggcagcaccttcgtccatgccggggccgccgccgccggagccaagcggaggcatcgtatcccccgtggcggtggtggcctcgcatttctgcgcgccctacgtggtgcagctggcggtgaaggagaagaaggtgagcctccgggaaggcgacttcaccatcaccgacaccaacggcgccgtcgtggtcacggtcaagggtgccttgatcagcatgcacaaccgccgccgcctactcgacgccgtcggcaaccccctcctctgcctgcgcgagaaggtaatcagcatgcacaacacgtgggaagcgtacagaggggacagcacgagatcgagcgacctgctcttcaccgtcaagaaatcctncatcatgcagccgttcaagaccgagatgctcatctacctg

SEQ ID NO: 64869 - DNA, 426 bp, Zea mays
  Clone ID: LIB3075-021-Q1-K1-G4
tcgcccactcgtgcgcatgctcatgagcgccgaagagaagtctccaggcaaggtgctcgccggggtcaagttgagcgcggcgctggctcaccacatcatggccggcgccgacgtgctctccgtcaccagccgcttctagccctgcggcctcatccagctgcaagggatgctatacggtacgccctgcgcctgctcgttcaccggtggactcgtcgacaccatcatcgaaggcaagaccggcttccacatgggccgcctcagcgtccactgtaacgtcgtggatccggcggacgtcatgaaggtggccaccacattgcatcgcgccatcaaggtggtctgcacgccggcatacgacgagatggtgaggaactgcatgatccatgatctctcctggaagggccctgccaagaactgggagaacgtgct

SEQ ID NO: 64870 - DNA, 452 bp, Zea mays
  unsure at all n locations
  Clone ID: LIB3075-021-Q1-K1-G5
gtgacaccatccttcacatacaagacaagcctgctctgttcagaagcgtcttcaaatggctaaagcccggtggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgagcagttcttgaatgttctacagagggagctaggtgaagttgaaaagaacaaagacgctttcctggcagacttcacccaggaggactatgacgacattgtgaatggctggaacgcgaagctgaaacggagctctgccggcgagcagaggtggnggttgttcattgccaccaagtgatttggcctggcagcangagggctcttcggaataagaatggat

SEQ ID NO: 64871 - DNA, 435 bp, Zea mays
  Clone ID: LIB3075-021-Q1-K1-G6
aggagatgaggtggagcgtccaggagatgcggggcgtgcaggagacgctgcagaacaaggagctggcggtgctgtccatgagcctcttcttcgcgtgcctggcgctcttcaagctggcgtgcgaccgcgtgttctgcctcttcgccggcaagggcagggaggaacccgacgcggaggagcacacaaggagcagtagggcgtggatgctcgtgctcgccagcagcagcttcaccaccctcatcgtcctgctctacaactgaagctttctagagtttcgcttgctagcacggagcaacgttcttttagccatgttcttgtccccgcatagctcattaactcccctctcaagtagatggggtaacgtatgtactcactatttcagaataaagatgaacacaggttccttgttcattgtaaaacaacctggaataatcc

SEQ ID NO: 64872 - DNA, 448 bp, Zea mays
  unsure at all n locations
  Clone ID: LIB3075-021-Q1-K1-G7
aggcatttcataattctggaattgaggttattttggatgtagtttacgaaccatacaaaggaagctgatgatgttaacccgtacatgacttcctttcgtggtattgataacaaggtctattacatgttagatctcaacaacagtgcacagctgctgaacttctcgggttgcgggaatacactaaactgcaaccatcctgttgtcaaggagcttgtacttgacagtttaagacattgggttaaggagtatcacatagatggatttcggtttgaccttgcgagtgttctttgtcgtggaccagatggcagtcctcttgatgcaccttcacttattaaggaaattgccaaagactctgtattgtctagatgtaagatcattgctgaaccttgggactgtggtggcctttatctagtanggaggttccctaattgggacaggtgggctgaat

SEQ ID NO: 64873 - DNA, 298 bp, Zea mays
  Clone ID: LIB3075-021-Q1-K1-G9
ccctcgtcgtcgtctcactcaccccgccttcacgcctccctcaccaaataaggtcccggccttttccgacattcacaggggggacaggaaatcagcggccatggcctcgattccggcgacgaccttcgccgtcatcttatccgtcctcttctgtgccgcggctggcaccgtcgtcgacaacgacctccccgactacgtcatccagggccgcgtctactgcgacacctgccgcgccgggttcgtgaccaatgtcaccgagtacatcgcgggcgccaaagtgaggctggagtgcaagcac

SEQ ID NO: 64874 - DNA, 213 bp, Zea mays
  Clone ID: LIB3075-021-Q1-K1-H1
acttctcctaattccctttctacccactctttcgatgaaacctatcattttctcccaattaactcactttcacgttcattctacatatctcaagacacttccaagtactccctttactcttctcagaaaacaaaacaatcattttatctaccaacatcatctatctctcttttaaaacatatctttaatctttattatctttctcttctaatc

SEQ ID NO: 64875 - DNA, 347 bp, Zea mays
  Clone ID: LIB3075-021-Q1-K1-H10
gcggcgcctcccgatccggtggtgggccaatgtcgccgcgcttggcatctttcttgcgggggccgcatctgctgacgcgggctttctcagcccggtccttattaataatgctggtgcacctattctttactgggaatcaataactttcatcagacccactgttgctctaatatgttttgagacaatcggcttattactaaatgattagtcacctccttctcccttcaagtcatcttgcatggatgactgtagcatatctttatggcttgctgataatcacagcggtgttgaacataagcaagcccgtgccgtattttatacgcactgcattgcactgcacgatacat

SEQ ID NO: 64876 - DNA, 351 bp, Zea mays
  Clone ID: LIB3075-021-Q1-K1-H11
cccacgcgtccgcctgcagtcatctcctccatcaccaccaaactcaacaacagccagctggcgaaaataatgaagagccggagcatggcatcatcggccgcgctcttggtgctagccctcgcgctagtggcggccaccgccccacaggtagcggaggcaaagaagaaaagagcggcggagagcggcgaagcggcggatgcgaataagatccaggacgacttctgctcgacgctgtgcgagggcaagaaggggacggacctggtcgtgtgcaaggggtcctgcgcgctcttccaacagtccaacctggtgctgtacgggaggatccagtgcaagggcaagtgcaccgagcag

SEQ ID NO: 64877 - DNA, 330 bp, Zea mays
  Clone ID: LIB3075-021-Q1-K1-H12
cccacgcgtgcgcctgcagtcatctcctccatcaccaccaaactcaacaacagccagctggcggaaataatgaagagccggggcatggcatcatcggccgcgctcttggtgctagccctcgcgctagtggcggccaccgccccacaggtagcggaggcaaagaagaagagagcggcggagagcggcgaggcggcggacgcgaagaagatccaggacgacttctgctcgacgctgtgcgagggcaagaaggggacggacctggtcgcgtgcaaagagtcctgcgcgctcttccagcagtccaacctggtgctgtacgggaagatccagtgc

SEQ ID NO: 64878 - DNA, 180 bp, Zea mays
  Clone ID: LIB3075-021-Q1-K1-H2
aggaaatgtatcaggggcggtcaattgactcaggttcaggtgcattgtgcatatgtcaagacactcccaatgtacaccctttatttttctcataaaaaaaaacaatgttgttatctaccaacatcagcaagctgtgttgtaaaacatatctttaatcgttattatctttctctttcgatc

SEQ ID NO: 64879 - DNA, 455 bp, Zea mays
  unsure at all n locations
  Clone ID: LIB3075-021-Q1-K1-H3
ggaaaaggcagccttctcaccgtcggacccggcgatgcagcggcacgtcgcctccgggcggccgtcggtcggggacggctgcgacttttcttaccgcatggtcgtcgaatcccggtaccagagggtcgccgagggcagatcccgcctcgcgcgcctcatcctcgtgcaggcgctgcacctagtggccggaggcttgcttctattgctgtcgttgtccaagggggcggcggtgaacaagttcgccgtgctgtccatggccgcgggattcctggctatagtggtgggggaattagggcgaatgcggaccatggcagtgctgcttcggctttacacaagcttgtcatcaattgcggttgcattctctgtgacgtgcattatccggtcagagttgttcttgaaggttatgaagcanaacacagaggccatcacaagctacgaaatgcttgatgcggttc

SEQ ID NO: 64880 - DNA, 413 bp, Zea mays
  Clone ID: LIB3075-021-Q1-K1-F8
atcacgacaagatggctttctcaaacaattcgatgagagccttgttggtcctgttcctggtctgcatggggcatggtgagaaggaagagtcaaagggcatcgatgctaaagcgttctttcctggtgggtccttcgacatcaccaagttggtctcctccgtcaatgtcatgacatacatcacgaatgctgttcaggaggcatggtcatcagcattcgtcgtcactgttaagcagacaatcctcatacccaagggtgacttccttgtctgacaactcaacttcacagtcccttgcaagggctacttgaccatccaggtttatgtcaatctgctggctaccactgacctaatccagtacatggaccatggtaattggatctagattctacttgtggattacctggtcatcaccttc

SEQ ID NO: 64881 - DNA, 243 bp, Zea mays
  Clone ID: LIB3075-026-Q1-K1-C8
cagacacatccgactgcccgggccaaaccaaatcaacggcagcactgacgttgttcacgctgatcctcttcatcttgtaaagggtgctcacaagctcatcctgagcactgctaacgccggtggccgtgtcgctagcggcgatcatcttactccatggctgagaacccacgcctgactaggtggtgcctaacaggaacgtttcctgcctatctcacgagacgagcataaacattcggagacatg

SEQ ID NO: 64882 - DNA, 385 bp, Zea mays
  unsure at all n locations
  Clone ID: LIB3075-026-Q1-K1-C9
cggacgcgtgggcggacgcgtggggaaacaggcacacaagaacaaatacctcgccaccaacaatggcctccaggtcctccatcgctacttgcaacggcgatgctggttgcgctgtttgcggttggtttgtgcaccaccccgctcaccttccaggttggcaagggatccaagcctggccacctgatcctcacccccaatgttgcaaccatatctgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgncgacgacgtcattcccggcgatt

SEQ ID NO: 64883 - DNA, 238 bp, Zea mays
  Clone ID: LIB3075-026-Q1-K1-D1
accacgcgtgcggttaattgtggaggggagtgtcatgtatctatacagcgtactctagaacgggttgcatgtaagcgccatgtgagaccgtgagttctctatcacgcctgatcatggagtaacagcgtttctaaaatgcatgttgacattggccagctgacttggtgtgatctagcacaactatgaagagagtcatgaatggcttgcatgatggcctcaaagatgtccatttaatcct

SEQ ID NO: 64884 - DNA, 123 bp, Zea mays
  Clone ID: LIB3075-026-Q1-K1-D10
gtgaagaacgcgtccaaactggctaccgttttcacgtagaagaacaaggactccatgggcgcgggcattaactggctagacggcgaccagatacgcacggccgtcaacatctattacacgatg

SEQ ID NO: 64885 - DNA, 371 bp, Zea mays
  Clone ID: LIB3075-026-Q1-K1-D11
gagaagatcgcgtccaagctggctgccgacgacaagaagaagatcgaggacgccatcggcgcggccatcagctggctggacgccaaccagctcgccgaggcggacgagttcgatgacaagatgaaggagctggagagcctttgcaaccccatcatcgccaagatgtaccagggcgcgggtgccgacatgggtggcgccggcggcatggacgaggacgcttcggctggaagcggtggccctggccccaagatcgaggaggtggactaagcggattgtgtcagtctcgtgtgtctgctgcagtggctggctggcccagtcgctgctcgatttattgtcatcatcgcggtgtatccgcgttagaaccttttttt

SEQ ID NO: 64886 - DNA, 341 bp, Zea mays
  Clone ID: LIB3075-026-Q1-K1-D12
cccacgcgtgcggctctggcaagtatgagaagaaggtgtatgtgctccccaagcacctggatgagaaggttgctgctctgcacttgggcaagcttggtgccaagctgaccaagctcaccaagtctcaggccgactacatcagcgtgccgatcgagggtccctacaagcctgcccactaccggtactaggcacacggcttgcagcttactcgggccgttgtgtgctatgaagttcgctacactggcctgtcaggtatctgttgcatgcatatgcattatcatatacgcagtcgcgtagcaggttttcttatggttatcgcttgagctgatgagggagggaag

SEQ ID NO: 64887 - DNA, 347 bp, Zea mays
  Clone ID: LIB3075-026-Q1-K1-D2
ggaagcaccgagagcgctccagagatgtcgtcggatgagttgcgattggagctggacgagctgcgtcggctggagggcctcgccaagcgcccccgcgtccagaccctcctcgccaacgagatccgcaacattgaagctaagatggcgaaggcaactgaaccgtcaccggagccactagtggcggcttccgcgcccgcggcggcggcggcgcgttctgatttgagctacgccacgttgggctcgttcagctgggaacaggacaacgagaagatcaggatatatattccccttgagggagtcgaacaagggaaggtggaggctactttcaagccaacatcagtagatgt

SEQ ID NO: 64888 - DNA, 344 bp, Zea mays
  Clone ID: LIB3075-026-Q1-K1-D3
cctcctcctcctcctgctcccggggcgggcggcctccttttccacctcctgctggtgccagggccgggagggcgtcgcggaggtggcgcgcatggggctcgccggggacgggtcggcggacaccgcccacctcagtaataatgaaaatgggcggttcatttatggagttgcgagttctcctggtaaaagagcatcgatggaggacttctatgaggcaagaatagacgacgttgatggagagaaaattggaatgttcggtgtatatgatggtcatggaggagtccgagcagctgagtatgttaagcagcaccttttcagcaatttaatcaaacacccaaagttca

SEQ ID NO: 64889 - DNA, 445 bp, Zea mays
  Clone ID: LIB3075-026-Q1-K1-D5
ccaggttggcaagggatccaagcctggccatctgatcctcacccccaatgttgcaaccatatctgacgtggagatcaaagagcacgggggcgatgacttctcctttacgctcaaggagggcccgaccggcacctggacgctcgacaccaaggccccgctcaagtaccccctttgcatccgctttgctgtcaagtccggtggctaccgcatcgccgacgacgtcatccccgccgatttcaaggccggcaccacctataagaccacactcagcatctaatcagcctctgatgatgaattatatttcaaaagagctcacctggcgctcacgttagcaagacaatatttcttctatggttattttggggcgccaaaccacccaagaaatatgtgatgctacatgtcccttatgatgccttgttgtgttgggttgatattattacataaa

SEQ ID NO: 64890 - DNA, 442 bp, Zea mays
  unsure at all n locations
  Clone ID: LIB3075-026-Q1-K1-D6
tgacaatccccaagggaaccttgttccccatgtgtggcatgaaccttgccttcgacagggatgctcattggccctgctatgtactttggtctcatgggtgatggccagcccatcggtcgctacgacgacatgtgggcaggatggtgtgtgaaggtcatctgcgaccacctgagcctgggagtcaagactggcctgccatacatctggcacagcaaggctagcaaccccttcgttaacttgaagaaggaatacaagggcatcttctggcaggaggacatcatccncttcttccagaacgtgaccatccccaaggactgcgacaccgtccaaaagtgctacatctacctctctggacaagtgaaggagaagctgggcacgattgacccctacttngtcaaagctcgtgacgccatggtcaccctggatcgaggcctgggatgag

SEQ ID NO: 64891 - DNA, 328 bp, Zea mays
  Clone ID: LIB3075-026-Q1-K1-D7
gcacccggtatccctgctccttttccttggcggacgaacggggctccctccggcgactggggtgctccctctagccatcgactacctcacagatccctgtaagccggaccccattacccttctcggatagctgtgcccctaccgacaggacttcacgggagcaagcctggggttgatcggaggactcggcatggatcggtgcacgaaaccacgcccaggacttctcacagatcacactggaccgagcgctgagcgcctggaacttccctgttcatgcgcgagttaggtggaccggagctctccgtcgtgcgttgaacatcgctgtgct

SEQ ID NO: 64892 - DNA, 172 bp, Zea mays
  Clone ID: LIB3075-026-Q1-K1-D8
cagacacgttggcatacgccttaccaatcgttcatacacgtactcataatttatcacgggggaaaatctagatgccttggatgaagctaactaagatttgcatgacaaccctttcactgatcaagaacctgtactatggaagaacacataagatttcttaaagaaatattcc

SEQ ID NO: 64893 - DNA, 57 bp, Zea mays
  Clone ID: LIB3075-026-Q1-K1-D9
cagacacgtgcgcctactcgtgggcaaactctcacacatgaacaaataccttatcac

SEQ ID NO: 64894 - DNA, 299 bp, Zea mays
  Clone ID: LIB3075-026-Q1-K1-E1
cacaagatacatgacagtcgtgtagctagctcatgtatgctcaacggtcataatctagaacatgtattaagagcgcgacgagtgcctcaagaattactataccggccaagatcattcatcaacagcatgtcactttgcattgtggccacttcaatctggatcaagtgtggtcagatcttttagtgatttaacgcttatattacttacaacaaaagataaacccaccaatgcggacctcgatgtaccgcccagttcagcagaagcgcacaccgagatgttccatctgagccctgctggcc

SEQ ID NO: 64895 - DNA, 347 bp, Zea mays
  Clone ID: LIB3075-026-Q1-K1-E10
cttaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcattcaaggcgagcccggcgctgtcattcgcgggaagaagggatct

SEQ ID NO: 64896 - DNA, 347 bp, Zea mays
  Clone ID: LIB3075-026-Q1-K1-E11
cttaattgcgccactgctcgttatccttcttttgcattgcattgcaggtcgtacttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcattcaaggcgagcccggcgctgtcattcgcgggaagaaaggatct

SEQ ID NO: 64897 - DNA, 352 bp, Zea mays
  Clone ID: LIB3075-026-Q1-K1-E12
aataaatgcaccactgatacgaaaaactttttttgcattgcatagcaaagaaaaaaatgagcagcagcaacacactgcacagggtgtcgtggcaaaacgtacgtcgatgagcaccttatgtgcgagatcgagggccaccacctgagctctgccgtcatagtcggccacgacagcgccttttgggcccagagcaccgtattcccacagttcaagccagacgagattaccaacattattaaagactttgaccagccttggtttttggccctcatcggactattccattggcccaccaagtacatggttatccaaagcgagccctgctcttttatccatgggaagaagggattct

SEQ ID NO: 64898 - DNA, 295 bp, Zea mays
  Clone ID: LIB3075-026-Q1-K1-E2
cggacgcgtgggcggacgcgtgggggcgtccgagggcgacaacaagaggatgatcacgctcaggggctccgacttagaggaggtggaggtggacgaagctgcggccatggactcgcatactctccgccacatgatcgacgacgactgcgcctacaacggcgtcccgatccacaacgtcaactccaggatcctctctaaggtcatcgagtactgcaacagtcacgtgcacaccgtcgtcatacccgatgactactctgtcttcgagggcggcgaggacctcaagagctgggacgcg

SEQ ID NO: 64899 - DNA, 398 bp, Zea mays
  Clone ID: LIB3075-026-Q1-K1-E3
cggacgcgtgggcgatcacgacaagatggcgtgcacaaacaatgcgatgagagccttgttgcggctggtcctcttctgcatcgtgcatggtgagaaggaagagtcaaagggcatcgatgcgaaagcgtccaggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaggggcgacgtgaccatccacgtaggatggcaatctgctggcgaccacggacctaagccagtacaaggcccatggtaaattgaatcgagat

SEQ ID NO: 64900 - DNA, 389 bp, Zea mays
  Clone ID: LIB3075-026-Q1-K1-E4
atctggtttaatcttacggcctcctacgggagggctgagtaccgggactatcttgcgagtgcgtcgcagttcacaacaaattggtaccggagccactacgcgcgcatcgccaccatggccggcgcgcacgacgatcttgtgacctactccgccaagatggacctcatcctcgagcaacttgccgacatcaatgcccgtttggattcccatgacgctcgtctggccaagctagaccaggcgtgggtcagcccctttgcttctaccgcgggctgcctgggcgcgagcgagggcggcctgggcgcgggcagaggcggccgaatcgaggacgatgggggcaatgggctgcaacccaacacacccaaggaggtggaggcggcgttctacgttga

SEQ ID NO: 64901 - DNA, 253 bp, Zea mays
  Clone ID: LIB3075-026-Q1-K1-A5
cgcacgcgtgcgcgtactcgatgtgcacgttggagttcttgcctcgtacgaggttgccgctgggaggccacttcaatcatactaggtgtcgttgctgttcacgagggacgtaatcgccactagatccggaagaaagcaaccatgcgcaggacgacccttaacatctgccttgtatccctggagatgagaaagacattatgttcaactcttcaagtctggtctaccggctttgatccacagtgcaaggtacgga

SEQ ID NO: 64902 - DNA, 267 bp, Zea mays
  Clone ID: LIB3075-026-Q1-K1-A6
ggtggtccaccatggcgcagcgagcggtggccacgatgacgactaataagccccttctcctgggcgccctggcgtccgcgctccgtggtgcggcgcctgccgccgcgaacgcgcccggcggggcgttcagcaactgggtggcgatgaaccagcagagctacgcgctgtacgcgcagaagtccgtcggggacgggggcaaggagcccctggacaagaagctgtcggaggcggagaagaagaaggtcacgtacgtggtggaccccagcg

SEQ ID NO: 64903 - DNA, 265 bp, Zea mays
  unsure at all n locations
  Clone ID: LIB3075-026-Q1-K1-A7
ctgcaaatgagatgttctgcacctatgtttgtaatgttgtatttctgggtttttaagcgagccaacttggagatacaaccggggaggaaacancaacaataggtagttctacttctgagtgaggaaaaacaacttgcggctgagttaatgaagcttagtagctaccaccgttgtatgacagttgctcagagatgttatcttcattaagtgcttatattaccgctagttccctgtgaaatttgttaaaccattatatgtaagtttt

SEQ ID NO: 64904 - DNA, 331 bp, Zea mays
  Clone ID: LIB3075-026-Q1-K1-A9
gcactatctataggaagtgccctgtgtttttttttctcattccttgctagtgtcactaagggggctactaacatcacaaagggtcttcaatcacattctccacttcattcttcatgccccaatatccttcttttattccacacctactggtataattttaaacaagtcctctaattaccaaacttttctacattttgaaatatcaaacatactaagctcttctttttcttcaatcattactatttcttggcaccactcttcttatttcatattttatcattcccaacttttctacctttattcaccaacatcaaactttcttttttctatt

SEQ ID NO: 64905 - DNA, 240 bp, Zea mays
  Clone ID: LIB3075-026-Q1-K1-B1
agcaaacctgcagtcatttgctgcagcaccaccaccaagctcaacaacagccagctcgcgaaaatagattaatagccggaccatggcgtcatcaggcgcgctcttcgaactagcccgtccgctagtggcggccaccgccccacaggtagcggaggcaaagaagaagagagcggcggatagcggcgaggctgcagaagcgaaaaagatccaggaccacttctgctcgactctgtgccaggg

SEQ ID NO: 64906 - DNA, 310 bp, Zea mays
  Clone ID: LIB3075-026-Q1-K1-B10
cagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggtgctgtacggcaggat

SEQ ID NO: 64907 - DNA, 75 bp, Zea mays
  Clone ID: LIB3075-026-Q1-K1-B12
aaaaaacatatgacatcgcattcgtctaattttaaataaaaaaaaaaaaaacaataaaagggggggggcttcctg

SEQ ID NO: 64908 - DNA, 153 bp, Zea mays
  Clone ID: LIB3075-026-Q1-K1-B2
aagattactgaaccaaacttacaaggagatagctattctatactttaacctaaagtcaattagggggcacgacttttacaacaaggtgcctgagaaaactctagctaaactcaactaaattcgcttgcaccacatccaaccttctccaggtgt

SEQ ID NO: 64909 - DNA, 318 bp, Zea mays
  Clone ID: LIB3075-026-Q1-K1-B4
gcgaggcggcggaggcgaagaagatccaggacgacttctgctcgacgctgtgcgagggcaagaaggggacggacctggtcacgtgcaaggagtcctgcgcgctctcccagcagtccaacctggtgctgtacggcaggatccagtgcaagggcaagtgcaccgagcagaagggcatcacggcgccggacatgaaagtctgccaggaggagtgcgacaaggcgtacgtggtgaaggccgccgatgtcaccaaggcctgcagcgtcacctgcgcctaggagaagaacccgcgccttagcgagaactgcaagaggtcctgca

SEQ ID NO: 64910 - DNA, 364 bp, Zea mays
  Clone ID: LIB3075-026-Q1-K1-B5
ggccacaggaccaccggcgggctggccggcaagttctacgtggtgattgaccccagcgacgacgccgccgacctcgtcacccccaggaagggcacgctccggcacgccgtgacccgggcccgggcgctgtggatcaccttcgcgcgcgacatggtgatcgagctctgccaggagctcatcgtgagcagcgacaagaccatcgacgggcgcggagcgcaggtgcacatcgtgggcgcgcagatcacgctgcagaacgtgcgcaacgtgatccttcacaacctgcacgttcacgacgcctgagcgcacggcggcggcgcgatccgggactcgcagcacccactgggccttgcgcggggagagcgac

SEQ ID NO: 64911 - DNA, 275 bp, Zea mays
  Clone ID: LIB3075-026-Q1-K1-B6
ccgcatcacctctccctccggcgcgcgcgttcgggtacagcgctagagtcactcaccaccatgcaggcggcggcggctgcaaatggcgcaggctactttcacaagcctcagcagcagccgctggtggcgggggcgccgccctcaccgtcggcggcggccgtggtgtcgccccattgggtcggcatgccgttcgcgccgcctcctggggccacggacatggtgatgcagccgcacacatatggcgccttcgccgacataattcgcgccgactcact

SEQ ID NO: 64912 - DNA, 288 bp, Zea mays
  Clone ID: LIB3075-026-Q1-K1-B7
caaaaatgctgcatgcgagaggcttcttgaacagagggtggatgtaaagatgaagtcaaaaaagatgatggattgcttgaatagatttcatgttgctctgccaaagcctcgtgacaacaaggagaggcctgtttgcatccctctggctgttctggaagctagggctaatgctgctgcaaaggaaaagaagcttgagaaggacattgagaatgagaatggaggtgctggggtctattctgcaagtctcaagaaacattatattttggccaatgatgaatggaaggagga

SEQ ID NO: 64913 - DNA, 220 bp, Zea mays
  Clone ID: LIB3075-026-Q1-K1-B8
catctattgtagcgtacttgttatacagtactcttccatctctccttttttccttgttgatgccaaaatcaagtttacaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaataaggggggatgttttaaaggatcaaagttt

SEQ ID NO: 64914 - DNA, 384 bp, Zea mays
  Clone ID: LIB3075-026-Q1-K1-B9
gaataacacacgtgagcacgaccatcaggatcctatagctaataacatcatggacatgggcgcggcccttgcatggctcgttgggggcagctcttgctgctcccccaaggtctcaccccggccaaacatcaccaccaactacaacgccaagagactcacccctagggccacctggtacggtcagcccaacaagaccatccactactgacaactgctggaacctgcgcgatcaataacatgaacctgccaccctacagcgccatgacggcgtgccgcatcttccacatcttcaacgacggcaaggcctgcggatcatgctacaaggcgagatgcaaggaaaaacctgcatgatcgggcaatctcatcacggtttacatcactgac

SEQ ID NO: 64915 - DNA, 319 bp, Zea mays
  Clone ID: LIB3075-026-Q1-K1-C1
cccacgcgttcggctcattggggaagggagggtcatggagctatacagtgtactcggggccttgttccatgtaagcgccatccgagaccgagagttctctagcaagcctgatgtggggcaacagtgtttctcagaggcatcttcacgtcggccagctgacttgttgtcatctttcacaacaatcaagagtgttatgaatggcttgtatgatggccttaaagatgtccttttaatccttctaaaaaatttggatactcgagaaaaggttcttgagtatatagcagaagtgataaataaaaatgcatccagatctggcatg

SEQ ID NO: 64916 - DNA, 332 bp, Zea mays
  Clone ID: LIB3075-026-Q1-K1-C10
gcagcacagtcaattcaattgggtatcaatgatattgttgtggctggtggcatggaaagcatgtgcaatgccccaaagtacattgctgaagctaggaaggggtctcgttttggtcatgacacacttgttgatgccatgcttaaggatgggctttgggatgtatacaatgattgtgccatgggaatgtgtgccgagctttgtgctgacaatcatgccctcacaagagaagaccaggatgcatttgctatccaaagcaacgagcgtggaattgctgctcgtgacagtcgtgcttttgcatgggagattattccgggtcaagttcctgttggtag

SEQ ID NO: 64917 - DNA, 72 bp, Zea mays
  Clone ID: LIB3075-026-Q1-K1-C12
gtaaaacatttttcatccgacatccacaatttgagaggggaaaacacgttacatttaccgggggggggttgt

SEQ ID NO: 64918 - DNA, 384 bp, Zea mays
  Clone ID: LIB3075-026-Q1-K1-C2
cggacgcgtgggctctcaaccgagccatatccaaagttctcaacatcgcttcgtgcagcctgcatcggtcgacgagggctgcacgaacgatggggtccgcctccgcctcagtgacgacaaccagcctgctggcgctggcgctggcagcgctggctttcgtctccagggccgcggcgcagggcaacggctgttccagcgtgatgatgaccctggccccgtgcatggacttcatctccagcaaggcgtcggagccggggatctcctgctgctcggtgctggccggagtcgtgcagaccgacccccgctgcctctgcatggtactggacggcactgccacgtccttcggcatcggcatcaaccaaaccaaggggcttgaacttcccg

SEQ ID NO: 64919 - DNA, 268 bp, Zea mays
  Clone ID: LIB3075-026-Q1-K1-A4
cggacgcgtgcgcgaccacgatgaggatgactaagatcatgatgacaacttcccaaacaacggggggcaagctctaaaaaacaagggctctcaaaagaaagatttgaaacatcacgtcattcaacacctcaagagataccaccatgaagtggaaagggcatgtcaacaacgtgtcctgtatggtaaagaaatcgtcgtaaggggcaacgaatcctgccaaatctaccaaatgcaaacttcagctctgaagcattgtttaatcacttca

SEQ ID NO: 64920 - DNA, 362 bp, Zea mays
  Clone ID: LIB3075-026-Q1-K1-C3
agaatccaccaaggacgatggccatcgcttgacgatggaatgctccactcccgtctcctccaggagcccttccactcgcaagaagcgcggggcgttcagcctcttcagggcgatgttcctgtccttcggccggagcgacgacagcatgaataagacagacgacgacaccacgagccccaagaagagagccatcgcggctgctgatgacgattgcaagcctgccggtgacgagtcaacgtcgcggaagcgcctcgtggacggtatgcgcccgctccgccttcgcgggcagcttgagtactacccggccgcaaccgcgccaccgttcgttggccacgccgatgtgtaccatgacgtgatccttc

SEQ ID NO: 64921 - DNA, 324 bp, Zea mays
  Clone ID: LIB3075-026-Q1-K1-C4
tcgcgctgtggtacgatcagcgtgggggcgcctgcatcttgcatgctcgatggcaggtctatcctccacttcgcgcgtctcctgcgccctccttgtggcatcggtgctgtcgcttccgccggcggtgtttaaggtcggcgacgagcggggatggacggtgccggccaatggcaccgagacgtacaaccactgggcaaagaggaaccgcttccaagtcggcgacgtcctgaatttcaagtatgccaacgacgactcggtgctgctggtggcccacgatgactacaagcagtgcggcacgggcatcccgctgagctcgtttacggg

SEQ ID NO: 64922 - DNA, 259 bp, Zea mays
  Clone ID: LIB3075-026-Q1-K1-C5
catacatgggcatcattcggactttaagagagaaggtgtccaaattaaaggctgcaaggatgcgcatttatgtccggagaggtggggcgaactacacaactggactcgccaaaacgcgcaccctatgcgccgaacttgtcctttcactagagggctattgaccatcaggccaccatgtctgggaactagaaagaagccattgattgcatgatgggcgcgtgaatcacaaatgtggtcgctgcatttgaagccacattcg

SEQ ID NO: 64923 - DNA, 302 bp, Zea mays
  Clone ID: LIB3075-026-Q1-K1-C6
tggacctccgggcacaggaaagacattgttggcacgtgcggttgctcatcacactgactgcaccttcatcagggtgtctggttctgagttggttcaaaagtatattggtgagggctcccggatggttagggaactctttgttatggccagggaacatgcaccatccattatatttatggatgaaattgactctatcggatctgctagaatggagtctggaactggcaacggtgacagtgaagttcagcgtactatgcttgaacttctaaaccagcttgatggttttgaagcatcaaacaaaa

SEQ ID NO: 64924 - DNA, 419 bp, Zea mays
  Clone ID: LIB3075-025-Q1-K1-G9
cttaaacagattagcgatgatggtagaaaagattagaccctactagccaggtattaagtgaacctcgcacattagaccaactgaaccatgagcaaaaagatctaactcaactagtatagtcatgatgaattacataatcggactatccaaacttttgaccaacatcatgtagtctatcttatctatgtctatcctaaccatattcctcaaccctgatgatatacactaacatcgaatcaatgaggtcaagaccggagaggaaaagatcaacattaacaaggaaggatgtaacagtcaaagcgaatctcgagatgaatcaagacttagatttttcagatgaagtttttgctatctttcgtgtggggaccttcggcctccgaaagttcttaaaaacaggatttaacagtatttctggagta

SEQ ID NO: 64925 - DNA, 349 bp, Zea mays
  Clone ID: LIB3075-025-Q1-K1-H1
ggccgagctcaggaaggcgcaacgcgtcaaggagttcaagcctaccgtgagcttccccctcgtcaagtcgttgctggagaaagagcaagaagcagacgacaagggaaagaagaagaaggggaagggcggccacgagaggaagaagccgtgcccggcgtacgtgctctggctcaaggaccagtggaccgaggtcaagaaggagaaccctgaggcagacttcaaggaggtgtccaacacgctgggcgccaagtggaaggctctgggcgccgaggagaagcagccctatgaggagcggtaccgccaggagaaggaggcctacctgcaggtggttggccaggagaagcgcgag

SEQ ID NO: 64926 - DNA, 441 bp, Zea mays
  Clone ID: LIB3075-025-Q1-K1-H11
ctgttgtagtcatttcgtcattttgtgttctggtgtctgcggaagggcgtcctggatggagtccgccgacggggcggtgtggagtgctcatcggtgcgaatgttgctgtcttcctgctgtggcgtgtggccgatccagggttcatgaggaagcatttcatgatttcactggacaatttcaagagtggacggttgcacaccttgctcacgagtgctttcagccatgcagagtttaatcacctctttgccaatatgtttggcctcttcttctttgggagcagtattacgaatgtgtttggtcctgcctttctattgaagttgtatgttggtggagcacttactggatcagtattcttcttgctggagaaggcttttctagcctatcggaacaggattatgtaggatgggatacttcaagagctgctgaacttggtgcaagtgc

SEQ ID NO: 64927 - DNA, 252 bp, Zea mays
  Clone ID: LIB3075-025-Q1-K1-H12
cgccaatacatttgccggcgacgacaccagctgtgttgaggtcgtctgctcgccaaacaaccctgacggtggcatccgacatgccgtcgtcaagtccaaatccagcaaggcgatctatgacttcgcctactactggccgcagtacacgcccatcaccgaggcggctgcccatgatgtcatgctgttcaccttctccaaatcctccggccatgccggtactaggctggggtgggcactggtgaaggacactga

SEQ ID NO: 64928 - DNA, 402 bp, Zea mays
  Clone ID: LIB3075-025-Q1-K1-H2
aggaggggacacacacacgtacaaaccgagagcacacaccgttccccgcccgcccgccgccgcgacacgcgcgccatggccatgctggctcgctccgccgcgcacctcttcttcttccttctcctcgtctccaccgcgcccgccgtgcggaccatccccgacgaagcccgcggccccggaaacaacatccacgaggcgtgcagcaagacgctgttccccaaggtgtgcctgcacgcgctcaaggacaaccccgagtgccaggcgggggcggtcacgccgcgccggctggccgagctgctcgtgtacgtgtcggccgaggtgggcatgaccggggccgcgttcgcgcaccacgagctcaactccatcaaggacgacgtcctgtacaagtgcctcgacacctgc

SEQ ID NO: 64929 - DNA, 444 bp, Zea mays
  Clone ID: LIB3075-025-Q1-K1-H3
gccacttcagtgcttgcgatcgcgtcggccacgatctcttgcgaaaaagcttaccctgtgtctgtctgtccgaccgtcagtccgtctaacaatcgatttccatgacgacgtccccgcgcgtgtggctgctcgccatggcactggcgctcgcctgcgtgctgctcgtgaggtccgccgacgctgctgccgaggcgtccccgactccaggcggctccacctacgggtgcaacccggccacggacaagtcgtgcaagcccgagggcgtgggggtggtgctgccgggcggcggcatcgacctcgacggcgacggtgacgaggacgagctgccgcagtttcagccccacctcatgatcctcggccatggccactgatgagtgtaaatggttggttggttggtcgtcctcagccgatctactggacgacacgatggcggtcacatttgcg

SEQ ID NO: 64930 - DNA, 433 bp, Zea mays
  Clone ID: LIB3075-025-Q1-K1-H4
ctttcccaactgaactatttggagaggaaggtgatcgccttaggaaagctggaatggaatttggcacaacaacaggtcgcccaaggcgttgcggctggcttgacattgttgcgcttaagcacagctgccaaatcaatgggttctcatcacttaatctgaccaaactggatgttctgtccgggttgtcagaaattaaggtgggtgtttcttatacccagactgatggacagaagctgcaatccttccctggggatcttgatacccttgagcaagtacaggtcaactatgaggttctgcctgggtggcaaagtgacatttcttctgttcgaagatacgatgaacttccccaagctgcccgcctctatgtggagaggatagaagaacttgtggtgttcccgtgcactacattggtgttggacctggcagagatgct

SEQ ID NO: 64931 - DNA, 440 bp, Zea mays
  Clone ID: LIB3075-025-Q1-K1-H5
ttggtgatggacttcgtgaacaacggggaggtgtccggggtcacgctgctcaactccaagttgttccacatgaacatgtaccggggcaaggacatgctgatcaaggacgtgaccgtgacggcgcccggggacagccccaacacggatggcatccacatgggcgactcatccgggatcacgatcaccaacaccgtcattggcgtcggtgacgactgcatctccatcggccccgggacctccaaggtgaacatcaccggcgtgacctgcggccctggccacggcatcagcatcggcagcctagggcggtacaaggacgagaaggacgtcacggacatcaacgtcaaggattgcactcttaagaagacgatgttcggcgtccgcatcaaggcgtacgaggacgccgcctccgtgctcaccgtctccaagatccactacgagaa

SEQ ID NO: 64932 - DNA, 458 bp, Zea mays
  unsure at all n locations
  Clone ID: LIB3075-025-Q1-K1-H6
gtgccgtaccgaatcgccgggtcgacccaggcgacccgtagaagtggaattgttgctcttgatagagcagaagcagtaattgagataactgaatgggttgaagtgccaaagaagatattgactctagagagtaacatcaccaatctgaattcttcttctgaagtaggagcagctaatagcacaacagatagtaaggaaaatctgagttctggcagtaatactaattcgagcactcccattgatgagagtaatgctcaagaaattattacagagaaggtgctaaagaaaagaacttttagggttccgttgaaggttgtggaaaaaacaactggtgctggaacaattctttcgaaggagttgtattctgaagcanaaaataggttagaggcactcgataagaaggatgcagaacggaggaaaactgctgaacttaagaataacctagagtcatacatata

SEQ ID NO: 64933 - DNA, 453 bp, Zea mays
  Clone ID: LIB3075-025-Q1-K1-H7
cggacgcgtgggctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacct

SEQ ID NO: 64934 - DNA, 244 bp, Zea mays
  Clone ID: LIB3075-025-Q1-K1-H8
ctcaaacactatatctttcatgcttgtaaatatcaatccatccttttcattcatcgagtgggcctcccacactatccgcagggagtcaattacttaaactatccaacatttcctttcttgccttaattatatctcataacgagcactatcctaactttttacttacattcccattcttaccactatttcctctactcctaaccacattccataaacctgcttatattcagtaacttcctaaaaa

SEQ ID NO: 64935 - DNA, 221 bp, Zea mays
  Clone ID: LIB3075-025-Q1-K1-H9
ctcaaacatatattcgttcatccttgacaattctaatccatccttcgtatatatctagtgggccaaccacactaaccccagggagcaattaccaaaactatctcacttatactcttttgccataatacttcacataacgatcacttccaaacttttcaccaacatcctctttcctatcttatttatctctaccctaaccattttcctgaaacctgcttata

SEQ ID NO: 64936 - DNA, 199 bp, Zea mays
  Clone ID: LIB3075-026-Q1-K1-A1
ggaaaaaccgaacgaaactgacatggagggtggtggtcttgactatcacgggtggcctctaagggggcaccatggcccagaagctggacatcgccggcatgaagtttacctcgcgcactttcgccttcgcgacaaccaaactggtgccggcgtgtaccttcgttatcgtcctcatcttccactacgagaagtacggcat

SEQ ID NO: 64937 - DNA, 310 bp, Zea mays
  Clone ID: LIB3075-026-Q1-K1-A10
ttctcatacatcacagacaatgaataccaagaagaatgttgttctttgctgccttcttttcgtgctcgttctgcatgcagatcacgctctagccaagtgtggctatacaactcctttaattccattctgcaaagcgtggatgtgcaaggcggagtgttggacggaggctaagttaactggaggcaaagtcacgcaacagaagtgcatgagaggtgggatcaagggctggtgttactgcgaattctgcatttaattttgcaaaggagaaggatcaccatttctttgcttggtcttgccttggtcaataact

SEQ ID NO: 64938 - DNA, 75 bp, Zea mays
  Clone ID: LIB3075-026-Q1-K1-A11
agcaaacatatgacatcggattcggcctatttttattacatgacaaattgaccccactaggggggcgtccgcctt

SEQ ID NO: 64939 - DNA, 142 bp, Zea mays
  Clone ID: LIB3075-026-Q1-K1-A12
ttcaaacatatctcatacaatccataaaatttataataaaaaacatttctaactattaagagtactttctacatattcaagggaccaaatttacatacacttctcttccactcctattatctacaatcttcatatcaaaatt

SEQ ID NO: 64940 - DNA, 382 bp, Zea mays
  Clone ID: LIB3075-026-Q1-K1-A2
gcgatgcacatagcgatgctgacgtacctatgtggtgtacgtggctttcgcgtgtggcctatcggggggcacgatggcgcagaaccgtggcatcaccagcatcaagttcacctcggccactttcgcctgcgcgacaaccaacctgctcccggcgtgtaccttcgtcatcgccctcgtctttcgctacgagaagttcgccatgcgcagcctgtccagccaggccaaggtcgccgggaccctgcttggcgtcggcggggccatgctgctcaccttctacaagggcgtcgacatcacgccctggcacagcaacctcaacctcgtcggcacgctgaaccaagaacaccatcacaccatcatcaacaacaacaactacgccatgggg

SEQ ID NO: 64941 - DNA, 381 bp, Zea mays
  Clone ID: LIB3075-026-Q1-K1-A3
ggaaaaaccgaacgaaactgacatggagggtggtgttcttgtctttcgcgtgtggcctctcagggggcacgatggcgcagaaccggtacatctccagcatgaagttcacctcggccactttcgcctccgcgacaaccaacctcctcccggcgtgtaccttcgtcatcgccctcgtctttcgctacgagaagttcgccatgcgcagcctgtccagccaggccaaggtcgccgggaccctgctgggcgtcggcggggccatgctgctcaccttctacaaaggcgtcgacatcacgccctggcacaacaacctcaatcttcgttggcacgcttacccaacaccaccatcacaccaccaccaccaccaccaactacgccatgggg

SEQ ID NO: 64942 - DNA, 452 bp, Zea mays
  Clone ID: LIB3075-025-Q1-K1-G7
gtcgtcttcagatgcataaaggtgtttcacatccccttgatgttgtagcagctgagaggtcagatgaggccatcatatggtgtcttgatgagtttatggtaactgatgttgctgatgctatgattctgaaccggctgttcagacaattgttcagcaaaggcattattcttgtttcaacttctaaccgtgctccagataagctttatgaaggtggcttacaacgggaccttttcttgccatttattgacaccttgaaagaaaggtgcatcgtgcaccctattgcatctgtggtggactatcgtcaactgggttctgctgaacaaggattctattttgtcggaaagcattacagtacgcttctgaaacagaagcttcagtctttaattggagaagaggaacccagcccacaaactgttgaagtatattatgggtaggaaattacatgttttttt

SEQ ID NO: 64943 - DNA, 308 bp, Zea mays
  Clone ID: LIB3075-025-Q1-K1-F10
cccagacctgcgaccgcgcctgctcgtaaactccagcgcgaccctcggagccgtcgggtgggccacccacgctggcggcgtggataaatgccgtaagcttggccagtattactctcaacgcctgtggatgctcaggacgatggtgtcgcagctgctgatgcacgtgcgcattgagatcacctctgccaaggtcaaagacgttcgcctgaaggctgatcatatggtgcaggtagggatggaggatactcatcatgcaacaagacaagctgttcccttcgatcgatgggatgatgaccttcataaactat

SEQ ID NO: 64944 - DNA, 279 bp, Zea mays
  Clone ID: LIB3075-025-Q1-K1-F11
acacatcgtctatcagcgctcattcaacaatccgagcgcgaccaaggcaataatggtgtcgtgctcccgtgctgtcgtcgtggacgtctgccttatggtcgccgagtcctccctcgccgtcgctgccttcgatggcagggggccgacgtacgggtacacggacgtgagccccgacggaccggataactggggcaagctgagccccgcgtacaagctgtgcgggcaggggaagcaacagtacatgatcgacatcgtcaccaagcaggccgtcctcaacgc

SEQ ID NO: 64945 - DNA, 300 bp, Zea mays
  Clone ID: LIB3075-025-Q1-K1-F12
aattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggacacgacggcgccgtttgggcccagagcaccgcattcccacagttcaagccagaggagatgaccaacatcattaaggacttcgacgagcctgggtttctggccccgatcggcctctttcttggccccaccaagtacatggtca

SEQ ID NO: 64946 - DNA, 448 bp, Zea mays
  Clone ID: LIB3075-025-Q1-K1-F2
cttaagggaactcgagctatttcttgagtgcctctccgtaaggacctgttcgttggatgaccgctcgggaaaacagtgcaaccatgagggtggagtgggacgcccttagttgagtaattagaggaactggggtgtagttcgcttcgccgtcgttccgttaatggggctcggtgtatgcggctcgctctgccaaggttggttcgcccccttggggaggagttcggtgcatttaggaaacccaacgggtggctacagccctagaaaatctttgtaaaggctacgtagtgagaccctgcctgttcactttggtagtgtttaagggtttgatcggcccgaggcaagagggaatcacagcttgtgggtaaagtgcgcaacctctgcagagtattatgaaactgatatatcagccgtgctcgcggttatgagcgttcaagggagcttcattgat

SEQ ID NO: 64947 - DNA, 463 bp, Zea mays
  Clone ID: LIB3075-025-Q1-K1-F3
ctccctctgtcagatccccgctcgggttgccatggcggaccagctcaccgacgaacagatcgccgaggtcaaggaggccttcagcctgttcgacaaggacggcgactgctgcatcaccaccaaggaacttggcactgtgatgcgctcattggggcagaaccctactgaggctgagcttcaggacatgatcaatgaggttgatgctgatggcaatggaaccatcgactttcctgagtttctcaacctgatggcacgcaagatgaaggacaccgactctgaggaggagctcaaggaggccttccgtgtgttcgacaaggaccagaatggcttcatctccgctgctgagcttcgccatgtcatgaccaacctaggcgagaagctgacggacgaggaggtggacgagatgatccgggaagccgacgtggacggcgatggccagatcaactacgatgagttccggaag

SEQ ID NO: 64948 - DNA, 404 bp, Zea mays
  Clone ID: LIB3075-025-Q1-K1-F4
cggacgcgtgggcggacgcgtgggcgaccaggtcatctccgtcatcaccaacgatggccgcaacatcgtgggtacgctcaggggattcgatcaggccaccaacattatactcgacgagtcccatgagagggtctattctagaaaggagggagtccaacaacttgttcttggtctgtacattatcaggggtgacaacataagcgttgtgggcgaggttgatgaagagctggattcaagattggatatgtcgaagctaagggcgcacccactgaagcctgttattcactgaagtccgagtatgtctttgggtaatatgtggactggatggatgggtcactgttgaatgcaagatgtaacatcatcatggtgaggggactgaagtatatggacatgtatcttgcgta

SEQ ID NO: 64949 - DNA, 117 bp, Zea mays
  Clone ID: LIB3075-025-Q1-K1-F5
aaaaaaaaaaaaaaaaaaaaaaaaaaaaaaaataataaaaaaaaaaaaaaaaaaaaaaaaaagggggagaaaaaaaaaaaataaaggtgggtctgccaattctaaagttcctttctt

SEQ ID NO: 64950 - DNA, 378 bp, Zea mays
  Clone ID: LIB3075-025-Q1-K1-F6
gcgtttgatcttcgctggcaagcagctggaggatggccgcacccttgcggattacaacatccagaaggagagcaccctccacctggtgctccgtctcaggggtggcatgcagatctttgtgaagacactcactggcaagacaatcacccttgaggtggagtcttcggataccattgacaatgtcaaggccaagatccaggacaaggagggcatcccaccggaccagcagcgcctcatcttcgccggcaagcagctggaggatggccgcaccctggcggactacaacatccagaaggagagcaccctccacctggtgctccgcctcaggggtggcatgcagatttttgtgaagacattgactggcaagaccatcacctt

SEQ ID NO: 64951 - DNA, 110 bp, Zea mays
  Clone ID: LIB3075-025-Q1-K1-F7
cggacgcgtgggcaagttccccggcgcgcaggtgctgctggccgagttcaacatgacctcggcgggcggcgcgcagaacttcaagtcgcaggcggacaacttcgtgtgcg

SEQ ID NO: 64952 - DNA, 417 bp, Zea mays
  Clone ID: LIB3075-025-Q1-K1-F8
cggacgcgtgggcgggactacgccaaaaaagaggaggtcgcgccgctccctcacgcccactaaattcaaagtcaagaaatacaagatgaaggccccctcgtccatgaagttcagattcagaaccatgaaagacggacaggtccgcaggtggagggccggcaagcgccacaatgcacacctcaagtctaaggaggccaaacggagacttcggaagcctgctttggtgcatttggcctacgcaaaggttataaagaagctcaacttctgtgggtagcaaatcaataaagacatagcggagtttggcatgggaaactagttaactgatactgaccgccaaccgctgcatctcagttgtaaacgctggagcctctccttggaccaaatacttgctttttgtcacatgatgcattatctcgt

SEQ ID NO: 64953 - DNA, 432 bp, Zea mays
  Clone ID: LIB3075-025-Q1-K1-F9
cttaaacagattagcgataatggtagaaaagattagaccctactagccaggtattaaattaacctcgcacattagaccaactcaaccatgagcaaaaagatctaactcaactagtatagtcatgatgaattacataatcggactatccaaacttttgaccaacatcatgtagtctatcttatctatgtctatcctaaccatattcctcaaccctgatgatatacactaacatcgaatcaatgaggtcaagaccggagaggaaaagatcaacattaacaaggaaggatgtaacagtcaaagcgaatctcgagatgaatcaagacttagatttttcagatgaagtttttcctatctttctgttggggaccttcggcctccgaaggtcctcaaaaacaggatttaacagtatttctggagtataatgtgtgaaca

SEQ ID NO: 64954 - DNA, 386 bp, Zea mays
  Clone ID: LIB3075-025-Q1-K1-G1
cccacgcgtccgcccacgcgtccgcccacgcgtccgcggacgcgtgggcgaagctggaggtgtggctagaggtggagtcgcaccacttctacccgaacgcgtcgccgctggtgttccagctgctcgtgaggccgctcctgggcggcgcccccgacgcggcggtggtggacaagcacgcggagcagctcgccaaggtgctcgacgtgtacgaggcgcacctcgcccgcaacaagtacctcgccggggacgagttcacgctcgccgacgccaaccacgcgtcctacctgctctacctcagcaagacccccaaggccgggctcgtcgccgcccgcccccacgtcaaggcctggtgggaggccatcgtcgcccgccccgcgttccagaag

SEQ ID NO: 64955 - DNA, 219 bp, Zea mays
  Clone ID: LIB3075-025-Q1-K1-G10
ctcatacctacgtacgcggctgcgtgtaaactcaaggccatccttggcagtgacggcgtgggcctcgcgggctagtcttgggggatcctgccgtaacctggggcggtgatactgtacaggtgtgagatactacaggacaacactcacgaagcttttcaggaacgtactgttcgagaccaccgctatgtctttcttagctgtatcccctacaacagctta

SEQ ID NO: 64956 - DNA, 204 bp, Zea mays
  Clone ID: LIB3075-025-Q1-K1-G11
acacaacgtctatcagtgcttattcaataattcgagcgcgaccaaggcaatcatggggtggggctaccgtgctggcggcgggggggaatgccttatacttggcaagttctactttgaaggcgttagcatccatagcagggggccgacgtaacggttcaaggacgagagcctcgacagcacagataacaggggcaagatgaaccc

SEQ ID NO: 64957 - DNA, 132 bp, Zea mays
  Clone ID: LIB3075-025-Q1-K1-G12
acaaaacgtctatcagtgcttattcaacaattcgtgcgcgaccaaggcaataatggggtcgtcctcccgtgctgacggggtgggcgaaggcctaaagcttgccaagtcctctttcgacgacgttagatacga

SEQ ID NO: 64958 - DNA, 291 bp, Zea mays
  Clone ID: LIB3075-025-Q1-K1-G2
catcgtcactcactgcatcgttcgttcattcatcaactactggaaattagagagccgcatctcttggtcggagaacctgcgaggaaggactaaagagtcgaagatgactgcggcggtgctgtccgagcgcacgacgactacgttgctgctagcagcagtcatcctgggcctctgcatcgttttcctctccccccgcggcgccgctgtcgcagcgggtctcccccggcgccagcccgatcgtggccatctgcatgacgggcccgtactcctgagctgttcttgggggagctg

SEQ ID NO: 64959 - DNA, 92 bp, Zea mays
  Clone ID: LIB3075-025-Q1-K1-G3
gtttttgctgtgtgcaggtgaggaggcacttccgacccgagctgctgaaccgtctcgacgagatcgtgatcttcgatcctctgtcccacgag

SEQ ID NO: 64960 - DNA, 412 bp, Zea mays
  Clone ID: LIB3075-025-Q1-K1-G4
ggaaggtcttcgggaattctgttcagcagaatccgagtccactagccctcctcagtcctccccagggatttcgacttccccgagacaccatcgctacgacgagcaagcagagcaccatctcggctgccttaaactgtctctccgccggatactacacccgccgccgcagcgccgaccttgtctcaatcgagcggagcgggcgatcggattggttgcttccttcccccatctcatgttggtggactgagagatggagttttgatttcaaatagcatctagagaactgccactaagtttttaagttagtatataatgggtggctggtgttgctgttcgtcgagaacatctgaagccgatagagcaccaattgatatatatcgtcaacaaaatcttgaagagcatgagcccgctg

SEQ ID NO: 64961 - DNA, 405 bp, Zea mays
  Clone ID: LIB3075-025-Q1-K1-G5
gggtttcacagcgacgcttccccaccaccaccgtcgtggagatgcagaccctcgtgccctccactacggcttcttctgcaagggctatggcaccgagatcggtgagacgttgtgcccggagatcttgtgcgaggagagcgccatccacaaggctcgttccacccaccaccgttggccggtcgtgcaattctctgtagctgtatgagcatttggagcctcatccctggacaagggggcgatttattcattggagtaaactgcatttaggttgcacaagattcagttttgcttagaccatcagataaagtcaatcatagcattggatcatctaaaaattatatttatatggatggtcaaatgtgagattggacatgagagagactgcaaatttgtctgatgcaaaaa

SEQ ID NO: 64962 - DNA, 408 bp, Zea mays
  Clone ID: LIB3075-025-Q1-K1-G6
caaacctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaagggacggacctggtcgtgtgcaaggagtcctgcgctctctcccagcagtccaacctggtgctgtacggcaagatccagtgcaagggcaagtgcaccgagcagaaggggcatcacgggccgggcatgaaagtctgccaagaagagtgcgacaaggcgtacgtggt

SEQ ID NO: 64963 - DNA, 333 bp, Zea mays
  Clone ID: LIB3075-025-Q1-K1-D5
tgataagatcattatgttaattggaacatggagcgaccacccgggaaaacagtgctaccacaagggtttatggacgcccttggctgattaattaggaaagctagtggaggactaccttactcgaaaggggcaagggcagtaggggagtggtcagtgtagggaggtccttggttgattttgctgcgatggcggtgaaagggaaatgtgcccttgggccattttaagtattttgttgatttagtgtctaacacaagtgcttaaatgtaaaatggtggacaaagtacaaaccaaggataaaggtatgtttctcagacttagtacatttgtttatgg

SEQ ID NO: 64964 - DNA, 361 bp, Zea mays
  Clone ID: LIB3075-025-Q1-K1-D6
gtcatcaccggcaagggaaaccttgacgggcagggcccagccgtgtggagcaagaactcctgcaccaagaagtacgactgcaagatccttcccaactcgctggtgatggacttcgtgaacaacggggaggtgtccggggtcacgctgctcaactccaagttcttccacatgaacatgtaccggtgcaaggacatgctgatcaaggacgtgaccgtgacggcgcccggggacagccccaacacggatggcatccacatgggcgactcatccgggatcacgatcaccaacaccgtcattggcgtcggtgacgactgcatctccatcggccccgggacctccaaggtgaacatcaccggcgtga

SEQ ID NO: 64965 - DNA, 341 bp, Zea mays
  Clone ID: LIB3075-025-Q1-K1-D7
cacgaccatgatgttattagcgagggatcccatcgtcgtgggtgtcgatcttgcagcgctggtccacgacgtgatatgcgggccttcgaaggtgactctaaggtcccaacatctcgaccaattactattgctagtgtctcacccccatggtcacgtgctacattgagtctaatcttgcacgagttgctgacaactggtggtcgtgggctatcaagaatgtgtacacggcatcctacaccaggatgaagatgtgtagctacgagctcatttttaatgaacggcagggttgcgtgtaatactatgaggtgacataccatgaaaaacctgggtgctcaggcaat

SEQ ID NO: 64966 - DNA, 330 bp, Zea mays
  Clone ID: LIB3075-025-Q1-K1-D8
ctccagcagcctcaaggatgtccaggtcgccttcagcaacgccgaccacaaggacagcggcggcaaggtggaacagccggcggacagctccttgaagccggcgagcctgaacgcgttcgacatcatctgccactccagagggttcgacctgtcaagcctgttcgaggtggaccaagagcagaaggccagcaactcgcggttcatgacccagaaaccggcgtcggcgatagtgtcaaagctggagcagatcgctgagacagagcgcttcatggtgaagaaacaggacgggctggtgaagctgcaggggtccaagcaagggaagaaggggca

SEQ ID NO: 64967 - DNA, 460 bp, Zea mays
  Clone ID: LIB3075-025-Q1-K1-D9
ggagctggtggcgctgtccggcgcccacacgctgggcttctcccactgcaaggagttcgccgaccgcctctacaacttgcgcaaccagggcgggaagccggagcagttcgaccccagcatgaacccgtcctacgccagggggctgcaggacgtgtgcagggactacctcaaggaccccaccatcgccgcgttcaacgacatcatgacgcccggcacgttcgacaacatgtacttcgtcaacctcgagcgcggcctcggcctgctcagcaccgacgaggagctgtggacggacccacgcaccaagcccctggtgcagctctatgcatgcaacgccacagccttcttcgacgacttcggccgcgccatggagaagctcagcttggtcggcgtcaagaccggcgccgactgcgaggtcaggcggcgctgcgacgcctacaacagcggacccgccgtcgccgcc

SEQ ID NO: 64968 - DNA, 83 bp, Zea mays
  Clone ID: LIB3075-025-Q1-K1-E1
gttctagatcgcgacggccgccctttttttttttttttttttttgacaaatagactcccttatcgtttttttttcatgtaccc

SEQ ID NO: 64969 - DNA, 407 bp, Zea mays
  Clone ID: LIB3075-025-Q1-K1-E10
cccggaccccggaccgcgccggctcgcagactcctccacaaccctcgtcgccgccggctgctccacccccgccaccgccatgggtaaattccgcaagcttggccgcaattactcccaacgcctctgcatgctcaggacgatggtgtcgcagctggtgaagcacgagcgcatcgagaccaccgttgccaaggcgaaggacgttcggcggaaggcggatcagatggtgcagctagggaaggagggtactcagcatgcagcaagacgtgctgctgcctttgatcgaagtgatgatgtccttcataagctatttactgagctggcctttcgctacagagatcgagctgggggctacacaagaatgttaagaaccaggatacgtggtggtgatgctgctccaatggcctaca

SEQ ID NO: 64970 - DNA, 393 bp, Zea mays
  Clone ID: LIB3075-025-Q1-K1-E11
cccacgcatgcgtggactcatatgccttgtccgaatcgaggctatcagagtatacgcgcagggcagagatcacgacctgggggacgactaatctactgttaacgagggctcgaatgcttgagctagctgcaagactgacactgcctttaagttcagcgaaggaatctggtgggacgctaagcttgcccggtacgcaatcggcgccaaactgaagcttgtcggatgagaggtctgcactgaacagcttactatggtaacctaaaaatcagtggcatatgcgataaatgataggtgaaccgagctaatctaacgcgaaggggcacgagtactactccacatatgaaccggagcgttctatgaccacgcttgacatgtgcatggcagagcttgacg

SEQ ID NO: 64971 - DNA, 397 bp, Zea mays
  Clone ID: LIB3075-025-Q1-K1-E12
agcaaacctgcagtcatctcctccatcaccaccaaactcaacaacagccagctcgcgaaaataatgaagagccgcagcatggcatcatcggccgcgctcttggtgctagccctcgcgctagtggcggccaccgacccacaggtagcggaggcaaagaagaagagagcggcggagagcggcgaggcggcggaggcgaataagatccaggacgacttctgctcgacgctgtgcgagggcaagaaggggacggacctggtcgtgtgcaaggagtcctgcgcgctctaccagcagtccaacctggtgctgtacggcaggatccagtgctagggcaagtgcaccgagcagaaaggcatcacggcgccggccatgaaagtcttccaagaagagtgcgacaagg

SEQ ID NO: 64972 - DNA, 444 bp, Zea mays
  Clone ID: LIB3075-025-Q1-K1-E2
attttcttatacaaactcagcattcagccggtcagttgaggaacaggaagaattctaattctggtagagcaaaagtttctgaaagtacagatatagttacatttgctgatgtggctggagtagatgaggcaaaagaagagcttgaagaaattgtggagttcttaaggaacccagaaagatatgttcgtcttggtgctcgccctcctcgtggtgtcttattggttggttttgcaaatgctatcagtaatggcaattactgcttgacaattgtgtttgttaccatattgttattctttatctacaggtgggtcttccagggactggaaagacacttcttgcaaaagccgtagcaggagaagcagaagtcccgttcataagttgctctgctagtgaatttgttgagctatatgtaagcatgggagcagctcgagtacgtgacctatt

SEQ ID NO: 64973 - DNA, 455 bp, Zea mays
  Clone ID: LIB3075-025-Q1-K1-E3
gtcagcttgcaattctggtgtctggtgcttctcggttcaacaactagatccattgattatataggacaatgcgctcgacaatccatttagttccttgtccacaacatttgaggcagctttatatagttcgaagtatttcaatgtataggctacaactgaattgttcatgtaactacatcctacttgcttagcagtgtttattacaaaataaccatatgctttcacgatgcttttaatttcacatgaagttgccttgagtcgtgcaaaagtattacttcactccttttttctcttcctttatcatctatcatattatgatgtaatttggaacaatgccttaaaaaacttatgttgtaggctatcatgaagctttctggtcaaagtcccaaaagaatgagagacctatcaagtttgtgggtttcactcccttcccacctcatcctttctgtgtctac

SEQ ID NO: 64974 - DNA, 421 bp, Zea mays
  Clone ID: LIB3075-025-Q1-K1-E5
gcggcacggggccgcgaagatctttagccaccctgacgtcaaggctgaggaaccatggttcgggattgagcaggagtacacccttctccagaaggacaccaagtggcctctcggttggccgctgggcggctaccctggccctcagggaccttactactgcgccgtcggagcggacaagtcctacgggcgggacatcgtggacgcgcactacaaggcctgcctctacgccggcatcgacatcagtggcatcaacggggaggtcatgccggggcagtgggagttccaggtcggccctgccgtcggcgtctcggccggcgaccagctctgggtggctcgctacattcttgagaggatcaccgagatcgccggcgtggttgtctccttcgaacccaagccaaattccggggactggaatggcgct

SEQ ID NO: 64975 - DNA, 458 bp, Zea mays
  Clone ID: LIB3075-025-Q1-K1-E6
ggcgatggctgggaagggagggaaaggcttgctcgccgcgaagactacggcggccaagtccgccgagaaggacaaggggaagaaggccccaatctcacgctcctcccgcgccggcctccagttccctgttgggcgtatccaccgtcagctgaagcaaaggactcaggcaaatggtcgcgttggtgccaccgcagccgtctactccgctgccatcctggagtacttgactgccgaggttctggagctggctgggaatgctagcaaggatctgaaggtgaagcgtatcacccctcgccatttgcagctagccattcgtggagacgaggagctggacacccttatcaagggcaccatcgcaggcggaggtgtcatcccgcacattcacaagtccctgatcaacaagtccttccaggagtgaaaacttagggatgtgcatctttagtttaaactagactttt

SEQ ID NO: 64976 - DNA, 444 bp, Zea mays
  Clone ID: LIB3075-025-Q1-K1-E7
cgccgactctgccgtctccctcgcctctttcccctcgtctcgtctgcatccgcctccgccggcccaagacctcatcacctccccttcgccgtgaaccctaaccccgcgcccctcgccccctccttctcgtcgtcatcgccgcccgcttttccgggcccccatcgcctcttctctttcacgagtggttcaagcatggtggtcgtgggctccgcggactccttcaacagcatcttttccaaggtgcaagatgaaaagctaccagctgtcttttactacacggcggtgtggtgtggaccatgtagggcgatcgcacctttagtatcaaagctgagcagccagtatcccaagataccggtgtacaaagttgacattgaattggaaggactgtgaaacaaactccgtgatctaaacatatgttcagtgccgacgttccacttctatcac

SEQ ID NO: 64977 - DNA, 432 bp, Zea mays
  Clone ID: LIB3075-025-Q1-K1-E8
caagctgccagccttccagcagagcaagcactgaattacgatgatcaaagtggaaaccttgcgccacctccttgggaggctcagccagcggcaagcaacgaaatgccaaatggtgaattgggaggcgtgcaacctcttcctgggacagctgggcagttcggcggcatgcagcaggcactgcaaccacaagttaaccacatgggagttccacaaaggcagccaatgtacagcaaccagccaggggttgtggtggcgccaacacagatgcaggcaggcttggggaaccagcagttgggttcgacatccatgatgggcatgcctccacagatgtatggcggcggatcgcaggcagccatgatgtaccccgcacaaatgccagtggcgccgcagcaacccatgtattgtggtggtgtcgtctggcagggtacatgc

SEQ ID NO: 64978 - DNA, 421 bp, Zea mays
  unsure at all n locations
  Clone ID: LIB3075-025-Q1-K1-D4
ctcgaccatccctgcaaattaccgcgatggctcccaagatcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgncattcttcccaagctggtcttcggcaacgaacagaaactcggcgtcctcaactacaccagggccgacgacgggcagatgtactt

SEQ ID NO: 64979 - DNA, 440 bp, Zea mays
  unsure at all n locations
  Clone ID: LIB3075-025-Q1-K1-C11
gtggacgacaccggcgtcgtcgaggtggatgccggcgccgccaatgcggtggcgctgcccgtgaagcccgccttgcagctggaggaaaagggggagctggagaaggaggtgtgggcgaggttctacggcaccggcttttggaggagcccgtcgcagctggacgacaacgacgacaggtgatcgggacaggcccgcgagcgagctatccacaagctcctccggcgatgcgtgggcttccttcgttttccgcgggaagaagagaggatcgaggaaagggaaacatgattgtgtgttcgatactacgattacgaacttcgntttcccttcttttttggttgtttggaaggggaaatacttctcttctattctacaacaatgtcacgtacatgcaatgtaataataaaaaatgtatgtgatatatttaacaatgtgattgatga

SEQ ID NO: 64980 - DNA, 279 bp, Zea mays
  Clone ID: LIB3075-025-Q1-K1-C12
cccacgcatgcgaccagaggttcagttcgctctcattggggccaccgcctacttattggctacactagcccgcggatgcgagggcttcttgtgtaccatcgaggaggacgcgcctggtatgattaccttgaatactagactccggaacaaagctgaaatggtgcatactcgatgctgcaagagcaattactgaactgaatggtgtcacaagcctagatcttacacttagaagtactgcgctgtatatgtctataagtacattcaaacctgttcttagat

SEQ ID NO: 64981 - DNA, 374 bp, Zea mays
  Clone ID: LIB3075-025-Q1-K1-C2
cgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatcttgttcatgtatgctcaaggttcattatcttgttcatgtattaagtatgttatgaataactcaatatttattattttgttc

SEQ ID NO: 64982 - DNA, 425 bp, Zea mays
  Clone ID: LIB3075-025-Q1-K1-C3
tgcaacgttgattgtacttgtgacagtgacaaaaaacagtgcacttatgaaaggcagtatgctgaaatgagctccagcagtggggtgcttggtgaggacatagtgtcttttggcagagagagtgaacttaagccacagcatgctatttttggctgtgaaaattctgaaactggagatttgttcagtcagcatgctgatggtataatggggctgggtcgtggtcaacttagcataatggatcagcttgttgaaaagggtgtcataagtgattcgctctcattgtgctatggtggcatggatattggtggcggtgctatggtactcggtggaatgcttgctcctccagacattgatttttcaaactcggaccctctccgcagcccatattacaacattgagttaaaagaaatacatgttgcttgaaa

SEQ ID NO: 64983 - DNA, 442 bp, Zea mays
  Clone ID: LIB3075-025-Q1-K1-C4
cctcaactacaccagggccgacgacgggcagatgtacttcggcgctcccggcgccccctgcgtggccaagctcgtgaaggtcgtcgcagcgcggccgtactctgtgtccatcatggagatcagcgagcccattttgccggccgcgttgccctcccccgtcgcggcgcccggccgccgcggcaagggtggtaagcgcaagatcaagccatcagcggcaacccatgaggattccaacatgatcccgcgcaagcccgtcgaagcagtggtggtgggtaagggtaaggtggccaaagataccgtgtccgagtcacctgctccaagccccgcccccgtctccgccccttagttgcgtgttgggcgccgctgcccgccggcccccggccaccatgcgtcgtgtctgcgcgcgcacgcacgcattgaacgggagatagaatatggtatc

SEQ ID NO: 64984 - DNA, 450 bp, Zea mays
  Clone ID: LIB3075-025-Q1-K1-C5
cggacgcgtgggccgtgaagccgaggacactacttgcacatctagtggaccattctcaaccagtgacccacagaaaaatacaattatgctgcagcttggatatccaatcaggaccaagctcggaataataggagattcatggtgtatgtgcactcgaaaggcatgattgtggatgatgaatatgtgataattggatccgctaacatcaaccagagatccatggaaggaactagagatacagagattgcaatggctgcataccaaccccagcatacattggcaaatatgctttctgctcctcgtggatagattttcgggtacaggaaaatacagtgtacgtgttgaaactgttatcctgccccaggttgggatagacggtggtacattcgtgttggtagaactgtgagaagaaaagatgggaaaactttgctttctttgctgtgatgatta

SEQ ID NO: 64985 - DNA, 344 bp, Zea mays
  Clone ID: LIB3075-025-Q1-K1-C6
ctcgtcgtcacgccatccctctccacctctcgtcttccagacgcctccaatccgggctcccagcgtctcggaaaagaggagcagcacggcacggcggcgatggcgaggaacgctccaataatatgctaacccgttctacccagtccaattagcagcctcccaaggagaaggagatccaatcctgcgggcgggcgtccccgtatcccatccatcgatccgaatctcggaatctgcaggaccctgcggcgcggcttcttcgtggagaagaggttgctgccgaagccaccgccaggtagccatgtcgtcctccgtgctgagggctgcggccgacagggccattcgca

SEQ ID NO: 64986 - DNA, 387 bp, Zea mays
  unsure at all n locations
  Clone ID: LIB3075-025-Q1-K1-C7
ctcaacgacaagattcgccactgcggcatcatggacgtcgagttcagaagggtgcgatgcaggtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctgcatccgcctcaccagcgagtccggcaagaaggtcatcgccaaagacgttattccggcgaacttgagacccgatgccgtctacactttcaacgtncaattctactagactttgaat

SEQ ID NO: 64987 - DNA, 53 bp, Zea mays
  Clone ID: LIB3075-025-Q1-K1-C8
ctcaaacttcctcacattcgttcaggttatcttcaccaatctcatctacaatg

SEQ ID NO: 64988 - DNA, 450 bp, Zea mays
  unsure at all n locations
  Clone ID: LIB3075-025-Q1-K1-C9
cccacgcgtccgcccacgcgtccgatcctccgccaccaccaggctctggtgtctacagtcctgcaccccctgcaccaggtcaagctgccccacctccgtatgggatgcaatatccaccaccaccaccacccccagcagctccaatccctccaccaggcactgctccatcaagtgatggagctcagaactatccacctggtgtaacaccaccaagttctggctcatccactcaccctgttgcaacatcagtatatgcatcatctggtgcaccaaatgcaccatcgatataccctccaccaccttatagttattcctcatactaccctccaccatttcagccaccacctncaccaccaccaccggctagtgttgatccctctcagagtattgcaactgcaccttggctaacccacagtgtggtggtgccaccaccacccgcgagtgttgatc

SEQ ID NO: 64989 - DNA, 446 bp, Zea mays
  Clone ID: LIB3075-025-Q1-K1-D1
cggacgcgtgggcggacgcgtgggctcggaaccggaaagcaaacaagtccagtacgccaagaagtacgtgcaggactccaagaacacgacggacaagactatggtgccgcccaccgtgtacccaccgccgcaggccatggcgtccgcatacccgccgcaacaatattgttcgccgtacgcggcgtacccgcggcagccttacgggtaccctgctccgccaccgtacgggtacaatgctgcttccccacaaccggcgatgtacaactacgcagcacagccggtagctgcaccggcgaggcatggcggaggtatggggatggggctcggcctagggctcctaggcggtgcggtcggggggatgatgctcggagaggcgatcggtgactatgagaccgacgccgcttatgatgccgggttcaacgatgcattggcattttagatctatg

SEQ ID NO: 64990 - DNA, 426 bp, Zea mays
  Clone ID: LIB3075-025-Q1-K1-D10
cccacgcgtccgcaggaacttccccccgcagctgacgcctttgtactacaaccagtcggggccactgatgcctctgctctgcaaccccttcacgcctgatctgagggaccgcaactgcagcagaggagaggttaccttggacaacgcaacccaggtgtggaagaagtacgagtgccagagcaccaccgtctcaggaggagccgagatctgcgcgacggtggggcgtgtgacccccagcatctacgggcagatgaccgcgggcgtgacggtgagccaggggctgtaccagtacgggccttttctcatccagctgcaagactgcaccttcgtgcgcgacaccttcacgaccatcaaccaaggctactgcccggagctggagcgctacagcaagtgggtgtacgtgggcctcgtgatggtctcgttggc

SEQ ID NO: 64991 - DNA, 404 bp, Zea mays
  Clone ID: LIB3075-025-Q1-K1-D11
gggatccaagcctggccacctgatcctcacccccaatgttgccaccatatccgacgtggagatcaaagagcacggtggcgatgacttctcctttacgctcaaggagggcccgactggcacctggacgctcgacaccaaggccccgctcaagtaccccctttgcatccgctttgctgtcaagtccggcggctaccgcatcgccgacgacgtcatccctgccgatttcaaggccgacaccacctataagaccacactcagcatctaatcaatctctggtgatgaattagatttcaaaagagctcatctagcgcacatgttagcaagacaatattattttttctatgggtattttgtggaaccaaaccacccaagaaataagtgatgctagatgtaccttctgacct

SEQ ID NO: 64992 - DNA, 422 bp, Zea mays
  Clone ID: LIB3075-025-Q1-K1-D12
agcacacctgccaacactcagcaacagccaggcccttcacatgtaccagtgcctcagcgaacagtaaagacatttactccggcgaacccagctggtctaaaaaacccgggacaatatcagcaacctaataccttaggttcccagctttacacgggcgctacgaatcaaccgtattcttctggaccatctgctccttatccaagcggacctccaacaacatttcatcagcctgtagcacctgttcaatatcagagtgctgctccaccagtatcttcttttggtccaaccacccctgtaccaggaacagtccctaaccagatgttttcccattctgctgctactaactcgacttgcaggtttatgccatcgaacaatcaaagctttgctccaaggccaggtttaagtcctgtgcagcccttaag

SEQ ID NO: 64993 - DNA, 415 bp, Zea mays
  Clone ID: LIB3075-025-Q1-K1-D2
atggctggttcgtggatgccggcgccacagcctctcctgctgtcgctgctggtcgccgtgctagcggtggccgccgatgtcgccaacgccggccacgccaagcccctgacgcctggcgggcgcgtggtacaccacaaccacggcaagttcacggccgggccgtggaaacccgcccacgcgaccttctacggcgggcgggacgggtccggcaccacggcgggcgcgtgcgggtacaaggacacgcgcgcgcaggggtatggcgtgcagacggtggccgtgagcacggtgctgttcggtgacggcgcggcctgcggcgggtgctacgaggtgcgctgcgtggacagccctagcgggtgcaagcccagcgcggcgacactggtggtgacggcgaccgaccttgtgcccgccaacgacc

SEQ ID NO: 64994 - DNA, 406 bp, Zea mays
  Clone ID: LIB3075-025-Q1-K1-D3
gagaagaagcagtcgaacccgatgcgggagatgaaggtccagaagctcgtgctcaacatctgcgtcggcgagagcggtgatcgcctcacccgcgccgccaaggtactggagcagctgagcggccagtcaccggtattctccaaggcaaggtacactgtgaggtcgtttgggatccggcgcaatgagaagatcgcatgctatgtgacggtgcggggtgagaaggcaatgcagctgctggagagtggcttgaaggtgaaggagtacgagctgctgaggaggaacttcagtgacactggctgctttggatttggcatccaagagcacattgatcttggcatcaagtatgatccatctactggtatctacggcatggacttctacgtcgtccttgagcgtgctgggtacc

SEQ ID NO: 64995 - DNA, 155 bp, Zea mays
  Clone ID: LIB3075-025-Q1-K1-C10
cacattcttccatcgatcggtttcatcgtccgccaacatccttcttgattgttatttgtgcaacacccagggcggcaggtgggaggacatgagctaccattgaaccatggttgcagccccagtacgcgcttgagtgctggtgctggctctagcac

SEQ ID NO: 64996 - DNA, 223 bp, Zea mays
  Clone ID: LIB3075-025-Q1-K1-A2
gagatttggtgatccaagtagatcagaagaatgaagctgtcctcttacctatttatggtaggatggttcctttccatgtttctactgtcaagagtgtgacaagtcaccaggacaaccgcacctgcactatccgtatcttcttcaatgtgcctggcatgccattctcaaatgatagcaagtttaattctcaaggtgctatctatctgaaagaaattacattccg

SEQ ID NO: 64997 - DNA, 353 bp, Zea mays
  Clone ID: LIB3075-025-Q1-K1-A3
ctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaagggcatcacg

SEQ ID NO: 64998 - DNA, 336 bp, Zea mays
  Clone ID: LIB3075-025-Q1-K1-A4
ctttcaagcgcctaggctgctaccttagaatcaagcctgcggtagagggtataacctcgccggagaagacagctatctccatagaccgaaggaccttccaaattgaaaataataataatatgagatcagtctgggctggcttgggcaggaagcgaacagcgcagtatacaattgcccctttgcagagcttgtcgcttggagtttaaggctgctggtggcaagaatacatggcaaagtcagtcgtaaattcatactgtaatacatattccttaggcatgcgaggcaatatttgcccagagccaagctgcggacaagctgccatcgctgtccgtccat

SEQ ID NO: 64999 - DNA, 159 bp, Zea mays
  Clone ID: LIB3075-025-Q1-K1-A5
aaatgatgagatcatggctaggggaacctttgccaacattcgtcttgtgaataagttcttgaagggtgaggttggacccaagacaatccatgttccatttggggggaaccttgcagtttttgatgctgttttgaaatccaaaattgaagggcttgccct

SEQ ID NO: 65000 - DNA, 421 bp, Zea mays
  Clone ID: LIB3075-025-Q1-K1-A6
aatcatcaactgggaaagcatatgcttcttcagttgatgatttgcttggcggggaacctattgctgatacaagtgtcactgctgatagcaatggaagcgatccatttgcagatgtatcattccatgaggtagaggctaaggagactaatgatctcttctcaggattgatagtagaagaaaaatcatcagctaccatgcacggcagttcttcatcaaacaaaaatgaattaccagatatctttggcagcccccctgattctttcatccaaggtagtgttactgaccaaggaactgtcaatgatttgatgtctgggttgaaccttaatggaacaggtcaggctcagcctccagttaaagcagaacccaatagcaccttcagtggatcacagttctttgatacaaacaatgacatcggccatgt

SEQ ID NO: 65001 - DNA, 443 bp, Zea mays
  Clone ID: LIB3075-025-Q1-K1-A8
ggcagcagtacagacggcaataccccgaggaggtcctcggcaaggccgacgcgaggggtaagggtgattatcatattgattatgtgcctgctccaagaattaccgaggccgacaaaacaaatgaccagaagtctttacaacgagctcttgataataaactttatctcctgctgtatggcaatgcttatggggctcctgatggaaagcctgtatggcattttccggaaaaagtatacgaaaatgaagaaactatgcgactgtgtgcagaagctgcattaaaatctgttcttgggggacttgaccatacatactttgttggcaatgctccaatggctcatatggcagttgaacaaacagattcaagtgtttcatcattcaagcgtttctttttcaagtcacaagtggttggcacaacgaaataccatgttggaaaatgcaaggac

SEQ ID NO: 65002 - DNA, 456 bp, Zea mays
  Clone ID: LIB3075-025-Q1-K1-B1
cccaaagatagcatagcagcagcactcacaatagcaaaaaccaccatccgtcgtcgccaaccgtagcaagaacatcaccaccggccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttccttctctaatttctcgaccccgtcgaattttttttcctttctattcttttactatactactactatctgttt

SEQ ID NO: 65003 - DNA, 302 bp, Zea mays
  Clone ID: LIB3075-025-Q1-K1-B10
aataaccctgcgtgcccttcgttctcgtttcgatcccaacaaccctccctttgtctccggcagaccacattaagtcgcgggggacatgaacaacgtcgcctgcgctgtacttgccgccgtcgtctcctccaccgtagtccttgtcgccgaggcccccgctccctctctcactaacgcctcctttgctgctttccctgccgtcatcacccctcttagcgcctccttgctttacttctttgcctactacctttagtaaactttaagtaggatcgaagggagacgcttcttgctttccatacctt

SEQ ID NO: 65004 - DNA, 344 bp, Zea mays
  Clone ID: LIB3075-025-Q1-K1-B11
cgcaagcactactcggtcgatgttgttgttgcgtggtacactgtaaacttagtagtagtctgtgtcgacaacaagctggggaaatgccggatcggacgagtggactacatttgcttccattaagctccaaagaaaaagagggcaggcagaaggaggagaaagacagttaactgaaggacgagttccacaagttactgaatgggaaccatgcggatcctactgatcggcgacagcgggcacagatgaacgggaggcacgacgaagacatcaatcacgcgctctccgaggccactgccaacggcacgtaagggcccgtcggcatctgcttttcaccgggggctttg

SEQ ID NO: 65005 - DNA, 454 bp, Zea mays
  Clone ID: LIB3075-025-Q1-K1-B12
cccacgcgtccgaccaggggttcagttcgctctcctttggcccagtgcctacttattcgctacactagccaggtgattagagagtctggtgtgaaccaaggtggagatcgtcctttctttgatttccttgagtcctgtctccggaacaaagctgaaatggtcatacttgaggctgcaagagcaattactgaactgaatggtgtcacaagccgagagcttacacctgcaattactgtgctgcagttgtttttaagttcatccaaacctgttctcagatttgctgctgttcgcacgcttaacaaggttgcatcaactcatcctttggctgtcacaaattgtaacatagacatggagagcttaatctctgatcagaacaggagcattgcaacccttgcgattacaacactgttgaagacaggcaacgaatcaagtgttgatcgtttaatgaaacaga

SEQ ID NO: 65006 - DNA, 421 bp, Zea mays
  Clone ID: LIB3075-025-Q1-K1-B3
atcaccaagcactacgcggaagaaggcgtgtggaagaactgggtgtggcacacggaggacgacctgttcatgaacggcgccatcttgaatccgtccggcggcgcccccaagcaggtcgacaccaacgagtgggtaaagcccaagccaggaacctacgttacaaggctcacccgcttctccggcacactgtcctgctgcacgggcaagccgtgctgaaggccggtgggcatcaggctgtttcttctagctcatggcctggccatgccaggtcgcgctggctgcgtttcatttcatggaagaaagcaaggatggatcacaggttgtcgttctgctaattaatctacatacgtttgccttcaagtactgtgttgtggcattgttacacatcacagtacagtttgggcaaatttttttttcacag

SEQ ID NO: 65007 - DNA, 420 bp, Zea mays
  unsure at all n locations
  Clone ID: LIB3075-025-Q1-K1-B4
cacacggaaccagaaagcaaacgcaaacaagaagcaaaccagcaatggcccgcgcctgcgtcttcctcgtcgtgctcctcctagccgccgtcgccatggcgccgttcgcgggcgcggcgcgcatcgacgtcgtcgagggcaggtccatggcgtccgcggacgcaccggaggccgtcgncgacgctcccgctcctgctcctggccccgactcctcctcgaccccgtcgccggcacccttcagcagcagctctttcgactagccgcccggcagagatatctacggcgtccgatcagtctttggcgccacctataacctatcggatcctgcaaagctatatatgattctatggtataatgtgtggttgcggcaaacgcgcggaaataatgtgcttgcgtgattggttttctctctcttttttt

SEQ ID NO: 65008 - DNA, 399 bp, Zea mays
  Clone ID: LIB3075-025-Q1-K1-B5
cagacacgtgagcatacgcgggggcagccgtggcgagagcagtcttgcgaatacacccaagaacggagaagatgtactcgaacgccaggatgcttggaccactatagacaggagcgactaagaggttcatctgacagacatggagaggaagaaggacctttgtgtcctgcttggcgccgacgactggggagcgagctgttgggactgggctgctaacgggcgccctctgaagggcgcgaaggctcggacagcggagaggttggacataattcaaggggcgcctcttgctggcgtctgaatgacgcctgtgtgctacaaagcctgcttcgatgcatatagcttgagtgtaagacgacatgagcggtagaaacgttaggatgcaaccagtgtgagtgatac

SEQ ID NO: 65009 - DNA, 128 bp, Zea mays
  Clone ID: LIB3075-025-Q1-K1-B6
gaaccgatccccgctattttactcccgttcgtttcattgttccgttgctttggatctgagtctcgagatcctcccctgtcctgctgctcgaggagccgccaaggataccaaaataccatgatgcaggt

SEQ ID NO: 65010 - DNA, 305 bp, Zea mays
  Clone ID: LIB3075-025-Q1-K1-B7
gccgaaccctcctccgttcgccgaggcggagcacgcccttccaggccagcttccaccggaggaggagctaagtcgcctggaaggcttcccagctagtagcgtgtgccgtaccccgtcgctcaaccgggatggcgtcgagtggggatccgcccggatctgctgatgagaagaaaactccaatatccgaagggtcttccgacgaacgtcaagggcttcctccagcaggcttttcaaatccttttgattttggttctatgcaagtttgctcaatgatccatctattaaaggagatggcagatcaaatt

SEQ ID NO: 65011 - DNA, 377 bp, Zea mays
  unsure at all n locations
  Clone ID: LIB3075-025-Q1-K1-B8
tgctggtcttgcaaatatgcgtgccaggaactatggcatccaagaggttgacaagctgaaggcaaaaattattgcaggaaggagcatcccagctattgcaacttcaactgccatggcgacaggactagtgtgccttgagctttacaaagttctggccagagggcacccaatcgaagactaccgcaatacatttgctaacctggccctaccgatgctcaccacatctgaacctcttccccccactgtgatcaagcatggagatatgacgtggaccgtatgggatcggtggtctatcgagggagacatcacagttgcagagctcctgaagtggttaagcgacaagggcctgagtgcgtacagtgtctnctgcggcacat

SEQ ID NO: 65012 - DNA, 372 bp, Zea mays
  Clone ID: LIB3075-025-Q1-K1-B9
atcaccaccaaactcaacaacagccagctcgcgaaaataatgaagagccgcagcatggcatgatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcataaaggcatcacggggccggccatgaaggtctgccaagaagagtgcgacaag

SEQ ID NO: 65013 - DNA, 288 bp, Zea mays
  Clone ID: LIB3075-025-Q1-K1-C1
cttctcctccccctcttaccaagtcctcttcgggttagggttacttagggttttgtggaggggcgagtggcggcggctgatgtggagtgccgttgcttcgtcggcgggcttgcctgggccaccagcaacgagtcgctggagaatgccttcgccttctacggcgagatcctcgactccaaggtcatcaccgaccgggagacggggaggtttcgcggcttcagcttcgttaccttctccttcgagaacttcatgctcgacgctatcgagaacattaacggcaaggagctt

SEQ ID NO: 65014 - DNA, 221 bp, Zea mays
  Clone ID: LIB3075-024-Q1-K1-D11
tccacacagaaaaccctatccgccgtcaccgaatcggcctcccatgtaagcaggatcgtgcagcccgccgcctccatgaagcgcaatcccctcgtcacgagctcccgccggaagtgccgcaaggcgcactttacagtcccgttctccgtgcgccgcgttctcatgtccgcggagctgtcgaccgagcgtacacacaagtacaacgtgcgcttcatcctgat

SEQ ID NO: 65015 - DNA, 368 bp, Zea mays
  Clone ID: LIB3075-024-Q1-K1-D9
cagtcattgtcgctacaaatatgttggaaagcatgattgaccattctactcccacgagggcagaagtttctgacatagctattgcagttcgggaaggagctgatgccatcatgttatctggcgaaactgctcataggaaagtatccactaaaggcagtcaaggtgatgcacactgtggcactcataacagaatacagcctttataacccaactacttctactagtctcgatgcatctgcacagggtctacaaaatgaggtcttctacgcatgccagctaagtaaaatgttctgatctcatgcaacgatgattgacaacatccttcgcacaccaatcattgtctttacacagacaggctccatggctgt

SEQ ID NO: 65016 - DNA, 425 bp, Zea mays
  Clone ID: LIB3075-024-Q1-K1-E10
agaattacgcctccttatattttactgagatctccgagctactgaggagattaccaagggttatattgttgatgcttaaaacaaatgactgtttacgtgcagtcagtcatgccctggttgggggcagttccttggagtcgtttatgattattggacgggtatcttctgaagctgtgctggatgctaaaaggatgaacaggaggtcctttctcgatggattgaagatatggctggaggaagccctgctggaagctcgattctttactttgaagctgatgctatgtgttatgcaacttaggaagttgttgcctggctaaaagcagttaggcgtatcatcagcctttttgaccggtagaactgctgagttgacatctagttccatatattttcttgagggcgaaacttgacattttgcttagaagatt

SEQ ID NO: 65017 - DNA, 428 bp, Zea mays
  Clone ID: LIB3075-024-Q1-K1-E11
caaaggttgggatgacatctgctgctgaaagtatcaccgtgagcctccgacggtctcgccagatgatggttcaggaagtggaaaggagtgcaagtaccttggcaacatttgatgaatcaacaagtgttctccggaaggctgaaggtgaatatcaaggacaccgctctttgctaatgcgtacccgtggtttgctctccacgatgcaacagcaagatgttcttgataggtaggtactctcactcctttatacagttcaaaactgggatcactgaaaataagtgtataatctgttcttatagcttgcactatttgttttacagtctaaatatttaaacttaatgaaatatctttatatagtgtgtacacctaacagctcttcacatttcaatgagcatctacaaattgaactttaaccattgttcctttcg

SEQ ID NO: 65018 - DNA, 437 bp, Zea mays
  unsure at all n locations
  Clone ID: LIB3075-024-Q1-K1-E12
cggacatcgacgaaagctatagccagctagtaacaagagcaaaaacaccatcatctcatgcgcccgtctcaacgccacccgcaatggcccagagcacgaggatggtggcgctggccctggtggtcctcctggtggcggcgacggcgtcggtgcccacggccaccgcgtacggctgctacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggcttcatcggcgcgcgggctcagctcgatatcagcatcatatacaatcgctgctccgtcgctcacgtcagcccatgcatgatctctcgacccggcccattgaatcttctncttctactatagtatatctttg

SEQ ID NO: 65019 - DNA, 268 bp, Zea mays
  Clone ID: LIB3075-024-Q1-K1-E9
ctgacgcgtgggcggacgcgtgggcttgtattgacacacgtgaacactactatcgcctggcctggcgataacactattggcgtgggcccccttcttctcccactcggaggcggacggtcgcgcggaaaacaaaacgcacctcaaccaccgaacatttaaagcaactacaacgacagacgggtaaccgacagactcacgtggtaccgacaggctaactgacaccacgctcctgacaacgtgcgggtacacgggctaaataacgaaaaac

SEQ ID NO: 65020 - DNA, 428 bp, Zea mays
  Clone ID: LIB3075-024-Q1-K1-F10
gttcagtgtcggagaatccaccaaggacgatggccatcgcttgacgatggaatgctccactcccgtctcctccagtagcccttccactcgcaagaagcgcggggcgttcagcctcttcagggcgatgttcctgtccttcggccggagcgacgacagcatgaagaagacagacgacgacaccacgagccccaagaagagagccatcgcggctgctgatgacgattgcaagcctgccggtgacgagtcaacgtcgtggaagcgcctcgtggacggtatgcgcccgctccgcctccgcgggcagctggagtactacccgtcgtcaccgtcgtcaccgtcgttgggccacgccgatgtgtaccatgacgtgatcctcccgccgtcgtcgcaggcacggttcggcttcgagatcaaggaagtgggcatgacca

SEQ ID NO: 65021 - DNA, 351 bp, Zea mays
  Clone ID: LIB3075-024-Q1-K1-F12
ccgttaaccaaaaatagatgccgcattatttttttcttgctccaaccgatccctcgtcggtctcccaaaaacttcgggtgcccgcatcgagctgctcccctccctcatattttggtgtgagtaatctttccccaatccgagctcccgttcgttctcccgcgtttttttggtaccgcacgtcgcttttgtggatgttgcgcgaagcgacggtggtgagaaagccatacactacgttcgaggatgaggcgctgggagattcaacccgcagaatcagtcgctccaaatgttcagcgcgtatcatgacggaaccgccataccttgcgagaagttgtctccatcggtgacaggctc

SEQ ID NO: 65022 - DNA, 171 bp, Zea mays
  Clone ID: LIB3075-024-Q1-K1-F9
acgactgactacaccaccgcgtcgtcgtctaattaaaaaggatacagagatggccctggggtgtcaacatatggccaggcgagcgcgattcttcgtcgctcgttcttttaatactcgcggatgtatacatgacaatatgcaaggtagtggcggaagagacaactctgactg

SEQ ID NO: 65023 - DNA, 292 bp, Zea mays
  Clone ID: LIB3075-024-Q1-K1-G10
gtcactcactgcatcgttcgttcattcattaactactggaaattatagagccacatctgttggtctgtgaacctgcggggaaggactaacgagtcgaatatgactgcggcggtgctttccgtgcgcacgacgactacttctctgctagcagcagtcatcctgtgcctatgcatcgtctccctctccccccgctgagccgctgtcgcgcggttttccctcggcgccagcccatgacgctcgtgatgcgctctgccttcgacgtctcgttctgcaccgtcagctgcatggagct

SEQ ID NO: 65024 - DNA, 410 bp, Zea mays
  Clone ID: LIB3075-024-Q1-K1-G12
gtgatattcctgaaaagcaaaaggaaaagaaaaggcaggagaataacgaagcaagagctgccgcggctccattttaactggtcggcgcctccgccgctgccgtcttccccctctcccctccgtaccactcgtcttcgtctagcctcccgcccgcagccaccatggcacccggcctctacaccgacatcggcaagaaaaccagagatttgctgtacatggactacaacacgcaccagaagttctccctcaccacctgctcgccccatggcatcgcaatcacagctgcaggaacaaggaaaaatgagtccaccttttgcgatcttcacactcaaatttaagaacaataaattgacggtcgatgtcaaagcgaactcagaatcacatcttgtgacaacaatcactgttgttga

SEQ ID NO: 65025 - DNA, 415 bp, Zea mays
  Clone ID: LIB3075-024-Q1-K1-G9
aaggaaataagcaagtctctccagcaaatgggatatgatgtgatgccttcagatgacgctggtcgatttgtgtgcaactatgtctattaccactcgcttaagtttgcagagaagcatggcatcacgtctctcttcgttcatttccccctcttcctggcaattgatgaggaagttcagatgcaatttgttgcctcccttcttgaagtcctcgcttccttgaacttctagtagtaacctgatggtagatctatctctttcagcggtgtattgttcccaatttatttggaagggtccccaatttacatgtggagtgaataagaatgaggaatcattcatggagttatgtgtgcttcaaaatgtgtaaaaaaatagctcttctcaaagaacatgtccaggcagtccatatgtacaaata

SEQ ID NO: 65026 - DNA, 415 bp, Zea mays
  Clone ID: LIB3075-024-Q1-K1-H10
aagagaacgaggggcagggcagccagcgccgctagctgaagcaaggcagggcaagagaatccgtacgtcgaggtgcaggtcgtaggtaggatggacgcggaccagcagggcgtggttgcggcggcggtgaagccggcgctggccaaggggacgccgtcggcgtcgttccggctccgcaacgggagcctgaacgcggtgcgcctccgccgcgtgttcgacctgttcgaccgcaacggggacggcgagatcaccgtggacgagctggcgcatgcgctggatgcgctgggcctggacgccgaccgcgccgggctgtccgccaccgtcggcgcctacgtgcccgacggcgccgtgggccttcgcttcgaggacttcgacaagctccaccgcgcgctcggtgacgccttcttcggcgcac

SEQ ID NO: 65027 - DNA, 369 bp, Zea mays
  Clone ID: LIB3075-024-Q1-K1-H11
tgaggccgtatacggaggaggaggaggcctttacgacggccgactgcggttcggcgtcggtgcattcctcgaggagggagacgaggccttcgaccttggacttgacgtactccgccgggttcttcatggcataccgcacgtctgtctgcgccgcgaggtggatcacgtgggtgaagggcacgacgtctaatagcttggccagtaagcggccgtccttgatgtctccctccacgacgaaactcatcgtggctggccatcaacgcgcgctgcgcctttttgagcgatgggtcgtagtaggagttgaagctgtcgatgcctaccacacccttgccgcgtttgctgagcgccagcgagcaatgctctcccact

SEQ ID NO: 65028 - DNA, 420 bp, Zea mays
  Clone ID: LIB3075-024-Q1-K1-H9
gtgacctccatgtccaaaagccaccaactgagatcgaagctttgtccatggggagacggcctgaggatcgcaggcgtcgtccatggttcagacggtcactacggatcgaggtgcggtaggtcggggcgccgcccacgattgtaggcttggccgggactacttcgtcaccaacgtcctcggttcaatgttaaacattgtcacacgttctcatatatgggtggaagataaagatttgtccagggttgatggcgaggtatttcaaattgatggccaaaacgcccatgttcgcacaaccaagggggaaggcgggagggcatattgtgacggctaccatggaccgatgttcctgtgtggcggcgacaacaacaccctggaaccaaggcaatgccagcaagctgatttttcagattggaatctatg

SEQ ID NO: 65029 - DNA, 449 bp, Zea mays
  Clone ID: LIB3075-025-Q1-K1-A10
ggacaagtgacaaatgaatctgtttgaggcttgcttgaatccagattcattggatggacaagtgacaaatgacctgaagaaagctggcagccttagattttacaaaccaaaattcaaatatattttttgtgatatggatggtacgctgctcaacagtaaaagtcaagtttcagcaaggaatgcagaagctctaagggaagctaggtcaagaggagtaaacatagttattgccactggaaaggcacgtcctgctgtaatcgacgctcttagtatggtggacttatctggaaggactggtattgtttcagaatcatcacctggtgtattccttcaggggcttgtggtttatggtttggaagggagacggatttataaaagaaatttggaccaagaagtatgtagagaggcactctcatattctatagagaacaagataccattagtagcat

SEQ ID NO: 65030 - DNA, 403 bp, Zea mays
  Clone ID: LIB3075-025-Q1-K1-A11
cacgacaagatggcgtgcacagacaatgcgatgagagccttgttcctcctggtcctcttgtgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcattggcgtgcggcggcacttggaagcagacaattctcatacccaagggcgactttcttgtcggacaactcaactttacaagcccttgcaagggcgacgtgaccatccaggtggatggcaatcttgtggcgaccacggacctaagccagtacaaggaacatggtaattggatcgagattctacgcgtggataacctggtca

SEQ ID NO: 65031 - DNA, 422 bp, Zea mays
  Clone ID: LIB3075-024-Q1-K1-D10
cccacgcgtccgcccacgcgtccgaccttaccaactgcaagctgcgctgcactctggatgggcacggtggctatgttaacgccgtctctgtgagccccgacgggtcgctgtgcgcctccggcgggaaggacggtgttactctgctgtgggatttggctgaggggaagaggctgtactcgctggacgcgggctccatcatccactctctctgcttctcacccaaccgctactggctctgcgctgcgacgcatgactctgtcaagatctgggacctcgagtcgaagcacgttgtgcaggacctcaagcccgacatccaggtctccaagaaccagatcctgtactgtacaagcttgagctggagtgcggacggaagcaccctctacactggctacaccgatgggtctatcaggggttggaagatc

SEQ ID NO: 65032 - DNA, 359 bp, Zea mays
  Clone ID: LIB3075-023-Q1-K1-G4
ggaaggccttctttgcttctggctctgtcgcattctatgtgttcctctactctattaactacctggtgttcgatctcaggagccttatcggaccagtttctgccacactctaccttggctattccctgatcatggcccttgcaatcatgctctccactggctccattggtttcctgctctccttctacttcgtccactacctcttctcgtctgttaagattgattagaggtgtgccccgctgcctctttctgcaatagagtcatctgatcatggttataggtaccctcttagaaatactacactatatatcaaatggataaaatggatacatggcaacgcccattgcttttggtcattg

SEQ ID NO: 65033 - DNA, 322 bp, Zea mays
  Clone ID: LIB3075-023-Q1-K1-G5
tagaatgaactgaaaacatcctatcgatctactttagctatacctctgcgatccattggggagcgcaacgaatgttacatgggcgaccgggcagagatgtcgcgacaggcttacgattgctatcacctgttttgcaagatctatatgccaccacctctcggcatcatgcatattcgttcacgacagctacggctgttcgcatatctcggcgttacactagttgaagaccatggacatggtcaacatcacaaatgtcttagacgagccatagcacctaacgccgactggtctgttaatcggacctactaagtacatggtgata

SEQ ID NO: 65034 - DNA, 267 bp, Zea mays
  Clone ID: LIB3075-023-Q1-K1-G7
tgacagaatataacatcctgatgaagttatttgcatatgccatcgacttgagatcaggatgtagcacaactgagaaagtaacttcctcaggatgtttcaatgacagaatataacaacattgcttaacaatttttatcatatgagtctgatgtttgtcagcttccaattcacatttcttgctaggcttaagtatatgcttccttgtacaacaaatcatatgatgcaagggattcaactgtcgatttacttggatcgtacattcaattt

SEQ ID NO: 65035 - DNA, 414 bp, Zea mays
  unsure at all n locations
  Clone ID: LIB3075-023-Q1-K1-H1
tcgggatgtttcaatgacagaatataacatcctgaggaagttatttgcatatgccatcggcttcacatcaggatgtggcacagctgagaaagtaacttcctcaggatgtttcaatgacagaatataacaacattgtttagcaatttttatcagatgagtctgttgtttgtcagctcccaattcacatttcttgctaggtttaagtatatgctcccttgtacaacaaatcaaatgatgcaagggattcaactgtcgatttacttggatggtacatccatttttgtgcacgagttgtgattcttgtaactatccgtaaagtcttagatcattagattntagtttacttgtaaaattgctaaatcgtcatttcctgtcttgcttatcagtgaggtacacacgtttagtgcttttatc

SEQ ID NO: 65036 - DNA, 293 bp, Zea mays
  Clone ID: LIB3075-023-Q1-K1-H10
gttggaaagcatgattgaccatcctactcccactagggcagaagtttctgacatagctattgcagttcgggaaggtgctgatgccatcatgttatctggcgaaactgctcatggaaagtatccactaaaggcagtcaaggtgatgcacactgtggcactcagaacagaatccagcctttataacccaactacttctcctagtcttgttgcatctgcacagggtctacagaatgaggacttctccgcaagccagctaagtaaaatgttcggatctcattgcaacgttgatggcc

SEQ ID NO: 65037 - DNA, 414 bp, Zea mays
  Clone ID: LIB3075-023-Q1-K1-H11
acgcccacgcgtccgaacacacggaaccagaaagcatacgcaaacaagaagcaaaccaggaatggcccgcgcctgcgtcttgctcgtcgtgctcctcctagccgccgtcgccatggcgccgttcgcgggcgcggcgcgcatagacgtcgtcgagggcaggtccatggcgtccgcagacgcaccggaggccgccgacgacgctcccgctcctgctcctggccccgactccttctcgaccccgttggcggcacccttcagcagcagctcttccgactagccgcccggcagagatatctacggcgtccgatcagtctttggcgccacctataacctatcgcatcctgcaaagctatatatgattctatggtataatgtgtggttgcggcaaacgcgcggtaataatgtgcttgcggg

SEQ ID NO: 65038 - DNA, 191 bp, Zea mays
  Clone ID: LIB3075-023-Q1-K1-H12
ccagacaacagctactagatgaaaacagtttcctcgttataactcctgtcctatcgtactgtggacgggagaaatctggcccttataagtcttgcagcttgttgcccgtttggcaatgttgcatttgcggacaggcgttatgttttcaatgcatgtacattaaattcaatatggtctggtcacaacttttc

SEQ ID NO: 65039 - DNA, 357 bp, Zea mays
  Clone ID: LIB3075-023-Q1-K1-H3
cggacgcgtggggaagcgcgaacgcgtgcatgcgcagacgttgaggtcgagggacacggtatctctgagcttcatcagagagcgacccgtcaccgtcacgcttggccgcaagccgagaagagtgccgggccgggagaccggacgataattgatccgtagcagattcgctaatggcggagacggcggacatggagcggatcttcaagcggttcgacaccaacggcgacggtaagatctcgctgtcggagctgacggaggcgctacggacgctggggtccacctctgccgacgaggtgcagcgcatgatggccgagatcgacaccgacggcgacggcttgatcgacttcaacgagttca

SEQ ID NO: 65040 - DNA, 324 bp, Zea mays
  Clone ID: LIB3075-023-Q1-K1-H8
tcgctcctatggaaaaagaagagcagccaagtaaaccgtgggaatgtttttttgttgttgtcttgtgttcgatggcaacacccaggtcgtgaaggcaatcgagaacgcgatccccgtgcggcacgcgctgcccgccgccgtcgtcgcggagatcgaccccgcgtgggaggaggagctgagggccatggaggcggagaaggcggagatcgaccgggcggcggcggcgcgggtgcggcgggagctgtggtgcgggctgacgtacctggtgatccagacggtcgggttcatgcggctcaccttctgggagctgtcgtgggacgtgat

SEQ ID NO: 65041 - DNA, 262 bp, Zea mays
  Clone ID: LIB3075-023-Q1-K1-H9
gagaaacctccttggcgtatgcatgggctgactgtgtgggttggcggtcgcgggactggctggtggcgagtgaattgattccgatgtcaggacctcgccatagatccgccgtgcgtcgtgggcagccgcgattttcgcctcaaatgctgtgaggtgtcgtgtcacctgaggatcatcctggtacctggaatctcaagtcccaggagatgaacaggtggttcatgtggagccacacatcgtggagttcgacttgatctaggtg

SEQ ID NO: 65042 - DNA, 274 bp, Zea mays
  Clone ID: LIB3075-024-Q1-K1-A10
cggacgcgtggggcatagttcataccagctgtagcgctactgcagatttgccttcatatgctattagttcgtaagacgaatgctatattcatttcccacaactcttcaaaaagaatctagatatttttttgtcatgtacgtgcagactggaatacaattttgtatagtcgttcatgaaccggtgaaaaatatattttttaatacatttggctaataaagaattattcatattagtttctttttattttctataaaacaaacataatagatattt

SEQ ID NO: 65043 - DNA, 264 bp, Zea mays
  Clone ID: LIB3075-024-Q1-K1-A11
tcgcgcacgcgttgctcaaagttcacacctactttaatgctaactgacttatgcctaggggcgcccttaacacgtatgaggacacccttctctataacccacaacccatcctaagaactcacttttcctaatcattacacatgcagacttcaacccaaacgacttactgtctaccagtgaacctgacaaaaatatcacaatatcctgaaccttaatgaccagaacgatgcatattacatcatctttaacatgaatgtgcacaac

SEQ ID NO: 65044 - DNA, 306 bp, Zea mays
  unsure at all n locations
  Clone ID: LIB3075-024-Q1-K1-A9
cccacgcgtccgcccacgcgtccgcccactcttccggaatcatcaattaccaattcatttgctcggaattgttcaattaatgtatgtttctaatttaccttaaagttgattttctttcattctttgcatatatatgttgtcagatatttgctccacacttatattattctgatatctagttactagtagctatgcaactcaattttcaatcacatgattatgtatagttgtcttcttgtgttttagcacctttgataactgaagcacacttgaaatttgattcctttntataaaaataaaataaaa

SEQ ID NO: 65045 - DNA, 288 bp, Zea mays
  Clone ID: LIB3075-024-Q1-K1-B10
tccacgcgtccgcccactcgtccgtccactcgtccggaatcatcaattaccaattgatgtgctcggaattgttcaattgatgtatgtttctaatttaccttaaagttgattttctttcattctttgcatatatatgttgtcagatatttgctccacacttatattattctgatatctagttactagtagctatgcaactcacttctcaatcacatgattatgtatagctgtcttctcgtgtattagcacctttgataactgaagcacactcgaaatttgtattcccac

SEQ ID NO: 65046 - DNA, 266 bp, Zea mays
  Clone ID: LIB3075-024-Q1-K1-B11
tccacgcgttcgcccacgcgtacgccctctcgttcggaatcatcaattaccaatcgattggctcgcaattgttcaatggatgcctgttcctcatttaccttaaagccgattttctttcattctttgcatatctacgttgacagatctttcctgcccacttatattatcctcacatccttttactagtagctatgcagctcacttctccatcacatgcgtgtgtatacatgtactctcgcgctctagcgcccttgataactaaagca

SEQ ID NO: 65047 - DNA, 284 bp, Zea mays
  Clone ID: LIB3075-024-Q1-K1-B9
cccactcgtccgcccactcgtccgcccactcgttcggaatcatcaattaccaattcatttgctcggaattgttcaattaatgtatgtttctaatttaccttaaagttgattttctttcattctttgcatatatatgttgtcagatatttgctccacacttatattattctgatatctagttactagtagctatgcaactcaattttcaatcacatgattatgtatacttgtcttctcgcgctttagcacctttgataactgaagcacacttgaaatttgattcc

SEQ ID NO: 65048 - DNA, 401 bp, Zea mays
  Clone ID: LIB3075-024-Q1-K1-C10
accggaagcatcagccatgtcgaactcggcgtcgggaatggccgtctgtgatgaatgcgggctcaagttccaggagctcaaggcgaataggagcttccgcttcatcgtgttcaagatcaacgagaacgtgcagcaggtggtggtggacaggctaggggagccaggcgagagctacgacgccttcacggcctgctttcccgccaacgagtgccgttacgccgtgttcgattttgacttcgtcactgacgagaactgccagaagagcaagatcttctttatctcttgggccccggatacatcgagggtgagaagcaagatgctgtacgcgagctccaatgaccggttcaagagggagctggatggcattcatgtggagctacaagcaaccgacccgagcgaaa

SEQ ID NO: 65049 - DNA, 373 bp, Zea mays
  Clone ID: LIB3075-023-Q1-K1-G3
cggatggaagggtctgaagctgttcctggactactccggcaccaccgggcgcaggaaagcggtggccaccccacgtggcgccatggcggtgggcatgtccagccgggacgcgtgggcggcggcgtacagcggggtcgccgccggggctgccctcgtcactggcatcggcgtcatggcgtacctgcgaagatctgcctagctagtgtggtggcgcggcggcgcggcgcgcatattcgccaatgcaagagcaaggggttcctgtcctgccttcgaatcaccacagaggtgctagtatgtgtggattacgtacccaaccggtgtatgtgtgtattctcttctacacgaacatgtaccatggcacaaagtttccatt

SEQ ID NO: 65050 - DNA, 416 bp, Zea mays
  Clone ID: LIB3075-024-Q1-K1-C11
cggacgcgtgggcgcgcgctgacggcgagcacggcgccgatccccggcgcgacggtggagaacaacaagttctgcctgtgcgtccacttccgctgcgtccaggaggagaaatggcgcgctctggaggagcaggtccggtcggtgctcaaggagtacccggacctccgcctcaccaagggcaggaaggtcctcgagatccggccgtccatcaagtgggacaagggcaacgccctgcagttcttgctcgagtctctcggttttgctggcagtaacagtgtcttcccgatatatatcggagacgatagcaccgacgaggacgcgttcaaggtcctgcgcaacttggggcaagggatcgggatcctggtgagcaagattccgaaggagacccgcgcatcctactccttgcgtgaaccttc

SEQ ID NO: 65051 - DNA, 81 bp, Zea mays
  Clone ID: LIB3075-024-Q1-K1-C12
attagaagtatttctaataatatttaggatctgtcatcaataaaatgtatgcaacaatacgactattgtattattttgtct

SEQ ID NO: 65052 - DNA, 202 bp, Zea mays
  Clone ID: LIB3075-024-Q1-K1-C9
aaaagactgcactgtatatagttttcctaacatattgcaagtctttcaccatctcgggtgcgctcaatgtgatgcgcgcgggccctcaaatagatggccttctcagccactattattcaaggaatatagccttcgactgcacatatctacacgatcatctccatcttctccatcaacactttcaggaaagggatgtccaacc

SEQ ID NO: 65053 - DNA, 194 bp, Zea mays
  Clone ID: LIB3075-023-Q1-K1-E4
atatgttcgagagcactgcatcctttggttccaacggcattgttgattttgggtggggccgatcgatccactcttgcttgaggcttgtgcagttgaacacacgtcgactcaagctgcatgctagcgcacaccgtctccgtttagacgagacccgtccatggggttcgcatccttcagctatgcgcgccgcgaca

SEQ ID NO: 65054 - DNA, 217 bp, Zea mays
  Clone ID: LIB3075-023-Q1-K1-E5
gttgaaagagcgagtactcgcagttgactcgcactctgcgtgcccgaatctgtgccgcggtccggatcagaactaggtgttgaggcgatggcaagcgtaagcaatggctcttggagcatctaatcaattcttgccgaatcactagaggccgcagatgtcaatgctacgcttcacattcgttgcgcgaacgactgcaagttcactgggcatacggacc

SEQ ID NO: 65055 - DNA, 352 bp, Zea mays
  Clone ID: LIB3075-023-Q1-K1-E6
tcgacaaggcttacctgcatcgccgacgtgcgcgccagcgctgcccagcccgcgcagatggaacgcacgcaggaagcgaaggttgtgaagctgcgggcggtggaggccacgcccgagtgcttcgcttcgctcgggcacgtcatcggcgccttcgccgacagcgacgagttcgggccccacgacgcccatctcgatctcagccgcggcatacgaaggttctacatcatgcggttgcagaaccggccgctgaaattctctaccatcacccaccacgccagcgtgacccagtgcctgggctccgtcggcgggcaggactggtactctggggtggccaagccgtcgatcgtggatg

SEQ ID NO: 65056 - DNA, 379 bp, Zea mays
  unsure at all n locations
  Clone ID: LIB3075-023-Q1-K1-E7
gctccagctccaaaggcgctcgtcttcctctgccacggctactccgtggagtgcagcgtgacgatgcgcggcaccggcgagcgcctggcgcgtgccggctacgccgtctacggcctggactacgagggccacggccgctccgacgggctgcagggctacgtgccggatttcgacgcgctggtgctggactgcgacgagtacttcacctcggtggtggcggcggcggcgcagtcgcagtccaaggacgcccaccaacttccccggttcctgctcggngagtccatgggcggcgccgtggctctcctcctccaccgtcggcgccccgagtactggagcggcgccgtgctggtggcgcccatgtgcaagatcggcgacgaca

SEQ ID NO: 65057 - DNA, 231 bp, Zea mays
  Clone ID: LIB3075-023-Q1-K1-E8
tccacgcgttcgggcctcgccattatccagcttcgagagcactggatcctttggttccaactgcattgtggatttttggtgccgttgatcgagccacgcgtgcttgaggcttgagcagttgaacacgctgggactcatgctgcaggctagcgcacacccgcgccgtctcgacgtgacccggcgatggggtgcgcaaccttcaccgatgcgcgccgcgacatggtgcggacc

SEQ ID NO: 65058 - DNA, 365 bp, Zea mays
  Clone ID: LIB3075-023-Q1-K1-E9
cggggcgtctgtcatcatgggcgtttctccgggacccctgtccgtgctgtagcagctgtgcatcaccaagttctcctactggctcaccccattcacggaccacaagaccagcccggtgatgttcggcgccatggccgacctgggcaagtacaaaaccacggtgaaggtgcagactatcccgctgctgaagaacccggtggaggacatctactactacgtgcccatggtgggtatctccatcgggagcaagcggctcgacgtgcctgaggccatcctcgcgccgaggcccgacagcacctgcggcacggagcttgactctgcgaccacactggcataacctgtggagccggctttcaaggagctga

SEQ ID NO: 65059 - DNA, 97 bp, Zea mays
  Clone ID: LIB3075-023-Q1-K1-F1
agtgctgcgccgctgtgtgctgctgcattcattacgacatggacgatgtcgcggttctatccacagtgcgcgctccctctacgctgtgccggaaggc

SEQ ID NO: 65060 - DNA, 150 bp, Zea mays
  Clone ID: LIB3075-023-Q1-K1-F10
tcgctcatggtggaagtatgggaccatgatacatttggaaaggattacatatggaggggcatcttgacactgacgagagctatactacaatgtgaattccaagatacctttgtcttgcaaggtgccaaatcggtaaaactaaacttgcat

SEQ ID NO: 65061 - DNA, 347 bp, Zea mays
  Clone ID: LIB3075-023-Q1-K1-F11
cgaaacaagcgcacaagaaaaaatacctcgccgccaacaatggcctccatgtcctccatcctgctcgcaacggcgatgctggctgcgctgtttgcggttggtttgtgcaccaccccgctcaccttccaggttggcaagggatccaagcctggccacctgatcctcacccccaatgttgcaaccatatccgatgtggaaatcaaagagcacggtggcgatgacttctcctttacgctcaaggagggaccgaccggcacctggacgctcgacaccaaggcctcgctcaagtaccccctttgcatccgctttgctgtcaagtctggtggctaccgcatcgtcgacgacgt

SEQ ID NO: 65062 - DNA, 308 bp, Zea mays
  Clone ID: LIB3075-023-Q1-K1-F2
tcgacgaggactaccggaaggacaagctccggctcgccaaggaggctgagctgaacaaggagcttgagaggcggctccgcgaggagcaagatcgggagagggaacgcgagcagcgggagagggaggcccgcgagcgcgaggagaaggactaccaatccagggccttcttcctcaacatattcggcgaggaggcgtggaagaggagggcagcgatgagcggtagcggttctgctgctagaaccccatcgttcccacctcacggtgatggcttcgccattgggagctcatcttctgctgggttgggtgtg

SEQ ID NO: 65063 - DNA, 338 bp, Zea mays
  Clone ID: LIB3075-023-Q1-K1-F3
agcagttctaatctcacagcatgctaaacatcacggagcaagcctcactgatcgtgcttctcgacatggtggccctgctgtacgacgatctgctgacgcaacccctgcataaggatagggaaggcagcgaacacgatgacaccgtctacccatacatcgcctgcatctgctctataaccccgttccaggaggtgtacacgttcaccgccatgcgggacacgtgcaattacgctatcatcgacaacctggcacgtctgaacaatcacttggacacgttcagcatacgcaccgctcaggcgcgcatgcacgtcgcgaggccgatcactaccatcccgacg

SEQ ID NO: 65064 - DNA, 382 bp, Zea mays
  Clone ID: LIB3075-023-Q1-K1-F4
tgggtaacaagtatcagagcaagcttctcgaggtgattgatgctagtgagttgccagaaatttttggtggaacctgccgatgtgaaggtggttgcatgaaggctgacaaaggcccttggaaggaccccgaaatcatgaagatggttcaaagtggtgatgggaggtgtggatcactcggtacggcctctttcgaggctccggagaaaatgatttgtgaagacgacacgtatcctaagaaacaagctttgtttgatggggaaacacaattagctggagacgagcattctcagtcacagaaaatttcccgtggccggattgaacattctcacgtgtcacctcttcacgaggaacttattcccacttcaattcataccccttgatc

SEQ ID NO: 65065 - DNA, 411 bp, Zea mays
  Clone ID: LIB3075-023-Q1-K1-F5
cagtcgtctccgtctgagagtgagactgagaccgacagtagcagcggagaatcttcgtcgtgtcgtcgtcggaggaggaggaggccggcgagaaggagaaggagaaggagcaggagatggagaaggcggtcgcggcggagaaggctgcccagcaggagctgctcaagtacgccaaggagaagggcatcgtgtcaccgaccaacggcacggggtggtacaagggcatcgcccgggagttcgtggacgcccacaacgagctccgcgcgcgctacggcgtgcctgccatgaagtgggacaggaagctggcgcggcatgcgcggcgctggtccaaccgcatgcgcaaggactgcgagctcgtccacagcggccacaagtacggcgagagcctgttcaggagccacgacgactgga

SEQ ID NO: 65066 - DNA, 333 bp, Zea mays
  Clone ID: LIB3075-023-Q1-K1-F7
tcggatgaggccgaccaactggccaaaaggctgtgacgagctacagaggaagctctccgactaggtgaaggtgaggaacagggcggtgaggaagctcaggagggccatcaggaagctggagtccctcaaggttctggacgtctgtctctcggactgctccaccggatcgctttccttcaactgacgctccggtcaccagtcgccgtaggtgtaagactctgcgtaggccgaggataggaacggtcctggctcgttgaccaccgatggctctgcgccatgcgctccttacagagacgccgacatggacgtgtcgtcagagggatcgtgcaccca

SEQ ID NO: 65067 - DNA, 374 bp, Zea mays
  Clone ID: LIB3075-023-Q1-K1-F8
tcgcctgcaagcaaggatggttctttacgcaatgtattagtgatcctgagttaaggggattgaggaacattatctgtttatcaatcaagaggatggacagctctgagtgggagaacattcctgtcccatcgagtgtgaaggcaatcgttgcattaaatcttcacaattatgcaagtggaagaaacccttggggaaatttgaagcctgaatatttggagaaaagaggatttgttgaagcccaatcagatgatggtcttcttgagatatttggactgaagcaagggtggcatgcatctctcgtgatggttgaacttatatctgccaagcacatagctcaagcagcggcaatacggatagagatcaaaggtgggtat

SEQ ID NO: 65068 - DNA, 311 bp, Zea mays
  unsure at all n locations
  Clone ID: LIB3075-023-Q1-K1-F9
acgcagctccactcctaactccagcgaccaccgcgtccccaccatggccgctcgccggagcactagccccgcccggcacggcgtgctccccgccctccttctcatcctatgctcgtccctcccttccctcgccgccgcataccgcccaggcgacatcgtcccgatgctccgctcgggccagtaccacggctcgaggtcggtgtggttcgacgtggtggggcgccattgcccggccttcgcggtcaaccgggaggtgctgatgccgatcccaaagcctacggngttcactggtgctgatccgtacaagataa

SEQ ID NO: 65069 - DNA, 363 bp, Zea mays
  Clone ID: LIB3075-023-Q1-K1-G1
ttccagaactggctttgccatctcttctaaagccacatcagcaggaccactggtttcttcgaattgcaagagggttgttgtgagggcaatgtcgcagagaggtgcccaaggacttcccattgatctcacaggtaaaagagcatttatagctggagttgctgatgataatggttatggttgggcaattgctaaggctcttgctgctgctggtgctgagattcttgttggtacatgggtgcctgcgttgaacatatttgagacaagcttgagacgtggaaagtttgatgaatcacggaagctacctgatggatctcttatggagattgctaaagtatatccactggacgcagtttatgacacccc

SEQ ID NO: 65070 - DNA, 352 bp, Zea mays
  Clone ID: LIB3075-023-Q1-K1-E3
gttcagcttgatccaggacgaagggaacggtgagccgccatggtgaaggacagcgcgtactacgacgtgctggagatcagcactgacgcctccatggccgacatcaagaaggcctattacctcaaggccaagctggtgcacccggacaagaatccgggcaaccctgatgctgcgcgcaagtttcaggaactaggcgaagcctatcaggtcctaagtgatccagtgaaaaaggagtcatacgataagtatggaaaggaaggactttcacacgactatcttgaagattatgttggccaacttgcgctagcatctgttgcctctgtagagattgaggaagaatcaaacacacctg

SEQ ID NO: 65071 - DNA, 334 bp, Zea mays
  Clone ID: LIB3075-023-Q1-K1-G11
tcgcccacgcgttcgtggacgcgtgggtcaattgtagaatctagttaaaaattgggacggtacaaaatctcttgtgcatgggaggtcataccaaaggaagcttggtgtcctaaagggtggagcacctccaacagtggataaaccaaatcgactatcaccagcatttacaggaagaagttcttgacaagataaatttcatcgttcaagaaacatgttcactatcccacatcgttcacgtgttcgtggaaggtttccagccttcaaatatgtaacttttgcctttgagaacacgagctattccatgaaaccttttcaccccttcccccctgttgtg

SEQ ID NO: 65072 - DNA, 190 bp, Zea mays
  Clone ID: LIB3075-023-Q1-K1-G12
tcgcactttctcgctggcccataaatatatatctatctatcgccatcgatcaattatgaggtcacagaataataaacatgggggggcaagcctcacggctcgtcctcctctccgtcgtggtgctgttgtacgccggcctcctcccgcaagctctgggtaagggtatgggaggcatgggacaccgtgggcg

SEQ ID NO: 65073 - DNA, 316 bp, Zea mays
  Clone ID: LIB3075-023-Q1-K1-G2
cggactcgtgggcaagatgggaaactgcgaatctattccatcagtggcgatacactcacagaagaagctctgcttgagaagcaccggggtgctatcacttccatacattattcgccagatgtttctatgtttgcttctgctgataccaacagggaagctgttgtgtgggatcgagcaagtagagaggtcaagctgaagaacatgttgtaccacacagccaggataaactccctggcttggtcacctgacagtcgattggttgccactggctcactggacacctgggcaattgtctacgagatagacatgccgggtt

SEQ ID NO: 65074 - DNA, 318 bp, Zea mays
  Clone ID: LIB3075-023-Q1-K1-C9
gcctgctgcaaatcagagcatgggtgcttgcgcgcgtaccattcaatgacactcgatcacacatattgtgaacggagtacgtggccactacatggtatgcagctccagaatcatgtgtctcctttttttcaaagtacactacatccattgatattatgagcaggaggggcatatctgctgaattagctacagtgaagccactctttccagggaagaatgttagtgcatcaggtggatcttatgactgatctactagctacaccttcagcatagtctatccgcatgataaggcatgagaatgctcgacgatgcatgaac

SEQ ID NO: 65075 - DNA, 468 bp, Zea mays
  unsure at all n locations
  Clone ID: LIB3075-023-Q1-K1-D1
caggacaaggagggcatccctcctgaccagcagcggcttatcttcgccggcaagcagcttgaggacggacgcacacttgctgactacaacatccagaaggagtcaaccctccacttggtgctgcgccttatgggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctncacttggtgctgcgtcttatgggtggaatgcacatctttgtgaaaacccttactggcaagaccatcactnctgaggtggagtcttcagataccatngacaatgtcaaggccaagatccatgacaaggag

SEQ ID NO: 65076 - DNA, 380 bp, Zea mays
  Clone ID: LIB3075-023-Q1-K1-D10
gagagaaagagcgggaatggaggaagaccggagtggagaaagcgccgccgccggtgaaacctccggcgccggtgttccatcctctgtgcgtagtcgcgtgggtgcgccaacgtccgggggaatccgtccgtgccttcggagcgggctgggcgaccccgaatcgggcggaattccacgccggtgaacgtgccagagcagaactacctcctccccgtggtcggctcgctagcgcagacaatccccggagaagaacaggtggttcaagaggagccacacatcgaggagttcgattcgatctaggtggcatctcccagttgactttttgacgccaaggatggtatttagatattggtatatttatcttttattttgtaaaactt

SEQ ID NO: 65077 - DNA, 433 bp, Zea mays
  Clone ID: LIB3075-023-Q1-K1-D11
caaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtcgttggcatctacgacgagccgatgacgcctgggcagggcaacatggtggtggaaaggctgggcgactacctgcttgaacagggcatgtaactactacgtaccagctggaatgcatgtcgacg

SEQ ID NO: 65078 - DNA, 150 bp, Zea mays
  Clone ID: LIB3075-023-Q1-K1-D12
cgtcgagcgccttgcctcggcacccacttcgtcctcctactcctcggcgccgctcgtcggtggtgcgtcgggggaccccgcggttgctgaggaggtgcggcgagaggtggcgcacatccaggggctgtgcgcgcagatggaccgactctg

SEQ ID NO: 65079 - DNA, 205 bp, Zea mays
  Clone ID: LIB3075-023-Q1-K1-D2
gcaccatgcaatgctctagcgacctgaattgaatgctatcggataagcgcatgtacgtttgtgcgtaagggtataacagcataggtaatgtaacgagtgtgtgcacatgtaacatgatgaccgagaagagaaacatgcaaatggagaaggaattggttctgcctttctaacaaaaatataatataaaaaggaagaacaaataaaa

SEQ ID NO: 65080 - DNA, 213 bp, Zea mays
  Clone ID: LIB3075-023-Q1-K1-D3
gaacttttacgctaggtcaatctataagagcgttgtgaatctacatggatcagccaaaaatttaccagcttcatgtacctcaaagccaaagcaatcacctgagctgtgtatgttcccacagtatgttgtcccgacaatgcgcacaccattgttcatacttaatgcagcctacgattcgtggcaggtcaagaacgtcctatcacctagtccagc

SEQ ID NO: 65081 - DNA, 326 bp, Zea mays
  Clone ID: LIB3075-023-Q1-K1-D4
gttctagatcgcgagcggtcgccctttttttttttttttttttttgctgattgctgaatacagtacatatacttggtttgctatcgaccttccgcggcaattattctctacaaactcttggtctcagattcatacaagcttggaaataaacaactaaccaacatataggtaagaaacaggatggttcacagtccccgtgaaagtccaagaaatacaacagccgaggacatctgcactttaagatctgcgatatcaacgtcatgacctcctttcaccaagccccatcgatcaacctggtggtcttcttcaagcctgatcaactcaat

SEQ ID NO: 65082 - DNA, 189 bp, Zea mays
  Clone ID: LIB3075-023-Q1-K1-D5
gttcattatctcgttcttatttatgacgaatgtcatgtatgttctggtgactgtcatgtatattctgatgactgtcatgtatcttgttcatgtatgctcaaggttcattatcttgttcatgtattaagtatgttatgaataactcaatatttattattttgctcaaaaataaaaaacaagaatgaacac

SEQ ID NO: 65083 - DNA, 379 bp, Zea mays
  Clone ID: LIB3075-023-Q1-K1-D6
gcggctctacgatcgcgagctgtggccctgcgacctgaattgaatgcttgctgattgctgaatacagtacatatacttgggttgctatcgaccttccgcggcacttattctctacaaactcttggtctcagattcatacgagcttggaaataaacaactgaccaacatatacgtaagaaacaggatggttcacagtccccgtgaaagtccaagaaatacaacagccgaggacatctgcactttaagatctgcgatatcaacgtcatgacctcctttcaccaagccccatcgatcaacctggtggtcttttttaaaccctgatcaactcaatggcctcctcgatacccaaactttctttaaatattggaagagggatcac

SEQ ID NO: 65084 - DNA, 306 bp, Zea mays
  Clone ID: LIB3075-023-Q1-K1-D7
tcgaccggcctcagtgggcggtaacatccgagatgaacacaccagcaagacgctcaagctctaatatttccatataacgcgactttcaaattcttgccatgcatcagccttcatcttctctctctaaagcaccctcttaagcttctcagtggatactgcacccaatgatggctaccttgtgccctatgaagaatggtatacttctaactgaagtatgagataagattatcctcctctccacttataaaagctactcatacatgaatgactacaatgtgccaaattctaaaacattactcgactttg

SEQ ID NO: 65085 - DNA, 382 bp, Zea mays
  Clone ID: LIB3075-023-Q1-K1-D8
tcgatctatggtcagctatgtcaggatgacatgcctatggtcagaagagcagctgcatcaaatcttggaaagtttgcagctacagttgaacagaatcatttgaagacagaaataatgtcaatatttgatgatttaacccaagatgatcaagattcagtgcgtctgttggctgttgaaggctgtgctgcccttggtaaattgttggaaccacaagattgcgtagcacacattcttccagtcattgtcaatttctcccaggataaatcatggcgtgttcgttatatggtcgccaatcaattatatgagctctgtgaggctgttggccctgagcctacaagagctgatttggtgcctgcctatgttcgcctccttcgtgataatg

SEQ ID NO: 65086 - DNA, 430 bp, Zea mays
  Clone ID: LIB3075-023-Q1-K1-D9
gtccaacatggtgacggcgcaagggcggacagaccccaacatgcccacaggcatcgtgctccagggctgccgcatcgtgccggagcaggcgctcttccccgaccgcctccagatcgccacctacctcggccggccgtggaaggagtacgcgaggacggtggtgatggagagcaccatcggcgacctcatcaggccggaagggtgggcggagtggatgggcgacctcggcctcaagacgctctactacgccgagtacgccaacaccggcccgggcgccggcaccagcaagagggtcaactggccaggctaccacgtcatcggacaggccgacgccacgccattcaccggcggcgccttcatcgacggcgcgtcatggctgcagagcaccggcacgcccaacgtcatgggattcaccaaagggtaatgatcg

SEQ ID NO: 65087 - DNA, 447 bp, Zea mays
  Clone ID: LIB3075-023-Q1-K1-E1
gaaacagctcatctcatgagggatatgtattacaaaaggaacccaccagcaagaggttcaagctctaatatttcagtaaaaagggactttgagatgcttgccatggatgagcatgcatctgctttctctagaggacctgctgaagcttttcagtggattgggcacccaatgagggctaccttgtgccgtatgaagagtggtttaattttaactggagttggagataagattctccgcctttggtctgctgaaagctgcaaattcatgaatgagtacaatgtgccaaattctaaaacattagtcgactttgattttgatgaaaataagattgtaggtttgaccagctcccagatttgcatatggagacgcagtgaaccaagaggcatatttcaatctggtggagcctcattcaatcattggttatgcatgagctttgctgatccggag

SEQ ID NO: 65088 - DNA, 314 bp, Zea mays
  Clone ID: LIB3075-023-Q1-K1-E10
tcgcccacgcgtccggaacgccatagctcagctgagagagagaacagaagggaggagagagggcgtcgccggcgaccttcgctccggccttgatgtgggtgcccacttcctcgctgggcagtgccgagcgtacaccgagaaggtcacgctctcgccggtcaagtctggaggacgagctgctcagaatgcgtcgtcggcattgagagaagtcatgggctcctacacaaatgcaatccgccgtcgtctacgtctcgaccaacggtaggaacaatgccctgccgtgcgccgcattcgccacttcgatgtgggcgaac

SEQ ID NO: 65089 - DNA, 438 bp, Zea mays
  Clone ID: LIB3075-023-Q1-K1-E11
cgcgtgacagcatgtgggagcaaagttgggaaaatggatatcgtcggtggtccggaggttggtcctctaagatgttggccaggtggtttgtgtctatctagatccataggggatcttgatgttggtgaatgcatcattgctgttcctcatgttaagcaagtgaagctttctaatgctggaggcagaattatcattgcaagcgatggtgtgtgggatgatttgacttgtgaaatggctcttgattgttctcgtgggttctcatcagatgtagctgccaatcgaattgttaatgaagcaacccggcctcgtggaatcagggatgatactacttgcatcgtaattgacattctaccaccataaaatatagtcccgagtcctcgtaagagaccccgcaggattacattcaataatgggtttcgcataagacatctagacgtc

SEQ ID NO: 65090 - DNA, 391 bp, Zea mays
  unsure at all n locations
  Clone ID: LIB3075-023-Q1-K1-E12
ctagttctagatcgcgagcggccgcccggatctagagtcgagaagctcttcgagatggaccctgattacacagtgcttgcgtttgctgacatgatgaggaagaagatcacgatgccagcccatctcatgtacgacggtaaggacgacaacctgttcgagcacttcagcgcggtggcgcagaggctgggcgtctacaccgccaaagactacgccgacatcctcgagttcctggtccagaggtggaaagtcgcggagctcacagggctgtctggagaagggagaagggcgcangactttgtctgtaccttggcgccgaggatcaggcggctggatgatagagctcaagcgagggcgaagcaagcaccggttattcctttcaattgggtttatg

SEQ ID NO: 65091 - DNA, 380 bp, Zea mays
  Clone ID: LIB3075-023-Q1-K1-C8
cctgaacttgtagggaggtgttcaattgttcgtgagcttcatgtctatggaactgcagtccctgtgcatggccgtgatgtagacaagctacagcaccaggggtatggaactctgttaatggaagaagcagaaaggattgctcaaaaggagcaccgttcaaagaaattggctgtcatttcgggggttggtactcgccactactaccgcaaattgggttatgagctagaaggaccttatatggtcaaatgtttggcataataccgtttcatttttttcgtgctcatgtagaacagactagtgtttataatgtaacttgtgtagttttttcaaaaaaaaaaataaatatttggtatacccttctttttaatattgagtcgtcc

SEQ ID NO: 65092 - DNA, 363 bp, Zea mays
  Clone ID: LIB3075-023-Q1-K1-E2
acaaggctaacctgcatcgccgtcgtgcgcgccagcgctgcccagcccgcgcagatggaacgcaggcaggaggcgaaggttgtgaagctgcgggcggtggaggccacgcccgagtccttcgcttcgttcgggcaggtcatcggcgccttccccgacggcgacgagttcggcccccacgacgcccagctcgatctcagccgcggcatcccaaggttctacatcatgcggttgcagaaccggccgctgaaattctctaccatcacccaccacgccagcgtgacccagtgcctgggctccgtcggcggccaggactggtacctcggggtggccaaaccgtcgatcgtggatggggcgttcgagcag

SEQ ID NO: 65093 - DNA, 371 bp, Zea mays
  Clone ID: LIB3075-023-Q1-K1-B11
caagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaagagtcctgcgctctctcccagcagtccaacctggtgctgtacggcaggatccagtgcaagggcaagtgcaccgagcagaagggcatcacggcgccggccatgaaggtctgccaggaggagtgcgacaaggcgtacg

SEQ ID NO: 65094 - DNA, 338 bp, Zea mays
  Clone ID: LIB3075-023-Q1-K1-B12
tcgcggacgcgtgggcggacgcgtgggttggacagcctttgtttccgggtgaaagtggtgtggaccaacttgtcgaaatcatcaaggtcctcggtacgccaacaagggaagaaattaaatgcatgaacccaaattacacagagtttaagttcccacaaatcaaagcacacccatggcacaaggtattccacaaaaggatgccgccagaagctgttgatctggtctctcggctactccagtactccccaaatctgagatgcactgctatggaggcacttgttcacccattctttgatgagctttgagatcctaatactcgcctttcaaatggtcgcttt

SEQ ID NO: 65095 - DNA, 210 bp, Zea mays
  Clone ID: LIB3075-023-Q1-K1-B2
tcgcttcttgtttgttctcctggcattcactctaaccaacgacggatgatctctcgatgtcccggcgattttgatattcagattcagcttataagacttcagagaaagctatggatttttaggttgaaagtcaatgtgctgttgatcattgtggtgagggagtagatgtacctagggtgctcggccacgaagtaatagtatgatggggct

SEQ ID NO: 65096 - DNA, 293 bp, Zea mays
  Clone ID: LIB3075-023-Q1-K1-B3
tcctccacgcagcggcactgacgccgagaaggctgacgctgctgccatccttccggctgttcaaaagcaggacccgggttcttgtcaccctgttgccgcgaaatgctgctgccatggaggcacttcctatatttcttgacagaatgtctcatcctgtcgatgctgcggtattgccagtgacatttgttcttgcctttgtagacgttataccgcatgcaatctgtaccagatatggcctaccaaccagtgctaactttgtatggctcgtacgcattctcatggtcatttgctat

SEQ ID NO: 65097 - DNA, 336 bp, Zea mays
  unsure at all n locations
  Clone ID: LIB3075-023-Q1-K1-B4
tccacgcgtccgctcagttgaaggcatctcgcgacgttgcaaatgccatggctgcaaaagcaaagttgctattgcgggagctgaaaactgtgaaggcagatttagcttttgcaaaggaacgatgtgctcagcttgaagaagagaataaaatgttgcgtgagagttatgacaagggtgataatccagaagatgatgatctgatccgccttcagttggaaacactactagctgagaaagcacggcttgcgcatgagaactcagtatatgcacgagaaaacagattcctgcgggaaatagttgagtatcaccagctcactatgcangatgtcatatatg

SEQ ID NO: 65098 - DNA, 258 bp, Zea mays
  unsure at all n locations
  Clone ID: LIB3075-023-Q1-K1-B5
tcgcggacgcgtgggctcaccgaaccctaaaccctgaccaccggccttccccggaggtccgtcggttcgtgtgggactctaggcgtcgtctgagcccncttcagggctatccgccgatgaagtctgaaaccctttacccctttccctccctttcccgggggagggggaaactatccgaggatgccaatcacgtcagagtggggcacgatgaggatcatgatcaagggaggcctgtggaagaacacggatgacgagatc

SEQ ID NO: 65099 - DNA, 381 bp, Zea mays
  Clone ID: LIB3075-023-Q1-K1-B7
cgacgtcgtgcagagctccacggggatcaccatctccaactgccacttcaccaaccacatcgacgtcatgctcttcggcgccagcgactcctggccgcaggaccagatcatgcagatcaccgtcgccttcaaccacttcggcaggggcctggtgcagcggatgccaaggtgccgctggggcttcttccacgttgtcaacaacgactacacgcactggctcatgtacgccattggcggcggcgacgcgccaaccatcatcagccagggcaaccgctacatagcaccaccaaacatcgccgccaaagtgatcaccaagcactacgcggaagaaggcgtgtggaagaactgggtgtggcacacggaggacgacctgttcatgaa

SEQ ID NO: 65100 - DNA, 258 bp, Zea mays
  Clone ID: LIB3075-023-Q1-K1-B8
cgaacggaggttcagagagcagtactgccgcttaatggtcatgaagcgatccagaaaatcatcgtccttaaccccacgatcttggacacgtatcccgaactatactttcatatccatcaactcaaacttatatagttgattctcgatggagaaataaatgaatctttggagttcactcaagaagaacttcgcaccgaaaggcgttgaactgcaaacatttctcgaggaaatagacaatactgtcgcactactggtttt

SEQ ID NO: 65101 - DNA, 405 bp, Zea mays
  Clone ID: LIB3075-023-Q1-K1-C1
agacgccgtcgtcgtaagccgtccgccttgcccctcgaaggcttggtcctccttgtatcccgacctcgtccgccacagacccgtttccccgctagagttatcgttcctctgcagcgatggcgatcaagcggaccaaggcggagaagaagatcgcgtacgacaagaagctgtgcagcctgctcgatgagtacaccaaggtgctcatcgccctcgccgacaacgtcggctccaagcagctccaagacattcgccggggcctcatgggcgactcggtggtgctcatgggcaagaacacgctcatcaggcgctgcatcaaggtctacgccgagaagaccggcaaccacacctttgacccgctcatggacctgctcgtcggcaacgtttgcctcattttcaccaagggag

SEQ ID NO: 65102 - DNA, 349 bp, Zea mays
  unsure at all n locations
  Clone ID: LIB3075-023-Q1-K1-C10
cagaaactatcgccagcaaagggagaacgccgaggtgagagagataatgcggtggtggtgctcatggtcggatgaatgggggtgtcgagctatgcgcggttgacgtcctcatcggagcaaaccccttcaccgttggttgccttgtaccgtggcctgggaagtcggtgactgctcatcatggtaggaggccccgaccgaccgtgcaaccgtgtgccgacgctgtggctgtgcgccaatgaaatcacgtgaggtcgtgagtcatctgaggatcatcctggtaactgaatctcaagtcccagtcaagacaaggtccgangatgaggcgcatgaangatgctgtgatgtgttc

SEQ ID NO: 65103 - DNA, 422 bp, Zea mays
  Clone ID: LIB3075-023-Q1-K1-C11
gtacgtaggagtttcaacaggaaactggggttgtggtgcttttggtggaaaccctgaaatcaagagcatgattcagtggattgctacatcacaggctcttcgcccttttgttaattactacacttttgagaacgtgtctctgcaaagattagaggaggtgatccagtggatacgacttcatggctggacggtcggcgagttgtggcatatgctcatggagtactcatctcagaggctgggaggagaaacgcacaagggttttttggcctggttgcttcccagcgacaggcccaagaatcaagtgcattacatgtccgaatagcaataaacccggcttttgtgaggagtgtgtgcatgaacgaagttattgctgacaaaaaaaaatgaaataaagataaaagcgtatgtatcagttgccacgc

SEQ ID NO: 65104 - DNA, 272 bp, Zea mays
  Clone ID: LIB3075-023-Q1-K1-C12
atagactctcaacgagccagatgacgactcgacaaggtggatctatcggggcactacaacgccgagacggcggaggactctgtgatgccagtacctaaatctgttgtgacaaaaggaggtgttcaccagagcaaggctgttccgtcagcatcgattcatcatcacccactacaaggaggcataagatggactctgagtcttcaaacttggtaccccaatatggggatttcccatgtcgaacctcaattcaacaaaatgcacaaccaccaaat

SEQ ID NO: 65105 - DNA, 160 bp, Zea mays
  Clone ID: LIB3075-023-Q1-K1-C2
gtcataattgtgacaagtgatggcaagcaagttggctacttaggaattgtccatgctgaggtgctatggaaatttggcattccggatccctgcactttcgttgagatggaccttgtatctctgtcgcaatgcacttataccagtgacttaggaatgcttg

SEQ ID NO: 65106 - DNA, 421 bp, Zea mays
  Clone ID: LIB3075-023-Q1-K1-C3
cggacgcgtgggcgctcggcgtcgggggagaagagaagcgcgcgcgatggcaccgggaagatctcttcgccctgcggggacggcggcggttctgtgggcgtcgtcgctgctgctgctggcgacgttgtgcgcgcgcgcaggtggcgcgtacgcggggccggggtgccggaagcacgtggcgagggtcacggagtacggcgcggtcggggacgggaggacgctcaacacggcggcgttcgccagggctgtggcggacctggcgcggcgcgcgcccgacggcggcgctgcgctggtggtgccgccggggaagtggctcacggggcccttcaacctcaccagctgcttcacgctctacctcgacgagggcgccgagatcctcgcgttccatgacatgaagcattggcccctcatagcttccctg

SEQ ID NO: 65107 - DNA, 350 bp, Zea mays
  Clone ID: LIB3075-023-Q1-K1-C4
tcggtggcctgaagggaatccgacaactgccgctatgcaggaaatcctctattggcaggggcataccatgtccatgatgtacaagattgtcgcagatgctctacgaaaggagggtttacatgaaaggcattcacaggagtatctgaacttctattgccttggcaaacgtgaagtctcgaatgaagttccgacgacaggcaattctaatgagaactctgcagtgcgtttgtcccagaaattcaagaggttcatgatctatgtgcactcaaaagggatgattgtggacgacgagtatgttctcatcggatcggccaacataaaccagagatccatggacggctcacgggaca

SEQ ID NO: 65108 - DNA, 434 bp, Zea mays
  Clone ID: LIB3075-023-Q1-K1-C5
gtcagaaaatagtggcatcgagttgtttcactgcacgagcacatcctccggcgaccaccggcctccctctacgtcctctagcgaccgaccaacgcgccgagcgaagatgtcgtggcagacgtacgtggacgagcacctgatgtgcgagatcgagggccaccacctcacgtcggctgccatcgtcggccacgacggctccacctgggctcagagcaccgcgttccccgagttcaagcccgaggagatggctgccatcatgaaggatttcgacgagccggtgcacctcgccccgaccggcctgatcctgggaggcaccaagtacatggtcatgcaaggcgaacctggagctgtcatccgtggcaagaatggatccgggggcatcactgtgacgaaaacaggggcagcactcatcattggcatcttcgacgagccca

SEQ ID NO: 65109 - DNA, 454 bp, Zea mays
  Clone ID: LIB3075-023-Q1-K1-C7
cgaccgtcgctgccgccctacttgccggttgctcggttcttcttcggcccgttagccgtcgacgagcaccaccagggcaaccagatacttcagtggcttcgcaaggatgtcctggtgcactattgagtctgatcctggtgtgttcactgagctgattcagcaaatgcaagtgaaaggtgtacaggtggaagagctttactctctcgatgtgggctctcttagtcaactgcggccagtatatgggctaatttttctcttcaagtggatacccggggagaaggatgaacggcctgttgtcagagatcctaacccaaaccttttctttgcgcaccaagtcatcactaatgcatgtgctactcaagctattctctcagttctcatgaatcggcctgaaattgacattggcccagaattatctcaattgaaggaattcacaggaagctttacacctgat

SEQ ID NO: 65110 - DNA, 281 bp, Zea mays
  Clone ID: LIB3075-023-Q1-K1-B10
ggacttcggaaagtcgactgtctccaaggctgatctctccaagatggtgaagtcgggttattttagtgagaatgagaagaagctacttcgcttcgggggggaagaaactaccccgaagccaggaaaggatgaaatagtcattttcaagagcttcctaaaagctgggttgagatttcccttaaataggataatctctgatgtgctgcaaagatttggcatctattttcaccaactgactcccaacgcgattgtcaagctcagcgtctatatctgggctcttc

SEQ ID NO: 65111 - DNA, 367 bp, Zea mays
  Clone ID: LIB3075-028-Q1-K1-B2
ttcagggcttgacctgcttgatgcagatttcaacaagaacagaagactttattgtggacactcttaagctacgcatatacattggtctctatttgcaagagcctttcaaagatccaacaaagagaaaggtaatgcatggtgcggatcgtgatataatgtggctccagcgggacttccacatctatgtgtgcaatctttttgacacaggacaggcttcaagggtcttacagatggagagaaacagccttgagcacctattgcttcatttttgtggagtaacagcaaagaaggagtatcaaaatgcagactggaggtcgagaccacttcctgatgaaatgatcaagtatgctagagaagatacacacta

SEQ ID NO: 65112 - DNA, 354 bp, Zea mays
  Clone ID: LIB3075-028-Q1-K1-B3
tgattactaggtttttttaaaaagaattgataataaacatccgataatcaatcaagcgcatacaaagaagatgatcaaaatgcaaataaataattaaacacttaaaaagtattaccctaattaatataataactaaattcattatttttaattgatggcttttatggtgttacaataagaaacataatacttcaatcttactaatgtttaaagcaaaaatcttgggaagaatggtgcaacaaacacaaaaactctgccacggtagcacaacctgtctctgtgatgatctaaacaatttttttcttttcatgaatgttttttgctttgtttttgggacagtcttacttgattctt

SEQ ID NO: 65113 - DNA, 366 bp, Zea mays
  Clone ID: LIB3075-028-Q1-K1-B4
attcactggagatgactgttgtgagtatcatgtggtcgttagtgcaggtgcaggtgctggtggtggtggcactagcatttctggtaggcggtgcctggtgtggtcctcccaaggttcccccgggtaagaacatcacggccaaatatggtagtgattggctagatgccaaggcgacatggtatggcaagccgacaggtgctggccccgacgacaatggtggcggctgcgggtacaaggacgtgaataaggcccctttcaacagcatgggcgcgtgtggcaacgtccccatcttcaaggacggtctaggttgtggatcctgcttcgagatcaagtgcgacaagccagcagagtgctctggcaagcccg

SEQ ID NO: 65114 - DNA, 291 bp, Zea mays
  Clone ID: LIB3075-028-Q1-K1-B5
tcgctgacgcgtgttcacgtggataactctggtcatcaccggcaagggaaaccttgacgggcagggcccagctgagtggagcaagaactcctgcaccaagaagtacgactgcaagatccttaccaactcgctggtgatggacttcgttaacaacggggaggagttcggggtcacgctgctcaactccaagttcttccacatgaacatgtaccggtgcaaggacatgctgatcaaggacgtgaccgtgacggcgctccacgacagctccaactcttattgcattcacatggg

SEQ ID NO: 65115 - DNA, 279 bp, Zea mays
  Clone ID: LIB3075-028-Q1-K1-B6
aaaatatggatccaaagagccatctagcggcaagatgtcttcaaaccatgaaagcttgcatccaaggaagactgttgtagaattaccagtccgtgtggactttgttgggggttggagtgatacaccttcgtggagcttggagcgtacagattgtgttttgaatatggcgataagggtatgaggaagccttccagtcggtgctatcgtagatacaacagattaccaccttggagtaaggatcgaagacgactcttgtagacatgtttatatcgatcatct

SEQ ID NO: 65116 - DNA, 349 bp, Zea mays
  Clone ID: LIB3075-028-Q1-K1-B7
tcggaaagcgcagatattttgactgtctcaactgaacaggagagggaatcctttgctgagaaacttagtgaggtgcaggattggttatatatggacggtgaagatgctcaagctaatgaattcaaagagcgtcttgaccaacttaaagccattggtgacccaattcttttcagattgagtgaattaaaaacctgaccaacggcctgtgaaaatgctcgattgtatcttgatgagcttcaaaagattgtcaagaactgggagacatacaaaccatgggtctcccaaaagagagtagttgacgttgtaagagaatcatagaaagtgaaagcttggctgaaggagaaggata

SEQ ID NO: 65117 - DNA, 330 bp, Zea mays
  unsure at all n locations
  Clone ID: LIB3075-028-Q1-K1-B8
tttgaagccgagaagatggtgctgaagacggaactctgccgcttcagtggccagaagatctatcctgggaaaggcatccggtttattcgtgctgattctcaggttttcctttttgccaactcgaaatgcaagcgctacttccacaaccgcctgaagcctgcaaagcttacctggacagcaatgtacaggaagcagcacaagaaggacatccatgctgaagctgtcaagaagaggcgccgcgccaccaagaagccatactcgaggtccattgtgggtgctttcttggaagtgatccagangaagagagctgagaagccttgagttcgtgat

SEQ ID NO: 65118 - DNA, 442 bp, Zea mays
  Clone ID: LIB3075-028-Q1-K1-B9
ccccaacaagttgtgtactgccaacggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccatcgactgacccatctctctagttataattcttctctcgtccttgcattgcccattagatgctatccattggtaacgcacaacagtaaaacgacagacatccgacagctatattatgttcgacggtgtaacaccctgaatttgagggtataaaatttcttctccaaataccaaccaaattta

SEQ ID NO: 65119 - DNA, 289 bp, Zea mays
  Clone ID: LIB3075-028-Q1-K1-C1
ggcgggagtgcttgatgagtaagactggcttctggggtcgatttgcttctgagttgtttattttatatcgtcgcaatttcgtggttgtcgattggttattctgtgaagcagccaagccaagctattgttatgaaaatttgtcgtctgtaagcatgtgaactttctacgttgccacatgctgcatcagtcttaataagtaagtatgcagctctaggtggtcagctgcgtctaccacaatgagcatgtacgtattgagaaatatctgtgaacccattttgcttatgaataa

SEQ ID NO: 65120 - DNA, 78 bp, Zea mays
  Clone ID: LIB3075-028-Q1-K1-C10
tggtcagcatatctgtcgcgttcatctgaaattacagctgcatccggctgatgcaagagggactatcgcaatctagtt

SEQ ID NO: 65121 - DNA, 437 bp, Zea mays
  Clone ID: LIB3075-028-Q1-K1-C11
gtgctacgacagctgctccgacgacgtggaggaggccgtcgcccacctcaacggcctcgtccgggagcccaccgacgccaagttcctcgagctcaagtcgtggctctcctccacgctcggcggcacctccacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcgagcgccagcggcccgtctggtgacgacgcgccggcgtccggtgctggtgccagcgcgtcggctgctg

SEQ ID NO: 65122 - DNA, 418 bp, Zea mays
  Clone ID: LIB3075-028-Q1-K1-C12
aacaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgaccgctgccgcgtcccgctcacccgcaacgacggcatcaagcagagcggcgtccgctacgcc

SEQ ID NO: 65123 - DNA, 291 bp, Zea mays
  Clone ID: LIB3075-028-Q1-K1-C3
ggaaatgctcattgaagagcttatcggaaaggctacatgctatactttgcagatttgtggtcatggtgtttggtattcattataaactgccatctatattagtgtcgggatcataggaatgtggatagcaagaataatgacagggttgtcgtacctgaagggttaaaggatatcgaagattcaggttattttgtaacatatctacaccattatgttaagtatttacaccttgacattgcccgaagaccagttgatgttttggagaaacctgatgtcttcttagagcatatt

SEQ ID NO: 65124 - DNA, 274 bp, Zea mays
  Clone ID: LIB3075-028-Q1-K1-C4
tttcacgggacctgagacgtgcttctgttagattacacactcgtgtttctgacagctgcccgacactgtcatgagcgaattacatggaatgtcatcctttgtagtttacacaccattgcatgcacttcactaagcctcattgacataccgggcatatactaccgtaatgaggtttaactctatagccaaatatgatgatcgacacaatccacttaatattatatttacctacttttacattgtcacgtggataagtcccttgatcctgtaaaaa

SEQ ID NO: 65125 - DNA, 292 bp, Zea mays
  Clone ID: LIB3075-028-Q1-K1-C5
aagacctcagtgaacttccatgcggtcctagatacactactgaccacatcgcgtacccgcgggatgccacttgcgacaaatcaagagaggcatcataatcctgacctctttcctaaactataacatgcagtgctggtccctgagaccgtctgtgcaagagacaacaccttcaaacacaaaggcgatcacatagacagtacaccctactgcttactccagttcaacctgccgattgccctttcgaccgtggtaacatccaaagagcgaattgtataactgacaccagctcaga

SEQ ID NO: 65126 - DNA, 266 bp, Zea mays
  Clone ID: LIB3075-028-Q1-K1-C6
gtggaggaggccgtcgcccacgtcaacggactcgctcgggagcccaccgacgccaagttcctcgagctcaagtcgtggctctactacacgctcggcggcacctgcacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgc

SEQ ID NO: 65127 - DNA, 383 bp, Zea mays
  unsure at all n locations
  Clone ID: LIB3075-028-Q1-K1-C7
gagtcggatggctcgtggctgccctgctcatacgtgcttgccgctcgaccgtatgcgtaacactnccgtcaactgtctcaaggtatggatgtctcattggtcccgacgaatcagctcgggcaccgcttggacgcgtcggacatacaacggactgtagcgcggctgaaccgatgaaccgaccgttcaccgtccaggagctagtccgattcgccgtctatgagcacaacttgaaggccaatgctcttctggggttcgagaagcttgtgaaggctcaagacacaggtgggtgctggcacgatgtactatcttagtttggaagtgaaggatggcgaagctaagaagctctacgaagttaacgtctgggagaagccatgggagaactt

SEQ ID NO: 65128 - DNA, 359 bp, Zea mays
  Clone ID: LIB3075-028-Q1-K1-C8
ggagtgctccggcaagcccgtggtggtgcacatcacggatatgaactatgagcctatcgcggcgtaccacttcgatttggcaggcacggcgttcggcgccatggccaagaagggtgaggaggagaagctgcgcaaggcgggcatcatcgacatgcagttccgaagggtcaagtgcaagtacggctccaaggtcaccttccatcttgaaaaggggtgcggccccaactacatggcgctactggtcaagtacgtcgacggcgacggtgacattgtggccgtggacatcaaggaagaagggctccgacacgtacgagcccctgaagcactcttggggtgccatctgtaggaaggacagcgac

SEQ ID NO: 65129 - DNA, 462 bp, Zea mays
  Clone ID: LIB3075-027-Q1-K1-H7
atcgatcacgacaagatggcgtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgtgaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcagggcccaaccgtgtggaacaagaac

SEQ ID NO: 65130 - DNA, 256 bp, Zea mays
  Clone ID: LIB3075-027-Q1-K1-H8
gtgttactcttttttttgtgtgtgtctcctggcaatagctaattatgtcaaaactgtcattgataccaccttttccattaatcattccttaaaagaatgtgtaaatagattcctatgtgtggtccatgatgcagatgcccttcaaaaaaaaaaaaaaaaaaaaaaaaaaaaaaaaaaaaagggcagccagttttaagggtccaaacttacattcgcgagggtgccaccttttaagtattcaatcttgccaccttaa

SEQ ID NO: 65131 - DNA, 318 bp, Zea mays
  Clone ID: LIB3075-027-Q1-K1-H9
gaaattttagttcaatcattgtatctattagatatgtcagagtcctcttgcatacatctattgaccgcgtaactcaaacggggagctggcaatgattttacacattggacttcagcagttcctactgcaccccgattgcctctcaccatgtctgcactgacatggttcaatgctccggtgccaccatttatgactaccacgacggtgatttcgtataccaactacatgaccaatgctatcttctctaacgccatgggcatcaccaaagtgtagcctcaaagagcttgcattcttatagaccctaaattaattgaccca

SEQ ID NO: 65132 - DNA, 296 bp, Zea mays
  Clone ID: LIB3075-028-Q1-K1-A1
gccctggctagcaccacacaccgcaggtatggagaaggcgacgaggctggccttggcagcggcggtggttctgtgcctgctgctggcgaccgggccgcaggaggccgtcggcgccgaggggatgctgtcgtatgataagttgctcagctgcaaggtgctgggcaactgcgacaagaacaggggccccggggccacctcgccggggaagcccgtaaacaagtacacccgcggctgcagcccgctgacccggtgccgcggcggctgatcatatctccttggtttctggtcgatgtgcg

SEQ ID NO: 65133 - DNA, 435 bp, Zea mays
  Clone ID: LIB3075-028-Q1-K1-A10
ctcataaaccctatataccgccgactcgccgtcttcgcctgccgccggatctctgcaccggcggtagagaagcccgtgctgcccctcgtgtatcaccggaacttgcagcaaagacacaattccagtttggtggatgcgagtggaggattcagcgagatgcttgcctctacacggaggtgctatgtatttggaggcaaaggtggtgtggggaaaacaagcatggcggcgtcgcttgctgtgaagtttgccaaccatggtgaaccaacagctattgtttcgacggaaccatctccgtcactcggtgatttatttgaacaagacatgggtgttggcggcaaaactgtacgcatcactggatttgactctctttttgcagttgaggctggtcagttcaagataaagggagaacctgaagatcttggatcttttatcaac

SEQ ID NO: 65134 - DNA, 432 bp, Zea mays
  Clone ID: LIB3075-028-Q1-K1-A11
atgcgaccatgtcagtggtgggggaggccaataacccggtggccggagtccgaggggataacccccaacaccagcaggctgcgccggctccggcgccagcacagggggaagtggcgcatgaggctgtagtgcaggggacgggacaagagcaggatcgagacaaggcggatcgagaggtgcaaggcggtgcgggtgataaggacgacggcgcgtgcatagatctggtcctggtctaggatccggaggtccttgcagtcgaggatccggaggaagctgcagcaaccgcaacactccaggaagaaatgaaagcgcttgtggcatctatccctgatggtgctggagcagcattcacagtcatgcagcttcaggagctagagcagcagttcatggtgtaccagtacatggctgccctaatacctgtgcctactcacc

SEQ ID NO: 65135 - DNA, 441 bp, Zea mays
  Clone ID: LIB3075-028-Q1-K1-A12
ctcagccaaccccatcttcatcgacatgaagtactgccccaacaagttgtgtaccgccaacggcgcctccaaggtcaccgtcaaggacgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcgtccttgcattgcccattagttgctatccattggtaacgcacaacagtaaaacgacagacatccgacagctatattatgttcgacggtgtaacaccctgaatttgag

SEQ ID NO: 65136 - DNA, 365 bp, Zea mays
  unsure at all n locations
  Clone ID: LIB3075-028-Q1-K1-A2
cagcaatggcgctgcttgcctccgactttcctcgcgtcatctcgtgcttcccaatccctatagatagaactggattgatccccatggacccatgattctctcagacgccactgcgcctgttcgacgacgcgaagccagaaggcctcgtggtcggggaggctgacgcagagagggacgatgggaacgggggtacccgcctacaacggcgctcggggcataatagttggtcaggcgtgatcataggggctcactagaggcgcgtgcatcggtccgtggggccgaagacggtcggtgcggcggcgattgctcgctgggatccgcaagaaccgncgtccgatcatcctgcgttgtcagcactcttccca

SEQ ID NO: 65137 - DNA, 127 bp, Zea mays
  Clone ID: LIB3075-028-Q1-K1-A3
gacctaggcgtacgcgtccgcaacgaagcccgaatccgacttatctagaatgatatcaggcttgccaatccttatggatagaactggattgatccgcatgggaccatgatcttcatagacgccactg

SEQ ID NO: 65138 - DNA, 372 bp, Zea mays
  Clone ID: LIB3075-028-Q1-K1-A4
tcttcctggacctgtgactgattctgagaagctaatttggaatgttctggaagctgaacgacctgacatgaggcaattacatggaaagtccctcgttgaagtaaacagaagtttccttgaaaaacacaatgcttccttgatgcaccgagcagctggtgctgaaatgatgtatctcttagagccaaataagaagatggaggcaattaatttaattgaagattcaacaaatattacatcatcagggcatagtttgcttggtcctgtaaaaacatggcaaattcaagattgtattgatgttcataaattgctggagacagtctttggtgatcagaatgttgcaaataagtggaaagcacggtgcgcggaatattt

SEQ ID NO: 65139 - DNA, 178 bp, Zea mays
  Clone ID: LIB3075-028-Q1-K1-A5
cggacgcgtgggcggacgcgtgggataagagggcttcatggatccagcagactagaggatttcggtggaagcataccaccagcagcgtcatcggcattagtcaagctgacaaaccggctcaacttcctgaaagaacgtatggctgctgctggcaagcgagatgcagagcttggatctg

SEQ ID NO: 65140 - DNA, 333 bp, Zea mays
  Clone ID: LIB3075-028-Q1-K1-A6
cccacgcgtccggggcgtcgctctcgaagccaaccggctgcgtcggggcgtactctcagacctcgtcgccgccgctggggggtaccaggcggcgctgtacctcgaggcgctctcgcgcttcgcgttgtccatgcacgaccccgaggtgctccgccgcttcgaccagtgtcgcgcctcgcctcgtagctagttacccttcttgttctcaaggcatctttgggaagcatgagatgggctagcatgtggctgatgcagtgcgaaacagaacataaccatgactacgagtggccagttgggccattaggtggtggtgagcgactcgaaaacgtagca

SEQ ID NO: 65141 - DNA, 156 bp, Zea mays
  Clone ID: LIB3075-028-Q1-K1-A7
caacgaagccccacacacacaaaagcaaaaagcatcatcacaataatggcccgcgcgtgtgtgttcctcgtggtgctcctactggccgtcgttgcggtggcgccgattgcgggggctgcgcgtgtggatgtcgtggagggcatgttcatggcgttc

SEQ ID NO: 65142 - DNA, 318 bp, Zea mays
  Clone ID: LIB3075-028-Q1-K1-A8
ttcgtggacgctgtgactgcttctgagaagttcattagcaatggactggaagctgaacgacgtgacatgacgcatttacatggaaagctcctcgttgaagtaaacagaagtttccttgaagaacacagtgctgccttgatgcacccagcagctgatgctgaaatgatgtatcttttacagccaaatgagcagattgaggcactcaattcaatcgaatattcaacaactattacatagtcacggcatagttcgcttaatgctgtaaaaacatggcatatctaagaatgaattgatgttcattacttactggagacagtc

SEQ ID NO: 65143 - DNA, 437 bp, Zea mays
  Clone ID: LIB3075-028-Q1-K1-A9
atgatgttggactggtgatactttagggggctcgagtggtttctcgagtgcctctgcgtaaggacctattcgttcgatgaccgcccggaaaaacagtgcaaccatgagggtggaatgggatgcccttagctaattagttagagaaactagagatgtagttgcttcgccgccgtgccgtcaatggggtccaggcacagtgcttgctctgccgaggctgggtgccgaggttctttcattttgcttttgttagtcacccctctgcgaggagtggtgctgtgtttatcaaactggagaaacctaacgggcggttatgacctctagggaatctttgtaaaggcttcgtagtgaatccctggccattcaccttgggagtggataagggtcttgcaagcccgggctagagagggaatcacgtcttgtgggtaaagtgtgcaacc

SEQ ID NO: 65144 - DNA, 343 bp, Zea mays
  Clone ID: LIB3075-028-Q1-K1-B1
cacaatctgaaatgcgagatatcattcttggcgctgaaattgctccaccatcacagcagaggcaacagattgctgaaattgagaaacagtcaagagagactactcagttaactgctgtaaccacaaggacgacgaatgtgcacggagatgaactcattatcacaaccacaagtccatatgagcaacaagcattcgcatcgaagactgattggcgtgtcagagccatctctgccacaaacttgtatctacgtgtaaatcacatttatgtcaattcttgtgatataaaggaaactggctacacttacattatgccaaagaacatattgaagaaattcatatgcat

SEQ ID NO: 65145 - DNA, 443 bp, Zea mays
  Clone ID: LIB3075-028-Q1-K1-B10
tcgcggacgcgtgggcggacgcgtgggcggacgcgtgggcggacgcgtgggggacattggtgcgctttctggtggtcacaccctgggaagatgccacaaggacaggtctggatttgagggagcctggacgtccaaccctttgatctttgacaactcttacttcaaggagcttctgagcggatagaaggaaggccttctgcagctaccaagtgacaaagccctcctctctgatccatccttccgtccacttgttgacaaatacgcatcggacgaggactctttctttgctgactacgccgaggcccacctgaagctttcagaattgggatttgctgaggcgtaacgaaccagaagagtgtggtggctgtcgccggtcgaccttgtgttaatgttgtctgcttttctcttgaacgaagatgtgatgaactcagctgaagatgtag

SEQ ID NO: 65146 - DNA, 441 bp, Zea mays
  Clone ID: LIB3075-028-Q1-K1-B11
cggacatcgacgaaagctatagccagctagttacaagagcaaaaacaccatcatctgatccgcccgtctcaacgccacgccaatggcccagagcacgaggatggtggcgctggccctggtggtcctcctggtggcggcgacggcgtccgtgcccacggccaccgcgtacggctgctacgacgactgctacgagcggtgcgccaacggcaagaaggacgaccccgcctgcaccaagatgtgcaaccaggcgtgcggcagcaccgacaagggcgcctccgtcggcgcgccggcttgatcgacccgagcttcatcggcgcgcgggctcagctcgatatcagcatcatatacaatcgctgctccgtcgctcacgtcagcccatgcatgatctctcgacccggcccattgaatcttctccttctactatagtatatctttgttgca

SEQ ID NO: 65147 - DNA, 475 bp, Zea mays
  Clone ID: LIB3075-027-Q1-K1-H6
caaagatagcatagcagcagcactcacaatagcaaaaaccaccatccgtcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttcctcctctaatttctcgaccccgtcgaatttttttcctttctattcttctactatactactactatctgtttgtcgcgttgatttcttctcata

SEQ ID NO: 65148 - DNA, 440 bp, Zea mays
  unsure at all n locations
  Clone ID: LIB3075-027-Q1-K1-G11
cttcaggctgccatagacatgtttagttcttatagggaaagggactattggtcggtgctggaacacccacctaaggatttggagattgcaatagtgcaagcagagcacagtgatcgatgggtccctgatgacgttcaaaggctaaaagcattagccgggagagagtccaagcctgatgtaggaaaagtgtcacttcacgttctccctaactctggccactgggttcatgtggacaatccgaaagggctactcgagatcatggtacctaactttctatcagcagttcaaaattgagtggtaccttcaatcagaaccttcatttattgtgacatattgagtttgacaacccatgggataacgtttcctctctcatattgntgcccaacaagaattctttgcttcttttctgaggaaatagtgcacccttctgttaataatcg

SEQ ID NO: 65149 - DNA, 466 bp, Zea mays
  unsure at all n locations
  Clone ID: LIB3075-027-Q1-K1-G2
gattggaacagctaccgatatattcaggagtcttataacaagtttggatacagagggccgctaccttctgttgaatgcaatcgctaaccaactgcgctatccaaatagccatacacactactactccttcatcactctgtatctattttccgaggctacccaggaaattacccaggagcaaatcacaagggttcttctggagcgtctcatagtgaaccgcccccatccttgggggttacttattactttcattgaattgataaagaatccgcgttacaacttttggagccggtcttttacacactgtgcacctgagatagagaaactgttcgagtcggtggcaaggtcatgtggcgcanaagttgtggacgaaggaatcagcgtgcangatggcagccactaaagccatctgctttgntcaagtgttgtttttgtgctatttcttctttggcactggaaattttct

SEQ ID NO: 65150 - DNA, 400 bp, Zea mays
  Clone ID: LIB3075-027-Q1-K1-G3
cggacgcgtgggctggcgttggccacggagccccacaacgacgagctcatgaagaggactcccgtcggaaggaaaggcaactgcgatcagcaacaccatgtggaggaacatcatggggcaggccctctaccagttcctcgtcatctggtacctgcagtctagggggaaacggctcttctggatcgacgagggcgccgtcgacgccgacctggtcctgaacacggtcatcttcaactgcttcgtgttctgccaggttttcaacgaggtgaactcgagggagatggagagggtgaacgtgttccgaggcatcctggacaacaacgtgttcgtcatggtcctcggcagcaccgtcgagttccagttcgtgatcgtgcagtgcctgcgtagcttcgccaacacg

SEQ ID NO: 65151 - DNA, 455 bp, Zea mays
  Clone ID: LIB3075-027-Q1-K1-G4
cgagtctcgaccaacccatacgcacctaccctccgccaccgttccccccctctgcatctcgcccgccgttctcgtccttgtagatctcctcgcacctcgcccattcgcttcaccaagggtttaagaccggcggcgatggcggcgaagctggcgcagctgcgcacacaggtaacgcgtgcggcggagttcgcctcgaagcacggctgctcctactacaaggaggtaatggagaagaacaagcagtacgtcgttcagccccccaccgtcgagaagtgccaggagctctccaagcagctcttttacacccgcctcgcaagcctaccaggtcgctatgagtcattctggaaggagcttgattgtgtcaagcaggtatggaagaacaggaaggacctcacggttgaggaccttggcattgccagtttggttggagttgagctctatgcatgggtctgcgt

SEQ ID NO: 65152 - DNA, 184 bp, Zea mays
  Clone ID: LIB3075-027-Q1-K1-G5
cggacgcgtggggacgaatcgtaaagatttgcttgatgaagctttattgagacctggacgattggaagtacacatggagttaaacctgcctgatgaaaatggtcgtttgcaaatccttcaaattcatacaaataagatgagggagatttcttccgtgtctccagatttaaatctatgagctcta

SEQ ID NO: 65153 - DNA, 309 bp, Zea mays
  Clone ID: LIB3075-027-Q1-K1-G6
acgcattggaacagctaccgatacacacaggactcttataacaggtctggatacatatgtccggggcctattgttgaatgctatcggtaaccaactgcgctatccaaattgccattcacactaatactccttgatcactctgtatctattctccgaggctacccaagaaattacccaccatcaaaatacaagggttcatctcgagcgtcttatattgaaccagccccatccttgagaggtacttattactttgatcgaattgagtatacaatccagttacaaccttttggagccgttctcttacacact

SEQ ID NO: 65154 - DNA, 340 bp, Zea mays
  Clone ID: LIB3075-027-Q1-K1-G7
cacacgctgagctactgatcatggcgctgaatgcgggggatgacatgagtgacgtggaccgcttaaaatacgcatcgggtggcaccgctcttattagagcacgacgctgtgcctgctcaatgagtgccctctctggagctgggggaatggtctacatggtgtacagaactgtcaaaggaaactggcttcacaagcaacacactgacccgtcacagaggcatcatgtgttcaagaaacgctatgcgtatcctgttgtgctttgctagaaacgatttgggtcatgactacctcgttttggcatcaaaagcgttggtttacacacacaagcccatgttatgca

SEQ ID NO: 65155 - DNA, 412 bp, Zea mays
  Clone ID: LIB3075-027-Q1-K1-G9
gtcccacacacacaaaagcaaaaagcatcatcacaataatggcccgcgcgtgtgtgttcctcgtggtgctccttctggccggcgtcgcggtggcgccgcttgcgggggctgcgcgtgtggatgtcgtggagggcaggtccatggcgtccgtcgacgcgcctgaagcggcggctgacgcgcccgctcccggtcccgactccgcctgatccccggactcgccgtcggaggcgccctacagcagcagctcatacgactagccgcgcacaacgcagttcttgtcatgatctatctagcagataaaaagatcatatgtctcgtttgattctctggaataactaatagtatatatgctgcgcccggatgatatagtaatatgtgcatcaaatgcgtgcggcaaacgcatggaatgtgc

SEQ ID NO: 65156 - DNA, 401 bp, Zea mays
  unsure at all n locations
  Clone ID: LIB3075-027-Q1-K1-H1
cgaacaaagtacaggtccatttctagcctatcgagctcctcaggtagtaaaaccctacctacacctcgtgccgcctccgtcgccggctcgcctccccatcgacgcgcaggcagccctgcgtttgctccccgtcggtcgggaaaggggcgcgccggcgctgcctccagcaatcaactcgccgcatccaatcacggcgcctccctcctcgattggctcctcggtggttggttgttataggcaggcgggaaggatgttctcgctgagccagatcgagcacgacctcccgatgccgccgcacctgctgangccgccccttcccgacgccatcaaggccgagctcgagaggctcttcttggacaaggtaatcacaaaacttgggctgtgcgtgtctgtctatgata

SEQ ID NO: 65157 - DNA, 334 bp, Zea mays
  Clone ID: LIB3075-027-Q1-K1-H11
cggacgcgtgggtggcagcgacaactgcgcatcggcgccgtcaccggacgtcagatctccggtgggggtttgatggcgatgagcacctgtcacgtactctaaggccactttctctcattaaggtagtactgagttcattgcatgactatgacttctgaagatggagacattttggctcttgtgtctgagccaagcctaaaggaagagcaacttgaggcttctgaatctgatgctacgtcttctgcaattatgaaagccattgaatcaaataagaatggagttgaatgttcaccatgcagaagcttgtctgggcagattgatacttcattcatac

SEQ ID NO: 65158 - DNA, 419 bp, Zea mays
  Clone ID: LIB3075-027-Q1-K1-H12
atttgaaacagttaagaattcatatataagagtgcatatatatatatataattctgccaagacaaaggtaatggagtcgtcacgcatgttccagccggccatcatcctgcttctcctgctcattgtgaccaccgatgtggcgcaggcggcgagggaatgcgagaaggacagcgagcgattccttggggcatgcatggcgtcggacaactgcgccaacgtgtgccgcggtgagggcttctccggcggcaggtgcagcaccttccgtcgtcgctgcatctgcactaagccgtgctaaattaacctactcccggcagttcgatggtggacgtttattctatttattggcttacttgattttttttcccctaacaataagaaaacgcacgtgcttgcatgtaccgtgtgttggatatgctttt

SEQ ID NO: 65159 - DNA, 445 bp, Zea mays
  Clone ID: LIB3075-027-Q1-K1-H3
agaagcccagcagcaagggcgcaagcgcaactgatcccgcacacgggtgatgttccacatacatgcctataggccactcacctcaccacgcagcgttaccggccgtactactatatctacatacgaccgtgggacaacgtagaccggagctcgatcggcgcagttgccgcatgggcgtggctgtcaaagatcctttgctactttcttgatttgtgcttgcgttgggttcggtgatccactttctttttatgtgattattaatcttggtttcagatgcatgtacgcatgtatgtgccggcaccatatggtcttgtgttaagattattcatggattccaatctctagtgtatggtcgattggtttgtgagtgcatgttgtactcataccaacttctgtctttacatcagcatttattacgaaatagcaatgtgacctatccaaatta

SEQ ID NO: 65160 - DNA, 429 bp, Zea mays
  Clone ID: LIB3075-027-Q1-K1-H5
cctccaccccggaggccattagcctgctctgcactgccaaggtcccatgcaccggcgtcaccatggatgacgtcaacgtcgagtatagtggcaccaacaacaagaccatggctatatgcacgaacgccaagggcagcaccaagggttgcctcaaggagcttgcatgcttctagaccctcagtcgactgacccatctctctagttataatttttctctcgtccttgaattgtccattagttgctatccatttgtaacgcacaacagtaaaatgatagacatccaacagctatattatgttcgacggtgtaacaccctgaatttgagggtataaaaaaaaaagataataataaacaaagaaaaaacaaaaattagaactaaaataaaataaatatgatatacgatccattgaaagcagaatcaattcattc

SEQ ID NO: 65161 - DNA, 448 bp, Zea mays
  Clone ID: LIB3075-027-Q1-K1-G10
gggcaaacagctgaagggacctacaactacacctccacccaacttttagatcttactcaagtaggaaatagagatgagtttctcaacatagaacatgaacaagatgaagtggaagaaaccttgccggcacatgaagaagatgatgtccatgttgttgaggcaggagatgcaacaggtttaaggcatgatccagtgccgcagagaacgactactgctacaagagggaacaatgaagaaacaaggacaaagaggcataaaaagggtgataacctagaaggaataatgggaagatacattgacatgagaatgaagcaagctgaggaagaagccacacaactagcaaaagagagggaggaaaaggaagtgagtcaagctgcagacttctcaatcaagaagtgcatatccattattggtacaatggaagttacaaaggaggaaaaagcgaaag

SEQ ID NO: 65162 - DNA, 458 bp, Zea mays
  Clone ID: LIB3075-027-Q1-K1-E7
ctgatactgaagttggaaacaatggactccagcatctatctggtcttcgtaatctgcaaagtattaatctctcatttactttggtcacggacattggtgtgaagaagatctctgtgttgaattcgctgaagtcagttaaccttgacaatcgccaaattactgatgttggcctggcagcacttataagtctcactaggctgactcatcttgacctttttggagcttgcataactgacaatggcacaaattgcttcagatattttaagaatcttgtttctcttgaagtctgtggtgggttcgttactgatgctggagtgaagaacatcaaggatctgaaggccctgacgttgctgaatctttctcaaaatgctaatctgacagacaaaaccttggagctgatctctggcctgactgctttgatcaacttgaacgtgtcaaactcacgggtgtccaatgct

SEQ ID NO: 65163 - DNA, 407 bp, Zea mays
  Clone ID: LIB3075-027-Q1-K1-E8
gataatctgacgctccaaacaatgcactgcattagctatcagggcttcagattctgcaaaggctaaatctgtcatatggtctggacactggcattcgtgtgaacaagatctatgcgaagagtccaatgaaaacagctaacctcgacaatcgacagattcctgaccatctactcgatgtacttataatctatacctaggcgtgctcatcgtgacctttacggagcctgcatacctacaccatggcaccaattgctatagatactataagaatatcggagctaatgcaatctgaagagagttacgaactgacgctggagtgaagaccattacggatctgaatgccctgacgtttctgaatgtaagtgaaactgcttacctgtcagaccttacctatgatatccacattg

SEQ ID NO: 65164 - DNA, 440 bp, Zea mays
  Clone ID: LIB3075-027-Q1-K1-E9
acgagacgaggcgacgcgagtcgcgaggagtcgaggaggatcggggctcaggcaagatgaacaggaagccaggagactgggactgcagggcgtgccagcacctcaacttcagccgccgagacatatgccagcgctgtagcgagccacgtggagttgctgatcgtggcagtggcggcggcggaggaggaggaggaggcgactacgccagcttcggtggccgcggtggctcctacttcggcggcggctttggcgctgctggctctgacgtccgccctggtgactggtactgctcctgcggcgcgcacaacttcgccagccgctccagctgcttcaagtgctccgcctacaaggaggaggccgctgtgaacagtggcgctggcggctttgacggcgacatgtcacgctcacggcgctacggcttctgcagcggtgctgctggt

SEQ ID NO: 65165 - DNA, 465 bp, Zea mays
  Clone ID: LIB3075-027-Q1-K1-F1
gctggtacgagaccgtctctgcggctgtagcctcaagattccctggtaaggctgttggtgtaaatctgcctgcgggatcagctgctgcggcagctgctcctgcggatgaggctgaggatgatgatgaccttgatctttttggtgatgaaactgaggaggacaagaaggcagctgatgagcgtgccggcgctgccaaggcctcttctaaaaagaaagaaagtggtaaatcctgcgtccttatggatgtcaaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactctaattgaggaccaccttacgcaagagcccatcaatgagtacgtacaga

SEQ ID NO: 65166 - DNA, 446 bp, Zea mays
  Clone ID: LIB3075-027-Q1-K1-F10
cttccggccgaattgcgagcgagcgttcctctccgtccgcttccgccgtttgcccgtcgatcagttgttggctgccggccgggtactaccgcctgcacgagcagcggctagccacagcccacagacagacgacgtcaggtcttggcggtgtacaagcagacagagctcgctcggtcgccatgtctttcaccggcacgcaggacaagtgcaaagcctgcgacaagacggtccacttcatcgacctgctcaccgccgacggcgtctcgtaccacaagacctgcttcaaatgcagccactgcaagggcgtcctctcgattagcagctactcttccatggacggcgttctgtactgcaagacgcactttgaacagctcttcaaggagacggtgaacttctccaagaaattccaaggtggaggtggagcatcttcaaacaagaacgacccg

SEQ ID NO: 65167 - DNA, 472 bp, Zea mays
  Clone ID: LIB3075-027-Q1-K1-F2
gttctagatcgcgggccgccctttttttttttttttactccagctaataatcttattcccttcaatgacgaattaggcatatcgacaagattattggtttctttgtgacaagaatcaaaacaatgggcgaaataaaatgactttctcctccaatagaaggtcaccgcaccacctatccaatatattccgaaactaactaaactgttcagcttgctttttatccccccaacgttagactacgccacggacccaaaaaaaaaggagactagatccctaccggagctaatccaagtagaagagtgtcacgatcttccgaaggttcatggcctcctggcatgtttccatcagcagtttgctgtcgtggaacgcgaagcagattacctgttggaccttagagatgatgtccatattgcataacctgctagcctcaattagtggcaaatgatcatactgtggtttctcgagtaaagtt

SEQ ID NO: 65168 - DNA, 419 bp, Zea mays
  Clone ID: LIB3075-027-Q1-K1-F3
cgcgacgactgacaaggcgaggggagcagtcggcgggcgatggtcggcggcggcgcacatggcggcaccacctacaaaggctacaccatcccacacaacaagcgctggcacaccgtcgccggcaagggcctgtgcgctgtgatgtggttctgggtcttctacagggctaagcacgatggtgctacgctcttgggttagcgtcatccttgggatgggcatgatgaccactcttatggtcatggacatgggaatgaggcatcgtgacattaagatgcctactctcggcggacggtgatttgatgctttgcatgtcacaacaactaaagattgagttaataaattgtaccacccttcatggtactcatggtgtatgtactcatgttgtatgcaactggtttagcacaaactggggtcgttac

SEQ ID NO: 65169 - DNA, 461 bp, Zea mays
  Clone ID: LIB3075-027-Q1-K1-F4
ggttgttcctctgagcgacggcgagtcggcgaccgaggtggggttccgagcgccccagcccgtggtggaattcgtttggtctggttgttgcgggggaccacagaagcattagctgggtgaactctttcaaaaggggcaggtgcgctagtttgaatggctgctacaaagcttcaggccttttggaaccaccctgctggccccaaaaccattcatttctgggcgccaacattcaaatggggtatcagcattgccaacatagccgactttgcaaagccgcctgaaaagatatcttaccctcagcaagttgctgttgcatgcactggaatcatttggtcaaggtacagcttggttatcacaccgaaaaactggaaccttttcagtgttaacgttgcaatggcgggtacaggcctgtatcagctttcacggtagattaggcaagattacttgtcttgtgagaagga

SEQ ID NO: 65170 - DNA, 460 bp, Zea mays
  unsure at all n locations
  Clone ID: LIB3075-027-Q1-K1-F5
atcatcatcttctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaggtgtgccaagaggcgtgcgacaaggactacgtggtcaaggcggctgangtcaccaaggcctgcaacaccacctgcgccaaggagaagcagcctctgctcagcgagaac

SEQ ID NO: 65171 - DNA, 460 bp, Zea mays
  Clone ID: LIB3075-027-Q1-K1-F6
gcgagtacgccctcgtcaccgagcgcggagattcgctctccaggctcgtcggcgtcgctgtcgcggccgatgctgcctcccgcgaggttcccgtctctgtctcggagtacatgcgaccgacgccgcgctcagcctccgccgccttcgactttgaggaagcagcaaccttccttgccgatgagggtctggattacgcccctctcgtatcagatgatggtgaggttgttgatctaatcaccgccaaggacgtggagcgcatccggagctatcccaagctgggcaagccgtctcttggagccaacgggaagtttgtagttgcggcttccattgggactcgtgaagatgacaagggaagactggagcaactagttaaggcgggggcaaatgctatcgtgattgatagttcacaggggaactccatataccagctcgatatgataaagtttgcgaagaagatgta

SEQ ID NO: 65172 - DNA, 426 bp, Zea mays
  Clone ID: LIB3075-027-Q1-K1-F7
agtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcacctttcgccgcctctgcatctgcactaggcagtgctaaacaagatcgctcgatcgctcgtcatgcatcgacaacctattcttaataacgttcattatctcgttcttattcatgactaatgtcatgtatgttctggtgactgtcatgtatatactgatgactg

SEQ ID NO: 65173 - DNA, 368 bp, Zea mays
  Clone ID: LIB3075-027-Q1-K1-F8
ctcacgcgtccgcccacgcgtacggtcacgcgttcgactacgcacccgctcaggtcggagccgacgcggacggtgtcgagctggaatgtagacctacgaagctgcagtcgtacgccatcgatatgagcaccgtgtcgagagctgttacatgagcctctacgtggtgtatccaagcagacgacgcgacgggtggacatatctacgatgcactgttacacggtgacctctagtactgcttgaacgttagtcagtgcttcctgaatccaatgagctactacgtgttaccatttttggactgcgtctttcggaagcacgtcaagcgcgcttgatacgacctcaagttcgggatcaccatgtactagggcagg

SEQ ID NO: 65174 - DNA, 371 bp, Zea mays
  Clone ID: LIB3075-027-Q1-K1-F9
cgaaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagatcccagcctagctctgaagctggaagtgttcgacaaggacacgttcagcaaggacgacccgatgggggacgcggagaacgacg

SEQ ID NO: 65175 - DNA, 459 bp, Zea mays
  unsure at all n locations
  Clone ID: LIB3075-027-Q1-K1-G1
gccaccgacatcgcctcttaacccgacaagccccattgcccaggagaaccccgtgccggggagcgagccgcgcgcattccccgtcccgtgccaccggaccaggggaaggaggacacacatgtcgtcgtctctctctccagcggcggcagccgcgcccctggatctggacggcaactccgtcgcgcccctcaccatctgcatgattggcgccggcggcttcatcggctcccacctctgcgagaagctcatggccgagacgcgccatgtcgtcctcgccgtcgacgtatactgcgataagatccgncacctcgtcgaccccgcgccgtcgcacctcgcggtgcgcatctccttccaccgcctcaacatcaagaatgactccaggctcgagggcctcatcaagatggccgatctgaccatcaacctggcggctatctgcacgccggcggactacaacacgcg

SEQ ID NO: 65176 - DNA, 467 bp, Zea mays
  Clone ID: LIB3075-027-Q1-K1-E6
aatagggtcttcgttcctttgatactctcacttcctaccaaagtattctcattgactgcgaaagatcagcttaaggttgaagttaccacagtgtttggatctgcagcacctttactcaaagtgaatcttgtgcaactgttgggaactgactctaaagtcatcaccaatgggaacagggagcttcaatatgaccttgacaaaaatgtccattacttggacattgctccattgcaaatagatgttgggaaatactcggtagttcttgagatttcacttcatgaacaatagcgtgagactgtttatgctactggagggaggaacactgaaagtgtatttgtcacaggactgatcaaagttgataaggcacagataggaatatgcgacaatgatgctgggaccgtggagtctgtccaaaagttagatcttgtgaaagatacacaggtgtctctttctgcaaaccacctaca

SEQ ID NO: 65177 - DNA, 469 bp, Zea mays
  Clone ID: LIB3075-027-Q1-K1-D3
gcgtctcacccctgaggccgcgcagagccactgcttgcgtctctgtctctctgtctgctcgcttatctccttctgcgactcgtaagagggtgaggtcttgcttgcctcgcggaatggcggcggccggggcatggctggcccgtgcgactgcgacggcggagctgggtttcgtcctggcggtggcgtcagctgaggctgcatcgggagacgcggagatcgttttcctcaaggccgtcgaggtcaaaggcgcaatgtgcttgcacggcagctcaccggtgtaccatttatctcgcggctccggatctggcgccaataactgggtcgtccacatggaaggaggagggtggtgcaggaatcctgatgagtgtgcggtacgcaagggcaactttaggggctgctacaaattcatgaagccactctcgatttagggatattatgcggcatccaataatccaattctgatttctac

SEQ ID NO: 65178 - DNA, 445 bp, Zea mays
  Clone ID: LIB3075-027-Q1-K1-D4
tgaagagctatacaccagaaatggttgacgttctcattgacagtgtgaggaatccagcattcctcgattgggaggtcaaagagcagctccagaacataaaatctgaaatagctgatgcgtctgctaatcctcaaggtctacttctggaggcccttcattcggctggatattccggggcactggcaaaacctttgatggcttcagaatctgctgtaaaccggttggatgttagcagcttggaggaatttgttgctgaacattacactgctcccaggatggttcttgcagcatcaggagttgatcatgatgcgctgatttcagttgtagaaccacttctgtctgaccttccgtgcgtgaaacgtcctgaagagccaaaatctgtgtacgtgggaggagactatcgctgccaagcagattcttcaaacacacacatcgcacttgcttt

SEQ ID NO: 65179 - DNA, 413 bp, Zea mays
  Clone ID: LIB3075-027-Q1-K1-D5
cttgtcgtcgcacagcctcgcggtgctcgcgggcggcgcgctcctgggcctccttctcgcggcgctggccgtggccaccacggacgccaggtcccctccgcgcgggcggaggcggcgcgtgccgtggctcgccgcggggttcgtgatgagcgtgctgtgggcgtacaccctggcgcgcgagctggtggcgctcctggtggccatcgggtacgtggtcgggatcaagccgagcgtgctgggcgtgacggtgctggcgtggggcgactccctgggcgacctggtgtcgaacgtggcgatggcggtgcacggcgggcccggcggcgcgcagaccgtcgtgtccgggtgctacgcgggcccgctgttcaacacggtggtgggtctgggcctgtcgctggcgctggcggctggcgcgc

SEQ ID NO: 65180 - DNA, 442 bp, Zea mays
  Clone ID: LIB3075-027-Q1-K1-D6
cgcattacttgcacgtacgagctcagaaggaaggcagaggctaaagcagccatggcgaactcgtcttccggccttgcggtgaacgacgagtgcaaggtgaagttccgggagctgaagtctcggcggagcttccggttcatcgtgttcaggatctgactgacacggacatggatatcaaggtggaccgtctcggtggaccgaaccatggctacggcgacttcaccgacagcctcccggccaacgagtgccgctactcgatctacgacctcgacttcaccaccatcgagaactgccagaagagcaagatcttcttattctcctggtccagtgacactgtacgcaccatgagcaagatgctgtacgccagctccaaggacaggttcatgagggagctggactgcattcagtgcgagatccatgacaacgaccccatcgagatgag

SEQ ID NO: 65181 - DNA, 452 bp, Zea mays
  Clone ID: LIB3075-027-Q1-K1-D7
ggaaagctgaggtcgaatctcctcggcacaaagtttgcaatatatgatacccagcccccatgcaatgcagcagaacccgggaaaacaagccgtcggttctactcccggaaggtgtcgccaaaggtctcctccagcacctacaacatagcgcaggtttcatatgagctgaatgtcttgggtactcggggccctaggcggatgaactgtgttatgcactccatccctacctcgtgccttgaggctggtggcactgttcccagccagctggacagcatccttgctcgctctactgatgagtcatttggcagcatttccttctccaagtcatctgttgtggaccggtctatgcgtttcagcagctcaagattctccgacatctcaatgagcagcagccgcaggattggagacacggcatcgggagacaatgatgagtgcaaggagaggccattgat

SEQ ID NO: 65182 - DNA, 419 bp, Zea mays
  Clone ID: LIB3075-027-Q1-K1-D8
agaagaccacacagacttctagatttattctcaaagcttgcaagaagagctgatgcagaggatccaatagaaaaggctcttcttggtcttccaacggatggccttcgcgtgcttcttgaatacgtccgtgaatggaatacgaagcccaagttctgtcatgttgcacagtttgtgctttttcggttattgaggagtttctctcccactgatatcctggagatcaagggcatcagtgagctccttgagggccttattccgtattcgcagaggcatttcagccgagtcgatagactagtccgaagcacgtttctgttggactatacgctgatgcgaatgtccgtggtagatccagatgtagatgcgggaacaatcaaagatgaaatgaacggttcgtctgcggagaacggtgaacttgcaga

SEQ ID NO: 65183 - DNA, 427 bp, Zea mays
  Clone ID: LIB3075-027-Q1-K1-D9
gcttcccagagacccagccatggcgatctcccagatctcacgcatattcctggccatccttctcctggccgccgccttcgccgccgccccagctgcgcttgcggacggcgacgacgtggtggcccttaccgaatccacgttcgagaaggaggtcggaaaggaccgcggcgccctcgtcgagttctacgccccctggtgtggtcactgcaagaagcttgctcctgagtatgaaagacttggtgcaagttttaagaaagctaaatctgtcttgattgctaaggttgattgtgatgagcacaagagtttgtgcagcaagtatggagtttccgggtatccaacaatccaatggttcccgaaaggatccttggagcccaaaaagtatgaaagacaacgcactgcagaagcccttgctgaatttctcaatact

SEQ ID NO: 65184 - DNA, 452 bp, Zea mays
  Clone ID: LIB3075-027-Q1-K1-E1
gaactttgctgttaagttcccagcttgctcaatcgccgcgaagcaccatattgaccagagcacaacaattcttgacgtgcaaggagtggggatgaagcaattcagtaaagctgcaagggagctcattggcatgcttcagaagattgatggtgacaattatccagagaccctgtgccgcatgttcatcatcaatgcaggccagggattccggcttctatggggcaccgtcaagagctttcttgacccaaagaccactgcaaagattcatgttctgggtaacaagtatcagagcaagcttctcgaggtgattgatgctagtgagttgccagaaatttttggtggaacctgccgatgtgaaggtggttgcatgaaggctgacaaaggcccttggaaggaccccgaaatcatgaagatggttcaaagtggtgatgggaggtgtggatcactcggta

SEQ ID NO: 65185 - DNA, 166 bp, Zea mays
  Clone ID: LIB3075-027-Q1-K1-E10
acgagactaggcgacgcgagtcgagaggagtcgattacgatcggggctcatgcaagatgaagagggagccagcagactgggactgcgggtcgtgccaacgccgaaacttcaggcatcgatacatatgccagcgctgcagctagccactttgacatgatcatcgtgg

SEQ ID NO: 65186 - DNA, 411 bp, Zea mays
  unsure at all n locations
  Clone ID: LIB3075-027-Q1-K1-E11
cccacgcgtccggtcgtgttttccgctgtgtaagcatctccaacaaacaccagacgtcgtatagcggcagtccagtccacctcctccgaagccggcggtcgccgccggccatcgccgcggaggatatggcgtccctccgtgtggtgtcggtgctagtgttggtggcaatggcggcgagcgcgggcggcgtcgcggcgcggcctctggtagggggaggcggngcgtgggagaacagggcgccgctgcagacgtcgcgccccttcaacatcgcgcaccggggctccaacggggagctccccgaggagacggcggcggcctacgcgcgcgccatcgacgagggcgcggacttcatcgaggcggacatcgaggccaccaaggacagccacctcgtctgcttccacgacaccacgc

SEQ ID NO: 65187 - DNA, 442 bp, Zea mays
  Clone ID: LIB3075-027-Q1-K1-E12
gtgcacaaacaatgcgatgagagccttgttcctcctggtcctcttctgcatcgtgcatggtgagaaggaagagtcaaagggcatcgatgcgaaagcgtccgggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccaggtggatggcaatctgctggcgaccacggacctaagccagtacaaggaccatggtaattggatcgagattctacgtgtggataacctggtcatcaccggcaagggaaaccttgacgggcagggcccagccgtgtggagcaagaac

SEQ ID NO: 65188 - DNA, 433 bp, Zea mays
  Clone ID: LIB3075-027-Q1-K1-E2
cggacgcgtgggtgagaaggttggcaggattttgatttacctttgtgaggggaagaaggtgaagatggcacactcattataccgtgcagtgaaggaaaaaaagattccagtcccaaaactagctttggatttccttgttggtgctttggcaaggaatgatgagaccattggtactgctctggagctgctggaagagtatcaaggggagtcgcttaagcatgcaggcaagtcctttgccacagttgtacatgctttgtgtacggtaaacaaaatggacgatgcaaataattcgctgatgaggatggtgcagcttgaagagtacaaaggggaatctcttaagaatgcaggcaagacatttgccacagttatacatggtttgtgtaagaaaaagaaattggaggatgcaaaagcctctgtgatgaggatggtaaat

SEQ ID NO: 65189 - DNA, 448 bp, Zea mays
  Clone ID: LIB3075-027-Q1-K1-E3
ggcgacgagtcggagacggcggtgcgggcgtctgaggagttgcgggactggtccgacatggcgccagtgtgtcttgccgaagcgttctcgcggctggcgctggaggacctgtggcgcggcgccatgccgtgctgtcgctcctggcgggacgccgcgcgctcgcgcccgggactcttcgcggtgcttgacctcgagcccgggtttgctgagttcacacctggcgccgaggcgacagcgtggtggacgccctcctttcagcgccgtgatgacgccatggtgcgctttgacagcacgttcgtcgaggtggagctgcgtgagatccatgtacaccactgtttcgacgactcgctcggcttcggcggcgagaggtctgctagacttagtatcctttcggtcaaaactagcctggcagtaaccgatcgatcaatgcttattgtcggagcatgct

SEQ ID NO: 65190 - DNA, 459 bp, Zea mays
  Clone ID: LIB3075-027-Q1-K1-E4
agcaggtgttccgtgagcaccacgacggcggcggcggcggcgacgacggcggcaacccgttcgcggcgcagctgatggaggtgatggagctgctgcacggcaacctggaggccaagtcgcggctgtacaaggacccgtcgctgagcaacatcttcctgatgaacaacgggcggtacatgctgcagaagatccgcgggtcggcggagaccaacgcgatgctgggcgaggcgtgggcgcggaagcagtcgaccaacctgcggcagtaccacaagaactaccagcgggacgcgtggagccgcgtgctggggctgctccgcgacgacggcgtgctgacggtgaagggccacgtgcagaagccggtgctcaaggagcggttcaagcagttcaacgccggcatggacgagatccaccggacgcagggcgcatgggtcgtcagcgacgagcagcttcagtcggagc

SEQ ID NO: 65191 - DNA, 470 bp, Zea mays
  Clone ID: LIB3075-027-Q1-K1-E5
acaacacatacaggaaaagcaagcaagaatcatcggaataatggctcgtgcatgtgtgttcctcgtcgtgctcctcctggccggcatcgcggtggcaccgttcgcgggcgccgcacgcgtggacgtcgtggagggtaggtccatggcatccgccgatgcaccggaggcggcggccgatgctcccgctcctagccccgactccgcctcatccccagactcatcgtcagaggcgccctccagcagcagctcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattgtttatttctttatttattatatgtctctctcggttgattgttatttttcttaatgcatgtaatataatttggtatacc

SEQ ID NO: 65192 - DNA, 427 bp, Zea mays
  Clone ID: LIB3075-027-Q1-K1-D2
cggacgcgtgggcccgaaactgaaggacttcaaatttaagcttggcagtaaacggcgcttcctcattttccccatcaaaggatcagaaagaaggggcctagaaagtgttgaggccaagaagaaaaatggacagtatgacatgaagctactagctgttgacataccaatggcatcaagtactgaccagtggctgttcctcgtcagtgatgaacaagagtacaacgtgggcggaggcttgatatctgagctgagagacccgatcgtaaaagctattgccgctgataaggagtttgactatcttgaagaggaagcggaagcattgatgcgccaggaggaaaggctgcgccaggcgggtgaagagcgtatgcggcgcgaggaagctgatagcctggataaagctacgtgacacgacgtactgtactgactt

SEQ ID NO: 65193 - DNA, 448 bp, Zea mays
  Clone ID: LIB3075-027-Q1-K1-B9
tcttaagaagacgatgttcggcgtccgcatcaaggcgtacgaggacgccgcctgcgtgctcaccgtctccaagatccactacgagaatatcaagatggaggactcagccaaccccatcttcatcgacatgaagtactgccccaacaagttgtgtactgccaacggcgcctccaaggtcaccgtcaaggatgtcaccttcaagaacatcaccggcacctactccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccatcgactgacccatctctctagttataattcttctctcgtccttgcattg

SEQ ID NO: 65194 - DNA, 461 bp, Zea mays
  Clone ID: LIB3075-027-Q1-K1-C1
gctagtatggtcccactagcttgtgggtcactactgccaggaggaacggcatatgatgaagtgcattcggacatatactcatgagcatcatcacgtgctcgcgttggcctaccatgtccaactgatctgccatctggtctataacgtgcatgattacaacgaggctcagtattggacaggtatacgtatgggctttcggatccgactggaacacagcgctcagctattgacaggtatgcgccatcactcgatggaacgaacacatcacgatcgaggagctccttgcctgagcagtacccgttcggacaacctggatcttccggtggcggatggcctcatcactgatcgctggaacttggtccttagatttgaccagcagacgtgcaaccgatttcttgagtccggtggagcctaaaacctatctacggtctaactttatggatcctactagtcgtttcttc

SEQ ID NO: 65195 - DNA, 435 bp, Zea mays
  Clone ID: LIB3075-027-Q1-K1-C10
cccacgcgtccgctcctctcccgtgctcaccacctcccccattttcgccgccccctccgatctcgccgttctcgtctccttccgttggattagggctcttcatctgttcgccgcacttcgtcagtcgcccatggcggatgaggaggtcactgatccaaaggcgctcctagaggatcgttcaaaggctaagtgtgtgtcgcagtggtatgattatcagaaatgtgttaaaaggattgaggacgatgagactgggcacaagcactgtaccggtcagtactttgattactggaaatgtgttgacaagaatgttgcagagaaactctttgagatgttaaaatgacaaatttttcctccatttatccacctaaagttggtaataattgtaccacttgggaggcctatagactattaaggcacttaatatttgtcagagaa

SEQ ID NO: 65196 - DNA, 438 bp, Zea mays
  Clone ID: LIB3075-027-Q1-K1-C11
cgaacggtgagatgcgggtagaactgcacacgacttggatcacgaggatgctggaggacgtggtggccgtagcgcttgacatgagggcctccgatgcttgacggtagggcctctcgcttgaagagggcgggcaggacctacgtgcttgagtaattcacgtgcactacattaaccatccgataatgtccagcaggctttcatagcctcatcgccaaactgcatgttgacggcagcacgtgtaacattggcctttgggacactgttaggtcaggaacgttacaacatactgagaccactgagctatcgtcgaactgatgtgtttcttctggctttctcactgatcagtattgccatctttgaaaatgtttcgaagaattggatacctgaactgaagcattatgcacctggtgtgccaattattctcgtagggacaaagct

SEQ ID NO: 65197 - DNA, 193 bp, Zea mays
  Clone ID: LIB3075-027-Q1-K1-C12
aaaaatgttgagaaaataggtggggttcaacagagataactgctgtttgaggcgtatgcaatgggtctatcggatctagtttgacagtatagtctattttatttagagataaaaatcgcttgtttaagaataagtaaagctctttatttaagaagaggtgtttgagaattaagacggaatgaccgttttcttc

SEQ ID NO: 65198 - DNA, 61 bp, Zea mays
  Clone ID: LIB3075-027-Q1-K1-C2
aaaaaaaaaaaaaaaatgaaaaaaaaaaaaaaaaaaaaaaaaaaaaggacaaaacatactg

SEQ ID NO: 65199 - DNA, 192 bp, Zea mays
  Clone ID: LIB3075-027-Q1-K1-C3
ttttttttttaaaaataaaatggctttaataccgagatctatagttacaaatcgggagtagtagctttatatgctactatcgatatacaaaccgagagcacagtacatatggtcacactactacaggtgcacgcatgtattgccgcttataaatgtgggaaaaaaaaagataacccgtttctctagcaatgg

SEQ ID NO: 65200 - DNA, 207 bp, Zea mays
  Clone ID: LIB3075-027-Q1-K1-C4
acgcttactttttaaaaataaaatggctttaataccgagatctatagttacaaatcgggagtaggggctggatatgctactatggggatggggaccgagagcacagtgcatatggtcacactactacaggtgcacgcatgtataggcgcttataaatgtggtaaaaaaaaagataacctgtttctctagcaatggaaagaagaacat

SEQ ID NO: 65201 - DNA, 413 bp, Zea mays
  Clone ID: LIB3075-027-Q1-K1-C5
gagccaacagagcgcagaagctgcacaactaggaggtaagagccaacagagcaacgcccaggcacacgcgacacgaaccaggcaaaccagctgccgagggaggaaccctagcggaacactgtgcaggtgacggcggctcgctaccggagacgggggatacggcggcatcgcccccctcggcccctcctacatccacggcgcggcggcgccagcagccggcctgcaggattccacgtcgtccatggcgcttgtcgagatgtgtgggcagccgtgcagcggtaaaacagcagccgacacttgccttgctgtggcgctgcactcctgctaacctgacctcactgtccgaatcatcgatgagtcatcccttcatctcaggcgcaacgatagctacaaagatatggttgtggagaaaa

SEQ ID NO: 65202 - DNA, 457 bp, Zea mays
  unsure at all n locations
  Clone ID: LIB3075-027-Q1-K1-C6
gttcgttcacgccacaggcaaggcacagaggcttgtgagggagagcgaggagcggaggaggacatggtgcacgggacgctggaggtgctgctcgttggggccaagggcctcgagaacaccgattacctctgtaacatggatccgtatgcaattctcaagtgccgttcacaggagcagaagagcagtattgcaactggaaaaggaactacccctgagtggaatgaaaactttatcttcactgtgtctgaccggacaacagacttggtaatcaagattatggacagtgatacaggcacagcagatgactttgttggtgaagcaacgattccattggaagcagtgtatactgaaaggagcattccaccaacactctataatgttgtgaaaggtgaaaaatactgcggngaaatcaaagttggtctcacattcactcctgaggatactcggcagcggggtc

SEQ ID NO: 65203 - DNA, 458 bp, Zea mays
  unsure at all n locations
  Clone ID: LIB3075-027-Q1-K1-C7
cggacgcgtgggcggacgcgtgggggcgtccgagggcgacaacaagaggatgatcacgctgaggagctccgacttagaggagttcgaggtggaggaagcggtggccatggagtcgcagactctccgccacatgatcgaggacgactgcgccgacaacggcatcccgctccccaacgtcaactccaggatcctctctaaggtcatcgagtactgcaacagtcacgtccacgccgccgccaaacccgctgactccgctgcctccgagggcggcgaggacctcaagagctgggacgcgaagttcgtcaaggtggaccaggctacgctcttcgacctcatcctggctgccaactatctgaacatcaagggattgctggacctgacctgccagacggttgctgacatgatcaagggcangactcccgaggagatccgcatgacattcagcatcaagaacgact

SEQ ID NO: 65204 - DNA, 440 bp, Zea mays
  Clone ID: LIB3075-027-Q1-K1-C8
cggacgcgtgggcggacgcgtgggcgatgacgatgttccagagcttgttcctggagagacttttgaagaagtagctcaggagacaaaagcctgatcataggctctaaatagtgaaatgttactgcaccaatgctgtgaggtcatggttttcgtgtgatggcactcttcttcctcccctcctaggccagccccagccactctttgtgttcgctgttggaaacttttagtttctccatctcaagcttttacctaaggttgtgcatgttgagatgccatggaaatccattttgctgattatttggtttgtggtcggttcacaacattacatgtgcaccaggttttgctgggttatcactatataatgtttgtgtagtctagaaaaaaaaaaaaaaatacatgacaataaatactgtaattgctttacaacttagcttgagaat

SEQ ID NO: 65205 - DNA, 443 bp, Zea mays
  Clone ID: LIB3075-027-Q1-K1-C9
ggcaaccagtgtcggtgagaagaatgtcctcatttttgaccttggaggtggtaccttcgatgtctccctccttacaattgaggaaggtatctttgaagtcaaggccacagctggcgacacccatcttggtggtgaggactttgacaacaggatggttaaccactttgtccaggagttcaagagaaagaacaagaaggatatcactggcaacccgagggctctccggcggctgaggacctcttgtgagagggccaagagaactctgtcttccactgcccagaccaccattgagattgactcgctgtacgagggcattgacttctactccaccatcacccgtgccaggtttgaggagctcaacatggacctgttcaggaagtgcatggagcctgttgagaaatgcctgagggatgccaagatggacaagagcagcgttcatgatg

SEQ ID NO: 65206 - DNA, 402 bp, Zea mays
  unsure at all n locations
  Clone ID: LIB3075-027-Q1-K1-D1
agctgaagctggaagaaggacaggacgtcacagcactcgctctagaccaagaaaacaccacgcttctggtttcgacagctgataagcagctaatagtctacacgggtccggctccaagtaccccgtaggtcaatccattagctccccggtgcttggttggaaaattgtaatggagatcagcgctagctatcttgacggcccaactgacagtgagctcggagacgacagtacagataatgcacgttaggcgacgggcttctcttgccgtgagcatggcgctgctgtacgtagaggctccaatggattgtgctgtaatacaagactgagactggaacctgaaatgggcgacatgtgcaccaaaaggtgaagagcccgtgcgctgctggaaaactctnctgtaca

SEQ ID NO: 65207 - DNA, 418 bp, Zea mays
  Clone ID: LIB3075-027-Q1-K1-D10
gacagggcaggcactcgtcgttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgacttccaataatagtaacaacaaagcaaaggccttcctcccggcgtatttgctttggctcttctcctccacgccataagatatctagcaattggtcactcgccttaattagttcgctttgcttttgaggttgattcgaccattttgctgtagcgtgaattgcatgcatggacatgcaacgctccaatggcccttggaatgtggaattttttttcccattttctggatttttcctataaaaaatgaactggttcttata

SEQ ID NO: 65208 - DNA, 440 bp, Zea mays
  Clone ID: LIB3075-027-Q1-K1-D11
ctgagttcaagtctggtgcagagaggaaggatgctgcggagagcaccatgaatgcctacagagctgctcaggacattgctcttgcagatctggctccaacccaccccatcaggcttggccttgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagctcctgcgcgacaacttgaccctatggacttccgacaccaacgaggatggcggcgacgagatcaaggatgctgctgccccgaaagaatctgcggagggtcagtaagatggattcagtctcacgacctgctgctgctgatgttgaggagtgaccagaaccagaaccgtcgtc

SEQ ID NO: 65209 - DNA, 439 bp, Zea mays
  unsure at all n locations
  Clone ID: LIB3075-027-Q1-K1-B8
cccacacacacaaaagcaaaaagcatcatcacaataatggcccgcgcgtgtgtgttcctcgtggtgctcctcctggccgccgtcgcggtggcgccgtttgcgggggctgcgcgtgtggatgtcgtggagggcaggtccatggcgtccgccgacgcgcctgaggcggcggctgacgcgcccgctcccggtcccgactccgcctcatccccggactcgccgtcggaggcgccctccagcagcagctcatccgactagccgcgcacaacgcagttcttgtcatgatctatctagcanataaaaagatcatatgtctcgtttgattctctggaataactaatagtatatatgctgcgcccggatgatatataaatatgtgcatcaaatgcgtgcggcaaacgcatggaatgtgcttgcctagctagctaattgttgttntttt

SEQ ID NO: 65210 - DNA, 235 bp, Zea mays
  Clone ID: LIB3075-027-Q1-K1-D12
gctcgagcgacccgtcagagcaagtactgtgcatagaggtatactacttgtcattgagacagtggtacctacacggcgggtgagcagatttcgccggctgccctcgtgatcatgcgatcaacctactatgggcgagctgtgacctatagcgacagcgaatagtagaccatgagagttccggtgctatcctgcacacgttcaacgcctgccttcaaaaatgcatagatgtgagtta

SEQ ID NO: 65211 - DNA, 449 bp, Zea mays
  Clone ID: LIB3075-027-Q1-K1-A3
ggaaagagttttttgtgattggtattcagtgggcttcaatatatcatcctgcactgtggtgtgccttttctctaatcttttcgttgcttcttgtaccacaagttttagcagtggtattcaaagatcggttcacatataaatctctatgcgcatatggtgggcagaggacactgttgaagtctctagttggtggtttcatctgttgttttgttgaactcgccaggctggttcttgtatggttattgctactgttatatgctatctatttagtttttataccttggttattcggtcaccctattactgaagatggtagcctgacttacatgacacataaaggctggattctgaaaggacccagtagtagcaacgaagtagtccatgctgggattccagatgtcatggtcattggtctacctcacctttgctttgtgttagtacccaccatt

SEQ ID NO: 65212 - DNA, 331 bp, Zea mays
  Clone ID: LIB3075-027-Q1-K1-A5
gcacattgcacagccaaaaaaaaaacaaaaaacaaaaaaaaaataaaaacataaagggaaaaagaaaataaaaaaaatgggaactgccaaaaaaaaaaacaacaaataaaaaaatatactgctaaattttgataatacacttagcaattctaaataagacagattaacaccagaagaagcaataatgattgagctagttacccttacagttttcatggaatataatagtccttacgatacttgactaacttgtgcaatattgaactctactacgccaccctattccaaacgattattagggaatatatcactttgacatccattgcatctc

SEQ ID NO: 65213 - DNA, 456 bp, Zea mays
  Clone ID: LIB3075-027-Q1-K1-A6
cggacgcgtgggtgcaggtgctgtgattccttttggatccatggaggacgccttgaagaaaagtggatcaatcaaatcctacactaatcttctagagaggatcgaaacagctcaaattgaaaatggtgaacttgatagcctatcctcgaagcttcaagcaactgtttcacttctttctccatcggaagaaatcattgaatctttgaagaaaacatttgatcagaatgttcgactaattgtgagatctactgctaatgtggaggatttggctggaatgtctgctgctggactctatgaatcaattcctaatgtcagtctctctgaccctagatcctttggagctgcggttggacaggtttgggcatcattatacacaaggagagcaatccttagccgtcgagcagccggtgtacctcagagagacgcatagatggcggttctcgtgcaagaaatgct

SEQ ID NO: 65214 - DNA, 446 bp, Zea mays
  Clone ID: LIB3075-027-Q1-K1-A9
agctgttgtgggtgctcaagatgggaaactgagaatctattccatcagtggtgatacactgacagaagaagctctgcttgagaagcaccggggtgctatcacttccatacattattcaccagatgtttctatgtttgcttctgctgatgccaacagggaagctgttgtgtgggatcgggcaagtagagagatcaaactgaagaacatgttgtaccacacagctaggataaactccctggcttggtcaccggacagtcgattggttgccactggctcactggacacctgtgcaattgtctacgagatagacaagccagtagccagtcgcgtcactatcaagggagctcatctgggtggagttcatggtttaaccttcctggagaatgatactctggtgactgccggcgaggatgcttgcattcgtgtttggaaggtggtggagtaat

SEQ ID NO: 65215 - DNA, 341 bp, Zea mays
  Clone ID: LIB3075-027-Q1-K1-B1
cggacgcgtggagagagagagagtcccgaagcgagcacaagaggccaccgcacagcggccaggcggggagcgagacacctccacacgtgtctcccccttcccctccccttccgttccctctgtagctgcgcccgaccgaacccccctaccccgtggaatcgtcctccgatgcggcgccgataggggctggcggaggagcggaatggcggcgcacggcgagaagcgtcgccgtacggcaagggcccacgagaagccggaagaggaggaggaggaccgcatctcggatcttccggacgtactgcgcctgcacattctgagcctgctgccgttcaaatcgacca

SEQ ID NO: 65216 - DNA, 441 bp, Zea mays
  Clone ID: LIB3075-027-Q1-K1-B10
cggacgcgtgggcggacgcgtgggggattccccactcgccggcgacaaccgccgcgcccgagccgtctgctaggtcttgcacctccgggctctgggcatggctgccgaagctggcccaatctccaaggtcctcatcgtcgtagcgatgcagacggaggcgatgccgctcgtccacaagttcaagctcgtcgaggcgcccgcccacgaatccacatttcctaaaggtgccccatgggttaggtaccatggcaactacaaaggcctccacattgaccttgtattgcctggaaaggatgctgctttaggagtcgacagtgttggtacggtatcagcagctcttttgactagtttttccattcaaacactgaagccagaccttatcattaatgctggcactgctggtggcttcaaggccaaaggggcaagcattggagatgtatt

SEQ ID NO: 65217 - DNA, 442 bp, Zea mays
  Clone ID: LIB3075-027-Q1-K1-B11
gtgatttgaaataattgggaataaatagttcgtgaatccctgaagcgtgcatatatatatgcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatcttgttcat

SEQ ID NO: 65218 - DNA, 443 bp, Zea mays
  Clone ID: LIB3075-027-Q1-K1-B12
gctgaaagcagttagaaacgagataaaaccagatcctatgtccacgatgagggcaccccaagttccttccatgctaccttttaacaatcttgcttttggcgcaacatttggtggtccagctagtctgaagcccatgacaatggctccaatgccaatggccatgcctatgtcaccagctcctctcacaaagaagccaactccagcagcagcaactcctctttgtggtaaaagtgataccgataacttgaagatggctaaacaggtgctgaatgaagatatctcaaagttgcaatctcaggttaataaactgaaacaaaaatgtgatgcccaagaagagcaactgcagaaagcggaaaggagagctgaacattctgcctctacagctgcagaagagtcttcaaggcgtaatggtgtcttggagttcattaggttccttgacaatg

SEQ ID NO: 65219 - DNA, 195 bp, Zea mays
  Clone ID: LIB3075-027-Q1-K1-B3
cttctatgacgccctggtgaacgcatactataaccccaagagggcactaaatactaggaccggcggggactgtatccatccaggtcgggtgacggtgagcacagtatgaccaattactggcgtctactggacaagactgacactaaacagtcttgctcctactccaaggggcgcacaccacatgcaggtgacctt

SEQ ID NO: 65220 - DNA, 447 bp, Zea mays
  Clone ID: LIB3075-027-Q1-K1-B4
gcaaagcagaaccccttcgccattttcaccaactccctccgatcccggccatggcgggggaggactgccgctccggcgcggaaatggacgcgctcgtacgacgcttgaagctccaccagccgtccccatccccctacgaccccgatccggccgcggcccccgtccccgccaccgccggcgacggcgagctgttccggccgcggagagctgccgtgcttgtctgcctcttccggggagacggcggcgagctccgcgtcatcctcactaagcgctcgtcctccctctccacccactccggtgaagtttcattgccaggaggaaaggtcgaggagggtgatgctgatgatgtagcaacagcgttaagagagtcaaaagaggagattggacttgatccagctctggtaactggggttgcctctctggaacacttcttggccaagcatcttc

SEQ ID NO: 65221 - DNA, 443 bp, Zea mays
  Clone ID: LIB3075-027-Q1-K1-B5
gaggaacactgtcatcccgaccaagaagtcgcaggtgttcaccacctaccaggaccagcagaccactgtctccatccaggtctttgagggtgagcgcagtatgaccaaggactgccgtcttctcggcaagttcgacctcaacggcattgcgccagctccaaggggcacaccccagatcgaggtgaccttcgaggtggacgccaacggtatcctgaacgtgaaggcggaggacaagggcacgggcaagtcggagaagatcacgatcacgaacgagaaggggcggctgagccaggaggagatcgaccgcatggtgcgggaggcggaggagttcgcggaggaggacaagaaggtgaaggagcggatcgacgcccgcaaccagctggagacgtacgtgtacaacatgaagaacacggtgggcgacaaggacaagctcgcggacaagc

SEQ ID NO: 65222 - DNA, 467 bp, Zea mays
  Clone ID: LIB3075-027-Q1-K1-B6
cgacacgtcgtccagcccggagcagaagccgaagttgatcgccgagtgtcaggccggcgatgcggtcgtgctcacctacgcctgcgaccggcccgccacgctggagcggctcagttcgttctggcttcccgagctccggcgactccagctgaaggccccagttatcgtggtggggtgcaagctggacctgagggacgaacaacaagttagccttgagcaggttatggcgcccatcatgcagtccttccgcgagattgagacctgcattgagtgctccgctcttcgccagatacaggtgcctgaggttttctactatgcccagaaggcagtacttcaccctactgcccccctttttgatcaagaattacaatctctgaagcctcgatgtgtgagagcgttgaagcggatattcattatatgtgataatgacaaggatggtgctctcagtgacgtggagctcaatgaat

SEQ ID NO: 65223 - DNA, 105 bp, Zea mays
  Clone ID: LIB3075-027-Q1-K1-B7
tcgccggcaccttggccgaaccctggccgacccctggtggccctttaaaattctgaggccccgggcccttcggcttccttttcgggttcccgtccccaaggccat

SEQ ID NO: 65224 - DNA, 357 bp, Zea mays
  Clone ID: LIB3075-027-Q1-K1-A2
gtttttcttgtgctttctggggggaagaaagcctagcgccgtgcttgacgaagtcgtgctagcgcttgcacttgcagcggcggtgtacgatttggttggagccggagcgtgaagtctcaagtgatcctgcaactgtcctgtcagttaaactcaaagatgttggaaattgtagtacgatgcggcccctgcgagttttgtagagttgaccctctttcattgtttttttttaaattcaaatcaagtttcattaaaaaatagaactgtaaaaactttacaaagccaataaatgattaaagattaaaaatctgttacagatagttgaagagcaataattctgtacaaaaaaaaagggcggcc

SEQ ID NO: 65225 - DNA, 368 bp, Zea mays
  Clone ID: LIB3075-026-Q1-K1-G6
atctctgcggagtaggtcgcctgacgaactcacaaatcacaaggatacgccgagacgcgcgtctcgtttctcccttcctcagctgctggccccctgcctgcagccattgccccgctcctcgaggtcaaatggcccctgcccccgctctcaccgccacatccgtcctgaagcgatcccacctacccggcgtccactcgttggccggtcgccggcagccggggcgggaccgcgtctcggtgctttctccagcgatcccgccgccccgcgtttcatggcagcaaggatctggagtggttgctaagaggctcctctgggcgagtgcgagtggttccttcgagaaagataacatcggggaggacgtggtgttg

SEQ ID NO: 65226 - DNA, 388 bp, Zea mays
  Clone ID: LIB3075-026-Q1-K1-G7
aaacctatcatcatcttctccgatccatcatcaatcgccgagagcgatcgagagataaatgaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaaggggcaagtgcaccgagcagaatggcatcaccgggccgcagatgaaggtgtgccaagaggcgtgcgacaaggacta

SEQ ID NO: 65227 - DNA, 325 bp, Zea mays
  Clone ID: LIB3075-026-Q1-K1-G8
atcatcttctccgatccatcaacaatcgtcgtgagcgatcgagagataaataaagatgaagaaagtggcatcatcgtcagccggtctcttcgtgctagccctgacgctagtttgtgccccgctgatagcagaggcaaagaagaagagagtcgccgtcgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaag

SEQ ID NO: 65228 - DNA, 130 bp, Zea mays
  Clone ID: LIB3075-026-Q1-K1-G9
gaggcggttaagctcctccccggcaacgtattcaaacctggccacctgatccatatcccgggcgtttttaccatattcgaagcggacatcaaagagcacgcacgtcacgacttttactttacgctcaagg

SEQ ID NO: 65229 - DNA, 309 bp, Zea mays
  Clone ID: LIB3075-026-Q1-K1-H1
cggacgcgtgggccggagccgcacgggcgcgagcgaggcaggcagtggctcctcccccctccgggcgatatcagctcatcgatgcgtcctatcacacacatatcattaccgctcctcttcctctcctatgcttgtcctctaactcattggcagaagagaaaaaaaaagtccttgttgagttgttgtatcgggttctggtggtgactgttactggggtttccttgtccggttcttgattcgcgcaaggacagatttgccgtcctctcgggttccgccgggcggtgctgaaatcctccttccctgttccct

SEQ ID NO: 65230 - DNA, 389 bp, Zea mays
  Clone ID: LIB3075-026-Q1-K1-H10
gtcctcgacaaggacggctccggcaccgtcttcgtcgccgacctccgccacgtcctcacgtgcatcggagagaagctcgaggtgcacgagttcgacgagtggatccgcgaggtctacgtcgcgcccgacggcaccatccgttacgacgacttcatccgccgcatcgtcgccaaatgatcccgtcccctccgagtctccattccgccgatccacccttgcgcgctcttcgtctgtaataacttcgtctcccatccgcgtgatttcattttggttcccttctatggctggctcatttgaattcaatctggcctccctttcgttcccagactgctcggataaaacggataatggttgctgtgtgttattaaccctttcacggtttttttttt

SEQ ID NO: 65231 - DNA, 203 bp, Zea mays
  Clone ID: LIB3075-026-Q1-K1-H11
cagacgcgtgcggttccttcctcaaccttattttcggctctcaccagagaaaaattgaggagcattaaccaaaggatcagagggccaaagctaacatggacaagcctgtgatgaaccaatgagtatctccagaagctttcgttaaagtgcaaccaaatccgatatcactttgatctggttagcttaaaaccaacgcttttaat

SEQ ID NO: 65232 - DNA, 352 bp, Zea mays
  Clone ID: LIB3075-026-Q1-K1-H12
atcaagttcctgacggtcatgcagcgccatggctacattggtgagttcgagtacgtggatgaccacagagctgggaagatcgtggtggagctgaatggaagactgaataaatgtggtgttattagcccacgttttgatgtatgtgttaaggagatcgagggatggacggcgaggcttcttccatcttgccaggttggctacatcgtcctaacaacttctggtggaattatggaccatgaggaggcccgccgtaagaatgttggtggcaaggttctaagtttcttttattgaaaatggtgttttttgagccacaaatgcgttcaagaactctgttgatgttttgaggtttgtt

SEQ ID NO: 65233 - DNA, 219 bp, Zea mays
  Clone ID: LIB3075-026-Q1-K1-H2
ccgacgcgtgggccgaagcctcacgagcgcagagcggagattgcagcgactcctcctccctgcgggcgatatacgctcatcgatgccgtctatcacacacctatcattaccgctcctcttcctctcctatgctatgctctctaactcattgtcaaaatagaaaaaaaaagtccttgttgagatagatgtatccggattctgcgaggtgacctggtactg

SEQ ID NO: 65234 - DNA, 268 bp, Zea mays
  Clone ID: LIB3075-026-Q1-K1-H3
ccaatatgatgaagctacgttctgaatataatgatgaatctgtcacaaagcatggtgtcaaagtgggtcttatgtctagctatggcaaggctgctgaatatgcacttcaaaaccagccaattgttaatgctgccattgctggcaatgacatcatatacagagactacgtatacgtcaccgacgctgctggcacttccaagggcccagtggtgcctggtatccgagatgctcataccatgaactttgctgacattgagaaagggatgaa

SEQ ID NO: 65235 - DNA, 318 bp, Zea mays
  Clone ID: LIB3075-026-Q1-K1-H4
gataaaaccatcgcttacgtgggcgattctctatggaggcagtgtttcagtcgatgatgtgtgtggtcactggtggaaaggagaggctggatatataaaatattggcgcacagtatggctttgtgttagcgccgggtgcaaaaaagccaaacggctgggcctaccggttcccgagcaccaacacaacaattctataccactggtcatcaacgctctgtgatttggagcccctgaacccatcataccgagcgaccagttatgccatgcacctggaccgcccgcctgcttttctgaagagcaacctccacaggctccatg

SEQ ID NO: 65236 - DNA, 380 bp, Zea mays
  unsure at all n locations
  Clone ID: LIB3075-026-Q1-K1-H5
tcgacgacatcgtcttctncaacaaggacggcggctacgtccgcgactcgccggaccacttcggctggcgcaccgtcttcgacggcgacggcatcaccgtcttcggctccaccaacgtgtggctggaccacctgtccctcttcaactgacaggacggcctcatcgacgtcatcgacaagtccactggcgttaccatatccaactgccaccttaccaaccacaacgacgtcatgctcttcagctacagcgacaagcatcccgaggaccagatcatgcagatcaccgtcgccttcaaccacttcggcagaggcctcgtgcagaggatgccaaagtgccgctggggctttttccacgtggtcaacaacgactacacgcactgg

SEQ ID NO: 65237 - DNA, 277 bp, Zea mays
  Clone ID: LIB3075-026-Q1-K1-H6
ggcggtgaacggagtatcctacctcccacatctagtgctgatgggcactggagcttacctgtgcatgacacaagctgcgcttgcggtgggctcactttttgatcaagttttgattccagcccgatattgggtcagttatcctgagatggatagactggctgatgcgactccagtgattcttactacaaacatatcagagaatttcttgttcatgccagagttgcttaccgactagatcaatgagaaatcgaggctcttaattctctgctctacatct

SEQ ID NO: 65238 - DNA, 154 bp, Zea mays
  Clone ID: LIB3075-026-Q1-K1-H7
gaaaatacgaacgggccatcgtgtcatggtgctaccacgtagataaactctggcttgctcgtacttttcagatgcatggttggacaacaccttttacttccagcaaaaaatacataatatgcatgtactcctcattttttccgtatagtaatat

SEQ ID NO: 65239 - DNA, 403 bp, Zea mays
  Clone ID: LIB3075-026-Q1-K1-H8
atcgagaccggctgcccgaccccggtccggcgatccctctgcacccctttctttgcgctgccagccccaatctctcggatccctgtcaaccatggcggcgtcagcaggcggaggcgcggtgcgcgcgctgtcccagaaggagcaggacatacagatgatgctcgcggccgacgtccacctcggcaccaagaactgcgatttccagatggagcggtatgtctttaagcgtcgcaccgacggcatctacatcatcaacctgggcaagacatgggataagctccagctcgcggcgagggttattgttgccattgagaacccacaagacatcatcgttcagtcggcctcgccctacggccagcgtgctgtcctcaagttcgcgcagtacactggcgcccatgccatc

SEQ ID NO: 65240 - DNA, 356 bp, Zea mays
  Clone ID: LIB3075-026-Q1-K1-H9
cggacgcgtaggcagacgcgtgggccggtcttaggccgacatctggtcctgctgcttaagggtgttcgtgctactcgccgggtgcctcccgttccacaacgccaacctgatggagatgtaccgcaagatcagcacatccgacatcaagtacccatagtggttatcccctgaactccagcgggtgatgcccaagcttctttaaccgaacccaaacaacaggatcacgatcgagaagctactcgagcaccccatggtcaagaaggagtacaggccggccgtcatgctggcacatccgcacggcttcagcagcctcaatgatgtccaagtctgcttcagtaacaccgaccacaaagaca

SEQ ID NO: 65241 - DNA, 348 bp, Zea mays
  Clone ID: LIB3075-027-Q1-K1-A1
gacgaatggaatagggcctgtatgaaacatgcagatgacgaacgcgatctaacttatgagggcatcatagagtctgtatcgggtgaactggaaaaggagctccacacatatggagaggacacgtgaaaagcacgctactacactggatcatctggaccgggttgataggcatgaagagtcacccctgattgagcaagctattcaaacacgcatagtggacgattaagaaccttgacgatcatgaggcactttcgcagatacaactcgataggcttcaccatgcctaacactgactcgagaaaaattgactttcacagacgttcgagcacaataatgctgtaccggaga

SEQ ID NO: 65242 - DNA, 439 bp, Zea mays
  Clone ID: LIB3075-027-Q1-K1-A10
ctgcgattcccggcgctgatgcgggagtggccatcgccgtcgctgatcccggcgtccacgctgctccccgtgccggccacctcccaggaggacgaggtcctcctcgccatggccgagtccgacctcgaggacaagttgaatgagatccggaagaccaacagccacctgattatcatcgggaagcccacaggcgacaccaaggaggagtatgacgctgacgtggaggacgacgatgcagacaacgtcgaggagtctgatggcgatgacttcgaccaggagactggttgacccaggcggctccccgctccccccctgcttcgccggcatccttgagcgtcgccatccccactgcccagtctgtatttcgcaatccctgagtcgctcctgctatctagatgttctgtgttaccctattctgctgctgctgtctgttctcgga

SEQ ID NO: 65243 - DNA, 314 bp, Zea mays
  Clone ID: LIB3075-026-Q1-K1-G5
ggccgacattggttttttctatttgcaagattatgtactgttgatcaaaataacagcactacgcatcatacaacatgctctaggagtaggatacagtaacacagcagcagaacatccaacccaacattctgccaagctctgatcaaacgccaaaacctgcaacatgcgatctactgaccgtacccaagtaactcaccccacaccctaccttgatcgccagagcagcttaccctctacacacactactgcgcgaggcacgcaccgaccacacggcgagctaattatgtatgagtaagtttagggactgggcttac

SEQ ID NO: 65244 - DNA, 442 bp, Zea mays
  Clone ID: LIB3075-027-Q1-K1-A11
ggaaaatcaagcgaactccctccccttgatgttccactcccaggcattagcattccctcacgtctaccagattttgtagagccatctaagacaaaagtcactactcttccaaatggcgtcaagatcgcctaggagacatcatcgagcccagcagcatctgtgggtctgtacattgactgtggttccatttacgaaacacctgcttcatctggagtatcacatctgttggagagaatggccttcaagagcacagtgaatcggactcacttacggttagatcgtgaggtagaagccattggaggaaatgtctctgcatcagcttcccgtgaacaaatgagctatacctatgatgcattgaagagctatacaccagaaatggttgaagttctcattgacagtgtgaggaatccagcattcctcgattgggaagtcaaagagcagc

SEQ ID NO: 65245 - DNA, 56 bp, Zea mays
  Clone ID: LIB3075-027-Q1-K1-A12
atccgatcatgctacctaagatgcgacgacgttactctatcagcatgacagcagat

SEQ ID NO: 65246 - DNA, 431 bp, Zea mays
  Clone ID: LIB3075-026-Q1-K1-E6
tggtacctttggggaggcgaggaaggacacgaggtcggcgcgttcgtgcgtgcccttctcactgcacgccgatccccctctccgaaccccgccgcctgccgcagatccgagggtcatcggcagccatgatctcgtccagcaagctcaagtccgtcgacttctacaggaaaatacctagggatttgaccgaggcatcactatctggcgctggattatccattgtagcagcattagcaatggtttttttgtttggaatggagttgagcagttacttagcagtcaatactaccacatctgtgatcgttgataggagttcagatggggagtttttaaggatagatttcaatatgagctttcctgcgctttcatgtgaatttgcatcagttgatggtagtgacgtgctgggaacatacagattgaacataacgaaa

SEQ ID NO: 65247 - DNA, 275 bp, Zea mays
  Clone ID: LIB3075-026-Q1-K1-E8
cgccgctttggttcctgtttccccacagctcccaactctctatatctcaatctcttggggatgtaccgtttcttgctttgacgcaaaccacatcaatctgtggccgttgtttccatcggagctgttgaggtttgtcttcttctcggccgaagacatggcggcggcgaacggagctgccggtgcggtgctgttcagcgaggaggacctgatggaggtgagtggggtgcgctggggagaggacttcgtggaggtgacgtgcggatgcaccagccacc

SEQ ID NO: 65248 - DNA, 251 bp, Zea mays
  Clone ID: LIB3075-026-Q1-K1-E9
gtgagagaaaccactgatctgacctgctgttgttcatctgaccacatgcgttcattgaggcggacgattacctggacccgacggcgcccaaaaccttccatggaaactgcctcttacctcaaaccaactgccaaatactatgtattccacccatatttgggcacaacacagcccataggtcccataacaccgcattttcacagttcaagccagaggagattaccaacatcattaaagacttctactagcct

SEQ ID NO: 65249 - DNA, 240 bp, Zea mays
  Clone ID: LIB3075-026-Q1-K1-F1
agcatgttagcccaaataggaaaagaaaactatgttatcttataccgacttaattcagaacatgtaaaaaaagcacgacatgtgcatagagaattgctgaaccagcaaagatcattcatcaacggcatgtcactttgcattgtggccacttcaatctggttcaagtttggtcagatcttttagtgtgttaacgcttatattacttacaacaaaagataagcccacgaatcagtagatcga

SEQ ID NO: 65250 - DNA, 357 bp, Zea mays
  Clone ID: LIB3075-026-Q1-K1-F10
cagaaccgcagaagtgcagcagaacgatcggatctagcagaattctctcaacctcatcggcggcggcgaagagcgtgcggagcggagatggcgacaagcgggtggaggaggagagcggctgcgcgggcctcctggagccacaccacggtgtacctgtggctcgcgctcgccgcagcagcactgacgcgcgcccaggctaagaaggacctaacggaggttacccacaaggtctacttcgatgtcgagattgacggcaagcccgcaggtcggattgtcatggggctttttgggaagactgttcctaagacagcagagaacttccgagctctttgcacaggagagaaaggaattggcaag

SEQ ID NO: 65251 - DNA, 87 bp, Zea mays
  Clone ID: LIB3075-026-Q1-K1-F11
gtgaaacacacggatgctttttctaccttttttgaattggacttcatgcacttcatcaggggcattattaacaatctcgaggggcac

SEQ ID NO: 65252 - DNA, 346 bp, Zea mays
  Clone ID: LIB3075-026-Q1-K1-F12
gtggagcaagctgttggaatgccatcagttgcccaaatattcaaggtccatagtgaagcgtgctttcgggataatgagagtggtgtcttgagagatttgtcctccatgcgacgattagttgttgccaccggaggtggtgctgttatccgaccaattaactggagatatatgaagaggggcctatctgtttggttagatgtgcccttggatgctcttgctaggcgtattgctaaagtgggaactgcctctcgtcctcttctggaccaaccatctggtgatccgtacgcaatggccttttctaagctcagcatgcttgcacagcaaaagggtgatgcttattcaaatg

SEQ ID NO: 65253 - DNA, 368 bp, Zea mays
  unsure at all n locations
  Clone ID: LIB3075-026-Q1-K1-F4
aagacgtgcaagatgtgctggatcggatcgcccggccggcgcatgcttaataatctgttatatgctcccgttgttgcatttcttgaacggattggagtgtctttgcgtactccctcagtctagagtcacaatatacttatacatgttgttaaggaataaggatggagggggatctttctaaaaaaaaaaaaaaaaaaaaaaaaaaaaaaaaaaaaaaaaaaagggcggcgctcgcgatctaaatttgccacgaattattattcatccnanaaaaataaaaaaaaaaaaattaaaaaaaatataaataaaatagaaaaaaataaataaaatctttttctggtaataatctggtgtttccttattttttt

SEQ ID NO: 65254 - DNA, 337 bp, Zea mays
  Clone ID: LIB3075-026-Q1-K1-F5
gcgcgaacgcgtgcatgcgcagacgttgaggtcgagggacacggtatctctgagcttcatcagagagcgacccgtcaccgtcacgcttggctcgaagccgagaagagtgccgggccgggagaccggacgataattgatccgtagcagattcgctaatggcggagacggcggacatggagcggatcttcaagcggttcgacaccaacggcgacggtaagatctcgctgtcggagctgacggaggcgctacggacgctggggtacacctatgtcgacgaggtgcagcgcatgatggccgagatcgacaccgacggcgacagctgcattgacttcaacga

SEQ ID NO: 65255 - DNA, 397 bp, Zea mays
  Clone ID: LIB3075-026-Q1-K1-F6
caagaagcagacaggccagctgaaggatattacattcgttctgggataactgtggtgctcaagaatgcagtaattctgaatggtacaaaaatttagaagattatagaattatctgcagaataccaatccctcagtgaagagcacagcattgaagcccacagcagagttctacgacgcagatgcagtcaataaaaaccccaatagcacaaaagattaggagactgtcgatgcagctaaagaagtgtggatataggcatggagcacctgcacctgcaacacgccaacggtacggacaaaccatgagcttgaggccatttcacgtcctttcataagcctcggctagtgccggcgcgcgcagggtatcttttgttccttttttctaacagtaatttacgtg

SEQ ID NO: 65256 - DNA, 242 bp, Zea mays
  Clone ID: LIB3075-026-Q1-K1-F7
tttctgctgtgatggttgccttggacaagtcatttttaccccactacggaaatccagcgacgagttttacgcggcgatgcggcacaacctgagcagcgtgaaggacacttttgaggaggtgaagcagctggaggagaaggccaatgctgtcatggcggttgcttgagcggcgattgcagcggcgctgaacaccattaataacgagacgcatgctgagctggagcatcagattgcttgaggga

SEQ ID NO: 65257 - DNA, 179 bp, Zea mays
  Clone ID: LIB3075-026-Q1-K1-F8
cggacgcgtgggccgaccgcgagcaagcggaccaaatcctgctccatattctatcgcgtgcacgcatctggccgcctcgaccctcggcggcggcggctgctactacaacgatgatggggctggagatggaggcgatggcggggtccatcggcgtgtcggtgcccgtgctccgggtcctg

SEQ ID NO: 65258 - DNA, 273 bp, Zea mays
  Clone ID: LIB3075-026-Q1-K1-F9
cgcacagctgctctaaaccctaggagcgtgcttgaacagtggcggatatgttatagcgagggaccctttcgccgtatcgaaggtctttgtatatcattactaccaaacgttcgataccaaccgtgctgggcttgatgggctgtaccatcagactctcatgctcacctttgagggtcagaatttccatggcccgtactacattgacggaacgcttggatctttccattaccaggcctgtgagcatcatatctttaactgttgactgccatccat

SEQ ID NO: 65259 - DNA, 131 bp, Zea mays
  Clone ID: LIB3075-026-Q1-K1-G1
ctcatgttgtttgttcttgcatgaggaatctaccactaatattgtcctcattgatgcatacatgtgtgaactcaaagcattgtgcatgctatacttatttatcaaacaaatacaaaagcttccttgtacct

SEQ ID NO: 65260 - DNA, 301 bp, Zea mays
  Clone ID: LIB3075-026-Q1-K1-G10
gtcctgctcacggaccagttcggcaccggatccaagcccgacctcctgcacctcatcacgtacgttggcaacatattcgaggtgcacatcatagaccacgggatccatgacttctactttacgctcaacgaggccctgacttacaactacacgctccacaccatcgccgcactaaagtacccgctctgcatacgctttattgcgacgattcacggttacccgctcttcgactacaataacttcgcctatcataagggtggcaccacctataatacctcacatggcttgttaataaccattc

SEQ ID NO: 65261 - DNA, 319 bp, Zea mays
  Clone ID: LIB3075-026-Q1-K1-G11
caaacgcgatcgatgcatgaaattccattctccgatctcggatgcgacgacaccacacgctgcgatggtggcgcgctcgaggcgacgtcattcgtctcggcagacatggcatgatagccacgagaggggtggcagcttgatgacaagcagtctgacaagaaaatgtaaggcatattaactggagacttctttacgtttatatgatgatgaatgagaaaggatggacagcatgggactgcacgagaaccatcagacaggcatctatgcctattgattaatgaagcgatgagatatttaccaaaaagctataatttcctta

SEQ ID NO: 65262 - DNA, 154 bp, Zea mays
  Clone ID: LIB3075-026-Q1-K1-G12
caaaaacactcgattcatgtggcttcttttatcaagagtgtattcaacgacaacatcaggagggttaattgcttgcttgaggcgatctcattttactctgccaacacctcatgataacataagagacgaccgggcgcatccttacaactgctct

SEQ ID NO: 65263 - DNA, 289 bp, Zea mays
  Clone ID: LIB3075-026-Q1-K1-G2
gagaaaggagggcctgaggcactctcagtcttatactgacaccaaacgagccaaacaacaatgtgctcagagatctcgtgtccggaagctccagtatattgcagagcttgagagaagagttcagtccttacagacagagggaatagaagtaactgctgaaatggattttctcggtcagcaaaatatcatgttagacttggaaaatcaagccttgaagcaacagcttgagagtgtatctcaggagcatcttattaaacggtatcagcaagagattgttgggagggaaatt

SEQ ID NO: 65264 - DNA, 409 bp, Zea mays
  Clone ID: LIB3075-026-Q1-K1-E5
cggacgcgtgggcggacgcgtgggcccgctatgtacgtcgccatccaggccgtcctgtctcgggagtgccagtggtcgtaccacaggtatcgtgctcgactcgggagatggtgtcagccacactgtccccatctaccagggatacgccctcccccacgccatccttcgtctcgacctggctggccgcgacctcaccgactaccttatgaagatcctgactgaacgcggctacttcttcaccaccactgctgagcgggaaattgtcagggacatgaaagagaagctcgcctacattgccctggactacgaccaggagatggagactgccaagaccagctcttttgttgagaagagctacaagctggctgactgacaggtcattacctttggtgctgagcgcttttcgtgc

SEQ ID NO: 65265 - DNA, 347 bp, Zea mays
  Clone ID: LIB3075-026-Q1-K1-G3
cccacgcgttcgcccacgcgtccgcaggaaagctggagatggaagcgaggaggaattaaagaggacaataaacaaagcagaaaaccatacaggcaatgacaggttgtgcgaggggttgtgtacttgtgtgagaggctgccgcggacgtgtggaacttagcgggtgttgtcatagttcataaacaattcgtggagaaccaatctagcaagctagtagcctaaaagtggagatagccgatgaggtcttaagatgcaactgaagcaaaagaggctactacatcaaggagcagttcaaccactcatttgatggcataatccatttgatgaggtcttagatgcaactgaacc

SEQ ID NO: 65266 - DNA, 287 bp, Zea mays
  Clone ID: LIB3075-026-Q1-K1-G4
gctggctttttcttcctctcttaccaagaactcttcgggttagggttacttaaggttttgtggaggggcgatggctgctgctgatgtggaataccgttgcttagtcggcggacttgcctgggccaccatgaacgagtctgtggagaatgccttcgcctcctacggcgagatcctagactacaaggtcatcaccgaccggaagacagggaggtctcacggcttcggcttcgttaccttatactactagaacttgatgctagacgctatacagaacatgaacggtaagg

SEQ ID NO: 65267 - DNA, 327 bp, Zea mays
  Clone ID: LIB3075-029-Q1-K1-E6
agacgctccgcgccgagctgccgttcttgattgttcccgccatccggatacgcaccgtctgcagcatcttcctgaagcgcgctggcgctgccgggctctgcctcgccgacatcggtgacatgatgacccgcgagttcacggctcagcaggatgggctgagcacactcgaggcgctatgcaagcaagcgcacgactccgtcctcccacacccctcgtccgacggcgacggcgacggcgtcgacgagagtacaagcgtctccggcgggcggaaacacgtgtcgttcggcgacctgagcctcgcggagtggacgtcgttcctggagaggt

SEQ ID NO: 65268 - DNA, 312 bp, Zea mays
  Clone ID: LIB3075-029-Q1-K1-E7
ggctgttgaggctatccctgtggatcagatcgacccagcattggttcagatcggtctcgctgaattcactgtcaagcttgtgcggcctctactgacctggagaaggctgatgcatagatcggagtcgatgttcacagtgccctcaatgctgcattgaccggttaattggtggcattttaaattgtcttgtatttttcatctacatgtttagagtgagtgtaagtttgcaaactcatggtcatgggatggagggaatgaacctaaataaattatactccatctaaaacatggacatatgtttcttgtttcctg

SEQ ID NO: 65269 - DNA, 468 bp, Zea mays
  Clone ID: LIB3075-029-Q1-K1-E9
tcgtggacgcgtaggcggacgcgtgttcagacgcgttggcggacgcatgggccctgggccaagtatatgaatgtagcgaggtggtttaatcacattgatgcacttctgaggctgagtggagttaccgcatagggcctaggtgttaaggttgagccatctgcagttccttcagcttcaattcttgatgttgctgatggacaggccccagctgctgacgaggatgacgatgatgatgttgacctcattggagaggagactgaagaggagaagaaggctgctgaagaacgtgctgctgctgccaaggcttgtggcaagaagaaagaatctgggaaatcgtcagttttacttgatgtgaagccatgggacgatgagactgacatggtcaagctcgatgaagctggtatgagtgtccagatggaaggactgctttggggcgcattcaagcttgtcccatttggatatggcatc

SEQ ID NO: 65270 - DNA, 328 bp, Zea mays
  unsure at all n locations
  Clone ID: LIB3075-029-Q1-K1-F1
ctgtcactgaaggacagggagcggctgctatggtttcgtggngctatggcggccggagcccatcctctgctatccgtggcgaccggcaaatgctatccgcggtgctatggcggacagactgagctcctatccgcggttgccgagaaatatgggtgatagtgccgattggaatgaagataacactgctctagtgtgtgaattgttctccgaacaagtgaagtcgcacaaccgttctggtacccacttagataaaacaggagacaaaaatgggatggacaaattcaaagaaaagactgggttgtcctacaccaaaatgcagttcaagaac

SEQ ID NO: 65271 - DNA, 332 bp, Zea mays
  Clone ID: LIB3075-029-Q1-K1-F2
tgcatccgcattccacccggaaccgtggtctgagcgctgatgtggctcagatgtcacctacccggaacaagtgcgtcctaaccggcatttgagcgcgttcttgtccaccctaacctggtgccttttacggtcgcattcgcaccgcgatgaactacgccgcagccgccactaacgcccccgcggcggcgcccgcggcagcgccggcgtcgggcacagaacacgcgcactacccgtattacgctggctattcttatccctacggcgcctatcaccaacctgccccgcccacgtactcctccgccgtggccgccgcctcgtcatcctactactac

SEQ ID NO: 65272 - DNA, 184 bp, Zea mays
  Clone ID: LIB3075-029-Q1-K1-F4
acgccaccggaatcaccattcggttcaccaataacaccttcgtgaacgccaccaacgagtacatggtcatgatcctgatcaccatatgattgttttaaaagcagcagcagtctagtgaaagtaatgtttcgttttaagattctagctgatagacgtcctatcatagctagtcaaattagatttg

SEQ ID NO: 65273 - DNA, 309 bp, Zea mays
  Clone ID: LIB3075-029-Q1-K1-F7
ctgctgataaggaggatgttctacaggctgtttgctcccgcgttagtgcactataggaggagcttgcagctacaaagaagatcttgcaggagactcttgagcgtcagtctgtgatcgttgcatacattgagaagaagaagaaaagcaagcgtttctttcgttggtagaagcaaacagcagtgaattgttcacgcccacgagaaaaaagtttatgcgtgtgatggaagcgagctgttgcttgcgtatgccagcaagctgcgattctgagtgtaacacataaggatgttctttcattcttctttgatgttc

SEQ ID NO: 65274 - DNA, 469 bp, Zea mays
  Clone ID: LIB3075-029-Q1-K1-F9
tcgtgttaccaggaacggggagtttcttggcattctcgcttgcaatcacttctgcgagcctgcccaggggttactttctcctgttatcgcaccgaaagcgcggcacgacgacagcagcctggacctgattctcgtccatggaagcggcaggctgagactgttttgcttctttgttgcctatcagctctgctggcatcttctacttcccctacgtggaatatgtcaagataaaagaagtgaatgttaggccagttggcagtacccacagtggttgtggcgtcgactgtgagcttcttgatggagagcgcggtgctgaatggcagtgctcgctgctttcagcacaaggcatgctgcttggccaggatcccggtgctttcaactagttagggctcgttcggttagctctcaatccattgttgatttgagtgagattggatgaatttgaatcccaaacaatataaacttaatt

SEQ ID NO: 65275 - DNA, 105 bp, Zea mays
  Clone ID: LIB3075-029-Q1-K1-G1
gaaataatgtgcttgcgtgattgttagtctatctctttatttgtttaataatgttataaatgctacggtgatgttttaacatgataattgtgatgttgttaaaaa

SEQ ID NO: 65276 - DNA, 106 bp, Zea mays
  Clone ID: LIB3075-029-Q1-K1-G10
ccaagacgcacacgggacggttcgttcaccaaacctaccttggtgggccccacttttcccccgaaccgtagcttcagagtgatccccttttcaccctctatataat

SEQ ID NO: 65277 - DNA, 322 bp, Zea mays
  Clone ID: LIB3075-029-Q1-K1-G3
tcgcggacgcgtgggtcaaggacggtaagggtttcggctcatgctatgaggtgagatgcatggtaaaacctgagtgctcgggcaatccagatacggtgtacatcactgacatgaacttcgagcctatcggtccctaccacttcgacttgagcggcaaggccttcggctccctggcaaagcccgggctcaacgacaagctttgccactgcggcatcatggacgtcgagttcagaagggtgcggtgcaagtaccccgtcgggcagaagattgtgttccacatcgagaagggctgcaaccccaactacctggccgtgcttgtgaa

SEQ ID NO: 65278 - DNA, 332 bp, Zea mays
  Clone ID: LIB3075-029-Q1-K1-G4
tcggccgtgtgtgctctagagtagctccaatctcatgggcctattcatgctgtctttggtttgaggttgataattaacagatgcagctgtttgatttattgttcgatcttactcgagcttgtagctggttgatttaagtggatctggcattaccgacaacgggcttgggatgatcagcaaagcattccctgacaccctatcacgcctgctcctgtatctgtgccttaacatcacgtcgtctggggtccaggtgttatgcagcacagttgcctttcctgcgtcttatggactgcggcaacatcatatgcgtcaacccccagcctgaagctggg

SEQ ID NO: 65279 - DNA, 327 bp, Zea mays
  Clone ID: LIB3075-029-Q1-K1-H1
gagtacatggccaagtttggacccctagactattgtgtcgtcatgaaggagcggtcttgtgggcgatctcgcgggtttggctatgtatcattcgcctcagctgacgatgcaaagaatgttctggattgcgagcatgttcttgggagccgtacattagaagtgaaggtagctactccaaaggaagaaatgaaatcacaaggatcaaagaaagctacaaggattttcgttgctcgaattccgcaatcggtggatgagtcgatgttgcgtggacatgttgaagcttttggggaaattcttgatctttacatgccaaagagtctgtggaca

SEQ ID NO: 65280 - DNA, 327 bp, Zea mays
  Clone ID: LIB3075-029-Q1-K1-E4
cctgcagtcatctcctgtactatcttcaccatgttcaacagctgccagctcgcgaaaatgatggagagccgcagcatggcatcatcggctgtgctcttggtgctagcccttgcgcgagtggcggtcaccgacccacaggtagcggaggcaaagaagaagagagcggcggagagcggcgaggcggcggaggcgaagaagatccaggacgacttctgatcgacgcgtttcgagggcaagaaggggacggacctggtcgtgtgcgaggagttgctcgctcttttccagcagtccaacctggtgctgtacggcaggatccagtgcaagggc

SEQ ID NO: 65281 - DNA, 188 bp, Zea mays
  unsure at all n locations
  Clone ID: LIB3075-029-Q1-K1-H2
gtnttgtcnccatattttttatttttttttttttttttttttttttttttcctttttttttttttgttttttttttttttctttttttttttttttttttgttatttttttttgtttttttttttttttttttttattttttttttttttttttttttttcttttttttttgttttaatatttttttt

SEQ ID NO: 65282 - DNA, 260 bp, Zea mays
  Clone ID: LIB3075-029-Q1-K1-H3
tcggccgtgtttgctctagatagctccaatctcaggggcctagtgatgctgtctttggtttgatgttcaataataacagatgcagctgttatatatattgttcgatcttacgcgagcttgtggctgttcgatttaagtggatctggcattaccgacaacgggcttgggatgatcagcaaagcattccctgacaccctatcacgcctgctcctggctgtgtgccctaacatcacgtcgtctggggtccacgtgtctgcagc

SEQ ID NO: 65283 - DNA, 406 bp, Zea mays
  Clone ID: LIB3075-029-Q1-K1-C12
cgctgtacgcgcagaagtccgtcggagacggggtcaaggagcccctggacaagaagctgtcggaggcggagaagaagaaggtcacgttcgtggtggaccccagcggcaagggcgactacaccaacatcaccgcggcgctggaggatatcccggtgagcaacaccaagcgcgtgatcctggaccttaagcccggcgctcagttccgggagaagctgttcctgaacatcagcaagccgttcatcacgtttcggtcggaccccaagaagcccgtcgtcgtggtctggaacgacacggcggccactaacggcaaggacggcaagccggtgggcacggtggggagcgccacgctggcggtggagtcggactactttacggcgtacggcgtcgtattccggaacgacgcgcc

SEQ ID NO: 65284 - DNA, 336 bp, Zea mays
  Clone ID: LIB3075-029-Q1-K1-C4
tcgtacacatccaacacagtcctgctttctttcattcattggactgccacaatcattattcttatcaggtcatgctacctgaagcaattgcaatagttatggcacctactgacacaagtaaacatgttatatttcatctcacggatccaggtggcatgggcgtgatccatgattgtcaagagagaggtttccatcctcacaaggcaccacttgatgggacgccaatatatgagcagtgctcccatgtgtacatggacaccgatataaatttcgatatgattgatctgcgacaaagatgacgaagctcacctttaagtttattttgcaacctatact

SEQ ID NO: 65285 - DNA, 330 bp, Zea mays
  Clone ID: LIB3075-029-Q1-K1-C5
gacggaaaagccagcgcagggggagcagggagcagaggagaagcagaatacaagggtagcggcagaggaggactgggtcggggatagcgggtaagttcctaaggaagctgacagaagaggagagggcgtgcatcgctcaatcagcaaccaactagatcaacctagcccaggggcatgcagccgagaacgccaagaagcttcgacgagagtgagcaggagaagaggctgaggaagaagtacgcgcacaaagacgaggagtgcgagcgcgggctaggggtgagccgcgagatcccgccctagcacatccttcccgacaacatcctcccacac

SEQ ID NO: 65286 - DNA, 343 bp, Zea mays
  Clone ID: LIB3075-029-Q1-K1-D1
gcggaagtccggtcggaaaaactgccatgatatatgctgaactgggacttatcagaaccgcggacaacatgatgtattcccacgggctgatgtttcttccagtcttgaccttttcgctcatctgtgctaggcaagtgagcttcaacgtctttttctcatacgtcttgaactctcagaagctcaccggtttgatcatgaactccgtggtgctgctcaccttggctgctgtactccttgtagccaaccatgaaactcatggacctattactggtggtgtctaaagacgaaagtaccttctgggtttcctgttgacagtaggagcatcaggcacctactcactcat

SEQ ID NO: 65287 - DNA, 305 bp, Zea mays
  Clone ID: LIB3075-029-Q1-K1-D10
atcgaagcctgctcgagcgaccatccatcctgtataacgcacactcttggacagactcgacagggggatccttcgtggaggatcaagccttctttactgggcaaaaacctcactagcgatgacacagcttcgagacatcggacgaccaacacttatgttcatgaacacaggagagttgatactaaaccgtgccaatgtaaacaatcatgcaaagaccgtaccttcgaagttgttagataacgcgcagatcggaaatgcagaatcagtgacacacgcatggtaagccatcaccagctgttgtacat

SEQ ID NO: 65288 - DNA, 130 bp, Zea mays
  Clone ID: LIB3075-029-Q1-K1-D12
acactgctctctctcagccatgctatttacctccactacggggagcatgatcaggcacaaaagcttacatcaataccacctcgtagtgaaacacactctaatcaacattgatgacgatacatgttctact

SEQ ID NO: 65289 - DNA, 331 bp, Zea mays
  Clone ID: LIB3075-029-Q1-K1-D2
gttttcaacaagggaaagatccactatgatccttatactgacatggaagctcttaagtttatcctgatgggattgtttgagaagcggatagctgggaaattcttcctttatgtccaagagtataagtgaaatgacccaagtactcataagggttacaaccttactaaactaacgacaaaagaacttatctcaaaatatggtttggatgataatactatagactgttttgggcatgcactggctcttcatagagatgatagctacttgacagaacctgcaattgacactgtaaaacggatgaaactttatgcataaatcaggggctcgcttt

SEQ ID NO: 65290 - DNA, 304 bp, Zea mays
  Clone ID: LIB3075-029-Q1-K1-D4
tcgcggacgcgtgggatccaggctctcgttaggccattcctgttggatgatatggcagatgtaatgcatggctgtactctgagagatcacatggatgacggccttaccgatgaagatgaaggcaatgggtttgaacgcttgaaggagatcgatcctatggctgcgcagaggatccatccaaacgaccatagaaaaatcaaacgctacctcgagttgtatgcaaccgcgggtgccctacccagcgagctgttccaaggagaggcctctgagaaatggtgtcggcctagtaactccagactctact

SEQ ID NO: 65291 - DNA, 321 bp, Zea mays
  Clone ID: LIB3075-029-Q1-K1-D5
gtctttagggagttatggagctgatcttgcttggtgctccgagtacagttgggattatggggaagctggtacgaaagagtatctgaaagatttccatcggcggaggctctaggtttttgcggaagcaggccccgatttgattgctttcgaaacgattcccaacaaactggaagctgaggcgtatgtcgaacttctcgaggagtgcaacatcaatatgcctgcatggttttccttcaactcaaaagatggagtgcgtattgtgagcgatgactcgttaatcgaatgcactactattgctgacaagtgtgcaaaggttggtgc

SEQ ID NO: 65292 - DNA, 325 bp, Zea mays
  Clone ID: LIB3075-029-Q1-K1-D6
cggacgcgtggggttacgggcgcactccacagtgtacatggaggactgcatggagaggtgcaaggagatcgctgataagcactggcgctagggacccttacaaggataactaacgtgacatggcatgaactaattaatgctcctatatcatctgcctatccatgcatgcattgcattgcgtatgcacactgtgcgtgcctgtccacaaaggtggacaacacaccgatctcgacggattagtaatcgagtgcactcgatcgttatatcgatggatgcttgctattatatctgtattccacattatatataagaaatacaaattaaa

SEQ ID NO: 65293 - DNA, 324 bp, Zea mays
  Clone ID: LIB3075-029-Q1-K1-D7
cgaagctgaagctgtccatggcacggttacttcgcatttccgtgtccaccagataggaggcttaaccagcacgaacagcattggttcgatctttgcatggacaagaggacttgcctacagggcaaagctcgacgacaacgctagactacttgacttcgctctcaaactcgaggctgcttgcgttgagaccgtggagtccgggaagatgactaaagatctggcgattcttgtccatggatcttccagcgtcacgagatagccattacctgaacacctaggaggtcatcgacgcattcgctactgagctccgatcaagactgggag

SEQ ID NO: 65294 - DNA, 321 bp, Zea mays
  Clone ID: LIB3075-029-Q1-K1-D8
cgaattctagggttaggttgctgttcatgcttgttcttgttgtttgtttgtaggcgatggttacagctgtggcatctactttagtactttcgaaagatgaagctcattttgcctgtatgtcttaaatatagtgctctgtattaagcttatctgcatcttttttttttttgcatatgacatctggtagtattaccgtcgagcctatgatttgttattgttatggaataacaaactgaaatctcccgtcagatgacattatattgcttgtgtccttgttcgacttactcttgcatcgtgcataacagtatttttttttctttt

SEQ ID NO: 65295 - DNA, 326 bp, Zea mays
  Clone ID: LIB3075-029-Q1-K1-E1
cgcgttccacgtcgactgcatcgacacgtggctgctgtcgcactccacctgcccgctctgccgccgcagcctcctcgccgacttccccacctgcggcggcgcctgcagcccgctggtggtcgtcctcgagtccggctccgagggctcggtctccgatcgccacgacgcggcgtcctccgcgcgcctcagctttggcatggagcaggagcaggcatggcaggatcggaaacacgtcgccgctgcagaggcagcggagaagaatgacgaggtggtcgttccggtgaagctcggcaaggttcgaaagccaggccacccgaaggagccgg

SEQ ID NO: 65296 - DNA, 214 bp, Zea mays
  Clone ID: LIB3075-029-Q1-K1-E11
agatcgatctaggcggaggcacactattcgtcggtaggagccaacaacgttttacgaacacattcgacttggacatcctctgatgactctagacaaccgacatgactaccacgcgaccgatgcatctatgatgaattaatccaatgtatttacataatggtcgatttactaaactaggatttgaaagcttgcgcgtactatactattgctatac

SEQ ID NO: 65297 - DNA, 328 bp, Zea mays
  unsure at all n locations
  Clone ID: LIB3075-029-Q1-K1-E2
cctcgtctcaccctccctcccttacacaaataataaggtaaggtcccgcccttttccttcgacatgcacaaggggggaggggaaaacactgtacattcacccggcggcaataatggtcttngtaccggctccggcgacgacgaccgccgccgtcatcctatgcctatgcgtcgtcctctcctgtgccgcggctgacgacccgaacctccccgactacgtcatccatggccgcgtgtactgcgacacctgccgcgccgggttcgtgaccaacgtcaccgagtacatcgcgggcgccaaagtgaggctggagtgcaagcacttcggcacc

SEQ ID NO: 65298 - DNA, 247 bp, Zea mays
  Clone ID: LIB3075-029-Q1-K1-A12
acattggcgccttttagatgacggttggcgtcagagccatgaacgcgccgatactggagatcgtcatgagcttcgacctcgtgtacacggaaaacgcgacagaacgtgaccccaagaagggcgactctggcatcataaagcccatcgccatcggcttcatcgtcaacgccaacatgctgtctcagagcgccttcaaacgggcctccatgaaccccggcgtctccttcggcccggacagagtcaccgg

SEQ ID NO: 65299 - DNA, 247 bp, Zea mays
  Clone ID: LIB3075-029-Q1-K1-A2
ggaccatggtggtgtgcgcgacggtgcggcccttgtgttggtggagtggttcgaggttcattgcgatagctggaagattgctcccggtggaacaaggaaacgtgtgaccgaggttgtagcaatggaggacttctgccgtaataagggaagtgattgggactgaaatttctggagataagatgctcttctgagaagcctggttatgtgagtaaaattgtttgtattccggtaccatgataattaaacg

SEQ ID NO: 65300 - DNA, 311 bp, Zea mays
  Clone ID: LIB3075-029-Q1-K1-A3
gcaagcggttcagggacttcattggtaaggctttcgacgacgatgtacagtgactagctcataggacagaacagggagccagcgaactaaggcaattaacacttcttaatttgggtggggttagtttgttcccacacaacaacagtggttcttttaagtaaaatcgtcggagcaatctgcagtagatcaaaacacttgcatagtgcagcaaaaggaggcttagatggtttcttgtagcatttgtgaattttaagcatttggtgcgtaagttaaagctgaataacacttcacttttaaaaaaaaaaaagaca

SEQ ID NO: 65301 - DNA, 258 bp, Zea mays
  Clone ID: LIB3075-029-Q1-K1-A4
ctgacacatgggctcaccggaccctaaacctgagccacctgcctagcccggaggtccgttgatgcgtgtgcgactctaggcgtagcctgagcccactacaagggctagcggtggatggagctgtgaaccgattacccatacgatccccttaccggtggagggagaaactagcctacgaggccaataaagccagaatggggcacgatgaggatcatgatcaagggatgcgtgtggaagaacacctacgactagaaactt

SEQ ID NO: 65302 - DNA, 324 bp, Zea mays
  Clone ID: LIB3075-029-Q1-K1-A5
cccacgcgtccgcaacgaggtgagctcgagggagatggagagggtgaacgtgctccgaggcatcctagacaacaacgtgttcggcatggtgctcggcagcaccgtggtgtttcagatcgtgatcgtccagtgcctgggcagcttcgccaacacgacccctctcagcgtcgcgcagtggggcgcctgcgtcgccatcgggttcgtcatcatgcccgtctgcgtggcggtgaagatggtgccggtggagtatgcgggcctctcgatctctctcggagttgagaaactggaggcaggcaagcggtcagtagttgttggcttgaaatg

SEQ ID NO: 65303 - DNA, 251 bp, Zea mays
  Clone ID: LIB3075-029-Q1-K1-A6
gcaagggcaaaattgtcggcgaatccggctgaaggacgctgcggcacctatgataggcgacactggccgcactataccgaagttgggcgaatgggacgtgaacaacctggtgtatgtcgacgggttcacggtgatcttcagcaaggccagggatgagaagaaagccccggcccaaggccacatcagggacaggtcggcgtctgtcgtcagcaagggctgcaggtccagggatgagaagatgacctgctaca

SEQ ID NO: 65304 - DNA, 311 bp, Zea mays
  Clone ID: LIB3075-029-Q1-K1-A8
tcgaacaggaactgtatgttggccatatgatggtgtatcagctgaacttactggttgtgctactggaaaggccattctttcgttgggccttaagatagggatggatttctgcgatgtcaggacaaaatcttcagttattcatgtttttccatttaactcggagaagaaacgtggcgctgttgcagtacagtttgatgatggtgttcacatgcactgtttaggtgcagctgaaatagtgttatcatcttgcaaaagctggcttatcgactgtggctctgttcattcaatgagtgctgataagcacgatgaat

SEQ ID NO: 65305 - DNA, 390 bp, Zea mays
  Clone ID: LIB3075-029-Q1-K1-B1
agcgtcaacttcccagctgagttctcagaatttactgagtcatagacaccacttagattccagttcaccaagcaatattacttcggagtcctatccaggaaagttcggtccatctagctgttcttctgcacaaagaaactcaaaagtgcagaagaaaactgtcaacatacaaccaagacagccagcaaatgataatgttatgaacacaagcagagcttcttacccttgtgagaactatgaaactgaaagaagaggattagggaaaagaactctgggggatcctcaagttacaatgggtagttcaatggtagtggatggctcatttgtatcatctatgtcctctgataactcagtcgaagaaagcagctttcaacaactgcaggatgctgt

SEQ ID NO: 65306 - DNA, 304 bp, Zea mays
  Clone ID: LIB3075-029-Q1-K1-B10
gcatgaatacccgcatctgtttccagtcatgaacttcctgcaaactctcagggagagctgctggagggtctttagacacatctacttttctgtatcacggtctgatttgatgtccgcgagtgaagagcatcgctcgctcctagactagatcaacgtcacgatcaacgagaacatccatgagtataagcactcgtcgtcgtgctcctcctcttacgactcaaacgatgacaaaaagcccaataactctaagaagaagaagcttcttggaagaaaacattcattgcatcatgttctcggaggaggc

SEQ ID NO: 65307 - DNA, 287 bp, Zea mays
  Clone ID: LIB3075-029-Q1-K1-B11
ccgatgcgcacgtacgggtcgacccaagcttgcgctggacacagagtggctcatgtatacgggcgtcaggactacctacatcctaggggtctacttcatctgactccattgaactctacagcctatatatgcacacactggctcacgcgtggacccgtcgacaaccttcttgcacttggccgtcacaaaccaatgtctccatcgtaagaacagaacaccttcagctgatgaccatcgcatgcacatcccattgacttggcgcgagcattttgataatggcatacacc

SEQ ID NO: 65308 - DNA, 285 bp, Zea mays
  Clone ID: LIB3075-029-Q1-K1-B2
cttcttccttttcttttcttttttttttttttttttttttgtttttttttttttttttctgttcttttgtttttttctctctttagttttttttttttttccttttcttttttttttttctttttttttttttttttccttttttttcttttttttttttgttttcttttttcttctttttttttttttctttttttgttttttcctttttttttttttttgttttttttctttttttttttttttttcttattttttttttcttttttcttttttttttttttt

SEQ ID NO: 65309 - DNA, 381 bp, Zea mays
  Clone ID: LIB3075-029-Q1-K1-B3
gtgaagttccggaatgcagtagcgaaggactactacttgcagatgtactatgatgatctcccactgtggggcttcattggtaaagtttagaagggaggcaaggccgatccgagcgagtggaagtactacctgtacaggcacatcatcttcgatatcctgtacaacaacgaccgggtgattgaaatcaatgtgcacactgatcagagtgctttggttgaccttacggaggataaggagacaaatgtggatttcctgtactcagtcaagtggaaggagacaccaacaccatttgagaagaggatggagaagtactccagctccttcaacatgccgtaccacctggaggtttattggttctcaattataaactcttgtgttact

SEQ ID NO: 65310 - DNA, 313 bp, Zea mays
  Clone ID: LIB3075-029-Q1-K1-B4
agatgatgtgccaagtgatcctgctgctggatctgatgtgactatgcaggagcagcctcctgcagctggaaatggagcacaagataatgaggaaaagtctgtttcgatggaaactgatgcataggttgagccgtcaaaaaagaaagttaagaaaactactgttccggtccatgagttggtctatggggccttggctgcagctgacctgcagaaggctgtatagaaagagtatgagatggctcttcaagacagagtaatggaagaaacaaaggagaagaagaatgctgttgaagcttatgtgtatgacatgcgt

SEQ ID NO: 65311 - DNA, 313 bp, Zea mays
  unsure at all n locations
  Clone ID: LIB3075-029-Q1-K1-B5
actagttctagatcgcgagcggctgtacttggtntggtctatgtttttgctgagtatggtttttttttgttttgggatgaaagcattttaaggaacggcgatcatttgtctgattttattaaaataacgaatccattctcttgacatggtcgttaagagtcacaggttactctgaacgaaaatgggaaattaacccagggttgtcaaaggtggttttggtgaggtttcagaatgacacttcgtttcttgagactgtgggccaccgtcgtcgtccaacttggggcccttggaacccttctggacagggcccttc

SEQ ID NO: 65312 - DNA, 328 bp, Zea mays
  Clone ID: LIB3075-029-Q1-K1-B6
gtcgtttccaaattcttcagatacatacaagtgttatgaaagagaattctttcctatctccagatattaatcttcttgagctagccgcaaggacaaagaactacagtggagcagagttggaaggtgttgtcaaaagtgctgtctcgtttgctttgaaccggcagataaccatggacgacctcactaaacctttggatgaggaaagcattaaggttactatggatgactttgtgaatgcacttcatgaaattactcctgcatttggtgcttccaccgatgatctcgaaagatgcagattgagaggtattgttgactgtggtaaggcaca

SEQ ID NO: 65313 - DNA, 324 bp, Zea mays
  Clone ID: LIB3075-029-Q1-K1-B7
acccaacatagagaataactctgcaagaagttgtgcagcctatgagaaagctgtatcatagtgtaaacagaaaattcagtttaagcagattgaggccactcagcttgtgagtaatctggaggaaatggaagtaacagagcataatttaaagacacagcttgaaaatgctctgaaggagctagaggctgctcaacataaagcattatctgcaacctttggaacagctgaaaatgctctactggaagctaagtcagtgtctgatcttaaatcgaaagatttggaggagaagaaaagggagcttgaactattggataacaaggtgca

SEQ ID NO: 65314 - DNA, 284 bp, Zea mays
  Clone ID: LIB3075-028-Q1-K1-H9
agcagctgattacagatggaacttgctctactggtcaagcgcactaccaacggataacgtcggatcatagaatcgtatgatacccgacttcatagggagcgtccttaccactatatttactcacatcgcgatgcacaaccaatcaccggatctccagcgcgtcaaatcgcgatgacctgcgtgtgtcctataactagccggacatctttgataaagccatgtgtagaaataatgcaactaaaatactgtgacatacaaatcaaactagaaatcagggccgtcga

SEQ ID NO: 65315 - DNA, 208 bp, Zea mays
  Clone ID: LIB3075-029-Q1-K1-C1
gcgaagggggcacggaagccagggcggcagaggcgctaagggaggcagggaggcgaagaggacgcgaggagggcacggccagcggcagagagaggcggcctggtgtgcacgtgcgcgcaagtgaggagagaaggtgttacagacactgtccaggaatgggaggagggagacaacacgacatcagaaattggggagggcgatggaccga

SEQ ID NO: 65316 - DNA, 435 bp, Zea mays
  Clone ID: LIB3075-028-Q1-K1-G11
gactcagccaaccccatcttcatcgacatgaattactgccccaacaagttgtgtactgccggcggcgcctgcaaggtcaccgtgaatgatgtcaccttcaagaacatcaccggcacctccttcaccccggaggccggcagcctgctctgcactgccaaggtgccatgcaccggcgtcaccatggatgacgtcaacgtcgagtatagcggcaccaacaacaagaccatggctatatgcacgaacgccaagggcagcaccaacggttgcctcaaggagcttgcatgcttctagaccctccatcgactgacccatctctctagttataatttttctctcgtccttgcattgcccattagatgctatccattggtaacgcacaacagtaaaacgacagacatccgacagctatattatgttcgacggtgtaacaccctg

SEQ ID NO: 65317 - DNA, 286 bp, Zea mays
  Clone ID: LIB3075-028-Q1-K1-G12
cagacgcgtgggctgtctcgtggggaagagtagcggcagcacgccgtacgacctgcggagggagttcgagccgtcgacgtaggactaccagcaacagcaacgcgcgagccctcagcagcagtctcatcatcaccactggggaagtagcggccgcggctgtcaccagcagcagcaccccccgtccgcgcacgggcacgggcatggccacggtcaccgagctccgcactcgcacaggctgcagcaccacgcggcgcctgggccacgggcgctgtccgtctttccttat

SEQ ID NO: 65318 - DNA, 370 bp, Zea mays
  Clone ID: LIB3075-028-Q1-K1-G2
cccacgcgtccgcgcaatcgtcgactgctgctgcgttctgttccgttcggaagatgttcttggagagcttccgggtggagagcccgcgggtgaagtacggcgacggcgagatccagtcggagtaccgctacgacaccaccgaagtcgtcccgccggggaatggcggcggcgcggggtgggtggtgcgcccaaagtccgtcacctacaacttcaagaccagcaccaacgtcccaaagctgggggtgatgctcgtcggatggggcggcaacaacgggacgacgctcacggtcggggtgatcgccaacagggaagggatttcgtgggagacgaaagagaaggttcacaaggccaactacttcggctccctgac

SEQ ID NO: 65319 - DNA, 285 bp, Zea mays
  Clone ID: LIB3075-028-Q1-K1-G3
gttctagatcgcgttcggcgccgtaaaaaaaaaaaaaaaaaaaaaaaaaaaaaaaaaaaaaaggaaagaaaaaaaaaaaaaaaaaaaaaaaaaaaaaaaaaaaaaaaaaaaaaaaaaaaaaaaaaaaaaaaaaaaaactaaaaaaaaaaaaaaaaaaaaaaaaaggggcgtcccttataagggataaaattttacgcaccgttcctttcaaagtaaaagttttctaaaagggtaactaaaattaaaataatgggccgtgtttttaaaatccttattatctggaaa

SEQ ID NO: 65320 - DNA, 359 bp, Zea mays
  Clone ID: LIB3075-028-Q1-K1-G6
ggggaaattgacaaagacgagtttaggaaagtgatgacactgatgcgatcctataatagagaaggagctgcccatagggatggtttacgctttggacgcaaggttggtcagccagtggaaaatggtggactggtcgaatacttctttggcaaggatgggaatgaacatctacactatgataagttctctagttttttgaagaaattgcatgatgagattgtccgcttggagtttagtcactacgatgtgaaatcatccaacacaatacctgttaaggcctttgcgttatccatggttgcttctgctgatatgatttacatagacaagttactggatagagttgaggatttggacgacaa

SEQ ID NO: 65321 - DNA, 365 bp, Zea mays
  Clone ID: LIB3075-028-Q1-K1-G7
cggaatctgcaggaccctgcggcgcggcttcttcgtggagaagaggttgctgccgaagccagcgccaggtagccatgtcgtcgtccgtgctgagggctgcggccgacagggccattcgcaggcaggccctcacgctgacgaacgcctcggtgtccaggatccggcagctcctcagcctaaggcaacggccatacctgcggctgggtgtcaaagcgcgaggttgcaacggcctctcctacaccctcaactatgccgatgaaaaggggaagttcgatgagcttgtcgaggagaaaggagttaaagtactgatcgaccccaaggctatgatgcatgttataggcaccaagatggactatgttgatgat

SEQ ID NO: 65322 - DNA, 231 bp, Zea mays
  Clone ID: LIB3075-028-Q1-K1-G9
ggcacccacagacacgcatagcccttttagcttaagggcctatgggtacttactgggacagggcgctaaggactcggagattgcaatagcgcacgcagagcacaatgatcgacacacatgtgatgacgtatataggctaaaagcattagccggcacatagatcaagactgatgcatgaaaagcaccactactacgtctacgtaagtctggacaataagtatatgatgacaa

SEQ ID NO: 65323 - DNA, 347 bp, Zea mays
  Clone ID: LIB3075-028-Q1-K1-H1
gcgacttcgcgtgcttgattgaaacgcacccagtccccgctcctgtttcgatctcccgaatgccgatcccgctaccggaggcggaggcgatggcggcggcgccggcggtaaggttcccggtcttcgggctcgtgcggctgctgggcttggccgccgcggcggcgatcctcttctgggccgtccacttccgaggcggcatggcgctctccaccgaagaggagagcaagctccccctcttcaacgttcacccagtgttaatgctgattggtttggtggccttgaatggcgaagctcttttggcttataaaactgtgccaggaaccaagaaactgaaaaagctagtgcac

SEQ ID NO: 65324 - DNA, 443 bp, Zea mays
  Clone ID: LIB3075-028-Q1-K1-H10
ccaacagctttttaaactttggtcaaaatgcagctcaagactcattccatgaaatgctgaggtcaagaggctctttcaaaaatggtacacttgctgatccttgtgctcccagaggatattcacgcaatgaaggtgcttcaaggtcaacattagagaaccagtatgttaataatgggactggaaactttacagagtgcatatcttcttcacaacttttactgcaaaaaggaaaggattagtgccacatgtatctcatataaatgcagaaaagtgccagtatcaacaatgtcacctgggatctacttttgtacctgaactgcgtggatacttcttgggaactgaaaatttctattttacttcaaagctctttggacttaagaagtcttcatcactatcttaattcatgtatgctggagaacaattttgcaatcagcatttgtcga

SEQ ID NO: 65325 - DNA, 388 bp, Zea mays
  Clone ID: LIB3075-028-Q1-K1-H11
accacctggcaactacctgacggtcctcttgtagctaaagggcccctgcatgttctacatgggcatctctctcgacggcaaccggctctgcaccggctacctcagcgcgttctataggaactggatcgagatcgagaacgtcaagaaccttctaatgaaccgtcactgttccatctacgggcatgtagccctggtgtggagcaagaaccagttccatcgttcttacaattgcaagatacttccttatagcttgctgctggatcttgtgactaacgtccagatcctacgcatgactctgctcaacagcaatttcttccacctcaacatctttgagtgcaataactatctgatcgacaaattgacggtcaatgtcatcagtgacagttcc

SEQ ID NO: 65326 - DNA, 372 bp, Zea mays
  Clone ID: LIB3075-028-Q1-K1-H12
caaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagaggtgatctgacccttccattgagttgaatgaagtagcctggaactgtggtagttcgtcttttacatcttaagctgctgatagacttcaaataaaatcttgtccaagaaaacattctgtgagcgtacatgttgtcgtcgagctgtgtaattgagcatatcgtcagattgaaactcgttgtctgccttggtcttcaaatac

SEQ ID NO: 65327 - DNA, 359 bp, Zea mays
  Clone ID: LIB3075-028-Q1-K1-H2
gcaaccagcacttaccaaatcctattcattccgctcttggagccaaaataatgtggtcatgtggcttgtttgctttattgcgcaatttggtcagtctgttgttcgagcagactatcttatcctccgcaagggttttataatgacccacaatcttccgccaacatatgatttccacaattacatgatacgctcaatggaagaggagtttgagaagattgtcggagtgagtggactgttgtggggcttcgttgttgcttttatgttatttaatgtagacggatccaacctgtacttttggatagcaattcttcctgtaactcttgttcttctggtgggtgcaaagcttcagcatgtgattg

SEQ ID NO: 65328 - DNA, 84 bp, Zea mays
  Clone ID: LIB3075-028-Q1-K1-H3
ggcacttttgtttaagctaagttttgcggagacaagatacttatatatgttcccgatgaaattatgggtccttgtatgctctgg

SEQ ID NO: 65329 - DNA, 371 bp, Zea mays
  Clone ID: LIB3075-028-Q1-K1-H4
gattcgagcagccatgtgggcttcttatgcggctcgcctcctatacgcgctaacaaccctgttatccatgatccacagtttggtaaaagactgccatccttttctcctctaggagggagctcctatggcaaaatgccagcagtaagagttgaagtaggctcgccatcttgcggcgttagcagcagcccaaaagtaaggatcgaaggtttcgcctgtggcaactccgagacccattatgcagttacctttgtctgagcatttcgttgatatgttcctgattttgccctccgaccgaccgaccgctccttgtgaatcaccgtggtggtgtgcaggatattaagtagtgcatttaagctagcctgattagagtt

SEQ ID NO: 65330 - DNA, 310 bp, Zea mays
  Clone ID: LIB3075-028-Q1-K1-H5
gtttgagcaaccaagaaatcatttgctctgctcacaaacggtacacgcactttcctgcgtgggttgccacctggttcatatagggaaacggctcaactatggaacagagacattgtacgactggaaagctatgcaagcacatagcttttcatcgtcgataaagaggattaaacgtgcccttgactcgtatcatgaattgcgtatcgaccatttgcaactggcttgcgcactttttagacagtaccttctgatgcaaaactagcactggttggaagctgcatggctcaaccaatgagtagctatcttgaca

SEQ ID NO: 65331 - DNA, 367 bp, Zea mays
  Clone ID: LIB3075-028-Q1-K1-H7
gttgttcatgtctgtgagctcgccgcagaatggcgtcagacatttcattcagatgtagtgggggacattgtatgctaccggcgatttggccataatgaaattgatgagccgtccttcacccaacctaagatgtacaaggtgattaggaaccatccaagtgcgctagagatttatcaaaggaagttgttagagtctgggaagatctcaaaggaagatattgataggttaaacaaaaaggtcagcactatacttaatgaggaatttcagaacagcaaagactatgttcccaacaagagggactggctttcagcttactggactgggttcaagtcaccagagcagatttcgcgtatccgaaacaccggtg

SEQ ID NO: 65332 - DNA, 440 bp, Zea mays
  unsure at all n locations
  Clone ID: LIB3075-028-Q1-K1-G10
ttctgggcgagcgaggatgaggcgaaggcgtgcttggcgaaagaagccagcgtcgactccattggacgtcgccagtgtcgaggagtacaagcagaaggcgggcttggtgtcgaagcggggccggacgtcgacaggcagcaactaactaccgtgaccatcgtcaccgttgtggtggttcttcgccctccgtgccttcttccccctgtccgatagccgacgccggtgcgagatctactcccccccatcctcgcttcaacgagcacctttctttaatcggttaggtaagatccactttcctagtacacggagttaatgctcagtgcttcatactntggcaatcctttgatttggtcagtacggttcgtatatctgtgaaattggttgacaatgttcgtgcatgtgcgaccatggaatacctatccgctctaagatctggtaga

SEQ ID NO: 65333 - DNA, 368 bp, Zea mays
  Clone ID: LIB3075-028-Q1-K1-H8
cccacgcgtccggtagcgattgcttgtaacccgagcgggggcaataaggtagtgtggatgtcaattgtggtgcatgtgcctgggtctagtgctacaaactgtggaccacccattccaagttgtgtagtgggtttcggatgccttggtgaaagcctttgcattccaacacctaaagtggtggacattgcgtgaggctggcttcacagagcagcgagtaccgcccgccaccagcggtggaaggataatgagtcgctatgctataggccaattgaggcacatgtgccctctctggtagaccactatctttttgctatttttcttatctacttttgttcctatgtaaccattacgagtatcacgtttttgtt

SEQ ID NO: 65334 - DNA, 334 bp, Zea mays
  Clone ID: LIB3075-028-Q1-K1-E7
caactactggaaattagagagccggatctcttggtcggagaacctgcgaggaaggactaaggagtcgaagatgactgcggcggtgctgtccgtgcgcacgacgacgacgtcgctgctagcagcagtcatcctgtgcctctgcatcgtctccctctccccccgcggcgccgctgccgcgcgggtctcccccggcgccagcccgatcgtggccacctgcatgacgggcccgtacccggagctgtgcgtgggggagctgggacagcggctgctggacgtgcagacgtcgatcgcgtccgcggcgcccgaccagcgcgcggccaggatcgcgggcgcc

SEQ ID NO: 65335 - DNA, 333 bp, Zea mays
  Clone ID: LIB3075-028-Q1-K1-E8
gagatacccgatcgacataggcatacctgacttaacttgaaggctgacacacgtacatgcgggaggggagaccctttatgagctggacctggtagcggcgattgagatccgacgcaactctatgccagctacttacacgagcacaataaactacgacggatgttggagcacatgaatgctttacatgatgagaatcatctaataactggtcacttgagtgacgcctgactgacaaagagagagatctactgatgaatgggctgatatctctactaaagagtcacatgtagacacccatgaacttcatgatctatgtcaacgtcgacgaacagc

SEQ ID NO: 65336 - DNA, 422 bp, Zea mays
  Clone ID: LIB3075-028-Q1-K1-E9
atggcgaccacggacctaagccagtacaaggatcatggtaattggatcgagattctacgcgtggacaaccttgtcatcaccggcaagggaaagctcgacgggcaggggccagccgtgtggagcaagaactcctgcgtcaagaagtacgactgcaacatccttaccaactcgctggtgatggacttcgtgaacaacggtgaggtgtccgggatcacactgttcaactgcaagttcttccacatgaacatgtacaagtgcaaggacatgctgatcaaggacgtcaatgtgactgcacccggggacagcccctacacggacgggatccacatgggcgactcgtccggcgtcaccatcaccaacaccgtcatcggcgtctgcgacgactgcatgtccatcgggcccaggacctccaaggtgaacat

SEQ ID NO: 65337 - DNA, 338 bp, Zea mays
  Clone ID: LIB3075-028-Q1-K1-F1
gtcctcgaccatccctgcaaattaccgcgatggctcccaagatcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttcttagttacttcgaccccatcaagctggacgagatgaagacacgcacc

SEQ ID NO: 65338 - DNA, 438 bp, Zea mays
  Clone ID: LIB3075-028-Q1-K1-F10
gatcaccggccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgtcgtgcccgccgtcggggcgctcgtcgcctccttcctcgcctactacctccactgagcgacgacgcgcggggcggcaacgttgggatgcatcgtgtttggttcatccgattaattaattggtttttttatttacgtggtttgcgattggttaattgtttgttt

SEQ ID NO: 65339 - DNA, 437 bp, Zea mays
  Clone ID: LIB3075-028-Q1-K1-F11
gtggctgtaaaacagttatctgaaacatctcatcagggaaaacagcaatttgcagccgaaatagaaactatttctcgagtgcaacaccgtaatcttgtgaagttgtatggttgctgtcttgaaggaaataaaccactgttagtttatgagtacctagagaatggaagccttgataaagcattgtttggaaacgggaaactgaacctagactggccaacacgctttgagatatgcttaggcattgcaagaggcctcgcttatctccatgaagagtctagcatccgtgttgtgcatagggacataaaggctagcaatgtcttacttgatgcaaacctcaaccctaagatctcggatttcgggcttgccaaactgtatgatgacaagaagactcatgtcagcacgaaagttgcgggtacaattggttatcttgcacccga

SEQ ID NO: 65340 - DNA, 445 bp, Zea mays
  Clone ID: LIB3075-028-Q1-K1-F12
agaaaatagtgggatcgagttgtttcactgcacgagcacatcctccggcgaccaccggccggcctctccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgacgagccggggcacctcgccccgaccggcctgatcctgggaggcaccaagtacatggtcatccaaggcgaacctggagctgtcatccgtggcaagaagggatccgggggcatcactgtgaagaaaacagggcagtcactcatcattggcatctacgacgagcccatgacttccgggcag

SEQ ID NO: 65341 - DNA, 370 bp, Zea mays
  Clone ID: LIB3075-028-Q1-K1-F2
atgcgctgcagcacctcagacttgtctttcctccgtccaccgagacattttatttcgaagagctagtaattttctggagcgttgccttcccacggtggctggagctactgattcagaagtgcaaaggcctgcgacggtttgagttgcagtgtggtctgtcattgctcaggagctgcctcgacggtggcaagaactggcatctcgtgcagcagatccccgaggtgcgcatcataagctgcgatggcaagagatactttcggtataacaagagccgccgcatctacgaaactaatgcacagtcagaagaatgaagccatttctgaaaaccttggcacgacactggtttgttttgggtcagccacacgtttca

SEQ ID NO: 65342 - DNA, 357 bp, Zea mays
  Clone ID: LIB3075-028-Q1-K1-F3
cccacgcgtccgttctctctcacactacatggagagtgagtgccgggagacgctaccattggcaggcgccgctctccctctctccactcccgcgcgtgaagactccagaggtgccgagttgctcggtgcgactccttcgtcgccgtccacggaagcggaggccggcgaccaacctccccgcgcggcgaagggtacaggcggccggatccgttgggcctcacgcgaggagagccacgcgaacggattcgacgaccgatgagtccggatcgaagcttccactggccgacttcatcgccgccgtcgccgttcaaccctgtccgtcggcgattcaacgaggctccttccccggctgggtgt

SEQ ID NO: 65343 - DNA, 361 bp, Zea mays
  Clone ID: LIB3075-028-Q1-K1-F5
agaaaatagtgggatcgagttgtttcactgcacgagcacatcctccggcgaccaccggcctgcctctccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgacgagccggggcacctcgccccgaccggcctgatcctgggaggcaccaagtacatggtcatccaaagcgaacctggagctgtcatccgtggcaag

SEQ ID NO: 65344 - DNA, 368 bp, Zea mays
  Clone ID: LIB3075-028-Q1-K1-F6
agcaaaaacaccatcatctcatccgcccgtctcaacgccaccccaatggcccagagcacgaggatggtggcgctggccctggtggtcctcctggtggcggcgacggcgtcggtgcccacggccaccgcgtacggctgctacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggcttcatcggcgcgcgggctcagctcgatatcagcatcatatacaatcgctgctccgtcgctcacgtcagcccatgcatgatctctcgacccggcccattg

SEQ ID NO: 65345 - DNA, 347 bp, Zea mays
  Clone ID: LIB3075-028-Q1-K1-F7
gcagcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcactgggatcaaccccaaggccaagccctactacctttttgatggctacgctcacctttcgtccgggcttgcctgtggccttgctgggcttgcagctggcatggccatcggcattgttggtgatgctggagtcagggcgaatgcacaacagccgaagctttttgtgggcatgatcctcatcctcattttcgcagaagcgcttgc

SEQ ID NO: 65346 - DNA, 340 bp, Zea mays
  Clone ID: LIB3075-028-Q1-K1-F8
cggacgcgtgggcggacgcgtgggcggacgcgtgggcggacgctgtgggtcgtcagcaaagggagagcgccgaggtgatagagataatgctgtggtggtgctcatggttggatgaatgggggtgtcgggctatgcgcggttgacgtcctcattggagcataccccttcaccgttggttgcctcgtgccgtggcctgcgaagtcgatgactgctcatcatggtaggaggtcccgaccgaccgtgcaacctggtgcacgacgctgtggcatgtgcgccaatgacatcacggtcaagaacaggtaccacaggatgaggcgcttggacgatgctgagatgagtt

SEQ ID NO: 65347 - DNA, 430 bp, Zea mays
  Clone ID: LIB3075-028-Q1-K1-F9
gagctgaactgtgttggactgttggataatgctggttcgcctcatcggttgccacaggtgcttaatggcgagtacaccactgatcacatatcaggcgctcttattattattatttcacgatgtctcgggatgttattctagcctgctggtgagtggtgacggcactcccaggcgcccccgaagtccagcgaccattcgtttcagttcagccctggagtccgatgatcccacaagcaacacggccgccagcgtttccggtgctcttgctgagctcgtgtacaccctttccaagatcatcggcgtcagcgtgaacaacaacagctctgccaatgattgagtttggcccagtcagtgtgatctggctgtcggtaacattaatgtttgcaacaccatctgctccagctgtcacatttccaagatcaccggcatg

SEQ ID NO: 65348 - DNA, 370 bp, Zea mays
  Clone ID: LIB3075-028-Q1-K1-G1
cccacgcgtccgcccacgcgtccgcctctcctccggctagggtgttcacgcctgccgcggcgaagcttctgccctccccggcgtcgggctctggtcgtcgtcggccgggaagatggctggcggcttcagggtacttcatctggtcaggccctttctggctttcttgccagaagtgccgagcgcggataggaagataccattcaaagaaaaagttatctacactgttatttctctcttcaattttctggtgtgcagccagcttccactctatggcattcattcgacgactggagctgatcctttctactggatgcgtgttatcctcgcatcaaaccgtggcactgtgaaggagttgggtattacttcaatt

SEQ ID NO: 65349 - DNA, 366 bp, Zea mays
  Clone ID: LIB3075-028-Q1-K1-E6
cccgggacctccaaggtgaacatcaccggcgtgacctgcggccccggccacggcatcagcatcggcagcctagggcggtacaaggacgagaaggacgtcacggatatcaacgtcaaggactgcacgcttaagaagacggccaacggcgtccgcatcaaggcgtatgaggacgccgtctccgtgctcaccgactccaagatccactatgagaatatcaagatggaggactcgggctaccccatcatcatcgacatgaagtactgccccaacaagttatgcaccgtcaatggtgcctgcaaggtcaccgtcaaggacgtcaccttcaagaacatcaccggcaccttctccaccccggaggccgtcaac

SEQ ID NO: 65350 - DNA, 365 bp, Zea mays
  Clone ID: LIB3075-028-Q1-K1-D1
cccgatcgccaccgccgaccggactcccctcaaaggcggccacagcacagcgagcatgggagaccggcatcagcatgggcctggcagcggcgtggaggacccggcgacgctgctgcggcgggtgcagacccgcgcgcccaactcgacgcaggtggtggggttcctgacgctgctcgtctctggcgccgtgctgctgctgctgacgggggtgacgctgacgggcgccgtggtggcgctcgtcttcctgggccccatcgcgctgctcaccagccccatctgggtgcccgtcgccgtcgtgatctccgccatcgtcgccgccgcgctctccgcctgcgccttcgccgccgtcgtgcttcccgtgggca

SEQ ID NO: 65351 - DNA, 434 bp, Zea mays
  Clone ID: LIB3075-028-Q1-K1-D10
accgaagagagaaacgcgagcaaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacgtggaggaggccgtcgcccacctcaacggcctcgtccgggagcccaccgacgccaagttcctcgagctcaagtcgt

SEQ ID NO: 65352 - DNA, 294 bp, Zea mays
  Clone ID: LIB3075-028-Q1-K1-D11
cccacgcgtccgcagacaactagaccaattaatgatgtggagaacttagatatgaaggccaaaatatctacaatttcctgaaagttcagatgagagttggtggtttggcaattgcatacttgctttggctatcaacaaggtcagagcattttgtgatatgggggacatggttgttctagtttccactctcttgctctctctctttttctttttcgttcaccaatctttattgttatgtgacagctagagattgcaagctttgtttattatcgtggttgaacatgatagaagctc

SEQ ID NO: 65353 - DNA, 444 bp, Zea mays
  Clone ID: LIB3075-028-Q1-K1-D12
aaaccctctcctctcgagaagcagagcggcggagatccggagagaagccatcggcagccgggaagcccgtcgcgtgcctttcttcctcgacgtgccatgattaacggaatatttgagcactgggacctggagcgacagtgaagtgtgacccaggagagttctggtgccatgtttcacaggctattccattattcccaaaagcagatgatttccagtgatggggatgaatgtgagaggtcaaatgaagaagatgaagactccaaaggacttctactcgaaagtgaagtagcattcatggactatgttagggaagttcgttattaggcaactgaattgtgggtttgcgtttactgctacaaacgggctctaaggcagcatcacaatgtccgatgcgtatttgattattgtgggttgttggaaagttgctgttttttctgctcaaca

SEQ ID NO: 65354 - DNA, 269 bp, Zea mays
  unsure at all n locations
  Clone ID: LIB3075-028-Q1-K1-D2
ncttatcatacgcagcatatttgtcgacgggatggcgtgcgtaagcgggggcttcgccatcagccagacggtggcggagaggctggagcggatgcaggacgcgtgcatacggctgaacccgtctctgtacggcagcgactaccgcatgcaggcgtgcatgggctagctgggcgtgccgttgacgaggcagcccgtgcttcaccagtacgacgtgtacggtgaccttctgggacttctcgcagcgcaccgcgacgtgccgctcgtgtcgc

SEQ ID NO: 65355 - DNA, 269 bp, Zea mays
  Clone ID: LIB3075-028-Q1-K1-D3
cgcgttcgcgccaccgactcgctcgcgcacccgctccacctctgccggctccgcctcgccgacccgcgctcgcgctccccctccccacggcacgggcggcgcgccatgtcggtccgcagctgcctcatcgacccggacggcagcgcgctcgtcgagctcgtcgccccgtccgaccgcctcccggcgctgagcgcggaggccgaagcgctaccgtgggtgcgcctcgcccgcggcgacctgcagtgggcgcacgtgcttcgctaggggtg

SEQ ID NO: 65356 - DNA, 332 bp, Zea mays
  Clone ID: LIB3075-028-Q1-K1-D4
acgcggacgcgtgggcgcgagcgccgccctcattttgtttatctttgtcgtcttcgtcttgtcgggtcgtgctcgcgctttttttgtttacggtactgtcttgccgccatgtccgtttgtacagaattcatcggctcgacgtgtacgcgcaaattgagtttgacggagtgtcaaataaactgggattaattacccccaggtggatgcttccatacgggtgcgggctggccgagatgaccataactgttagtacatgcattaaggggaaaaccccaacctgggaggatcgatcctgccctagcaccagattatgtttaaagttgacttgcggt

SEQ ID NO: 65357 - DNA, 349 bp, Zea mays
  Clone ID: LIB3075-028-Q1-K1-D5
gcttcctgcagcggatggacctgtgccgcaaatacgcctttggcaagatgcttgtggtaggctctgagccccctttcaaggtcaaggggctctggctcttcaggggctcagaaattcccaagtttgtcatggacgaagtctatgacatggagctttatgagtggaccaaggttgacctctctgatgaggcacagaaggagcgggtcaatgccatgattgaggaccaggagccattcgagggcgaggccttgctggatgcaaaatgcttcaagtgaggaaagagtttttgggtccaattctaaaacagccatggattatagtttgtgatatggcgtgctggttatgatta

SEQ ID NO: 65358 - DNA, 203 bp, Zea mays
  Clone ID: LIB3075-028-Q1-K1-D6
attcgatccaaaaaatagacaagaagataatataccgaatatgggaaattcttcatgggtgggtctttgtaaaataaaaaggtaaaagaaaactaaaaaatataaaataacataaaaaaatactatttaacaaaaaaagggaggtctatccaaagttcctttataatctgtactaatgtttttttggtttaaaagttttttta

SEQ ID NO: 65359 - DNA, 342 bp, Zea mays
  unsure at all n locations
  Clone ID: LIB3075-028-Q1-K1-D7
gtctaattggggagatttgatgtgttattggtgccgccggatctcgccgacatgtggaagcaatttataggaaagctatcgtggaagtcaatgaaatccagctctggcagcggggggtcgccgccggcgccactatcgtcgccgcgggagaatggagcctcaccgcgggagaatggggccacggggaagccgaacgtctcgcctcggtctcccgcggctggcgccggagccggagccggagccggagccgaagtgaggtccagggaggacgcctttgtccagaaagttaacatttgctgcgcggtgtacgacttctncgaccgaagcaaggactcgccggag

SEQ ID NO: 65360 - DNA, 361 bp, Zea mays
  Clone ID: LIB3075-028-Q1-K1-D8
agtcgcactaggaacttactacattcttgctctatagaaactgtcaggcttgtgagagttctgttatgtaccgcttcttttctaaagaaaaatagtagagttttagaaaacataatgaatacagcttcttttattgaactcttagaagtactccagccattgtagtttaatttatctgcatacagttggttgtattgaacactgggacaccctgaggtctttgttgttcaattatgattatatttctgtatactttatttttaatggttaatcaaaatgctagcttatataatgctccctcaaatgcaggttgcaatattttccagcatagcttgctcacctacttctcaatttagaagac

SEQ ID NO: 65361 - DNA, 332 bp, Zea mays
  Clone ID: LIB3075-028-Q1-K1-D9
gcgttcaaagctgtaccccagaggtcggatcctttgtcaatgacagtgaatggcatccagcgtgcctagaacattacgtcaggcgagatctgtctccaacccaccccatcaagcttgtgctcgctctcaacttctcagtgttctactaccaaatccttaacttccgtgatctctcctgcaaccctgcaaaacaggtcttcgattaggcaatctcttagctacacagcctgtgataggagttctacaaagacatgactttgatcatgcagttcctgcacgacaactcgaccctattgacttcctacacctactacgatggctgcaactagatc

SEQ ID NO: 65362 - DNA, 190 bp, Zea mays
  Clone ID: LIB3075-028-Q1-K1-E1
acggcggtattattttcatggcacctgtggccattaaagatccatggacacgtacagtaccaatgcatgattcttcacagttcaactatcgatgatactgttcatggattttcattccgatacaaactcatttcgtggttaaaaaaaaaaaataaaaaaaaaaaaaaaaaataaaaaaaaaaataaaaag

SEQ ID NO: 65363 - DNA, 440 bp, Zea mays
  unsure at all n locations
  Clone ID: LIB3075-028-Q1-K1-E10
aataaagcatcgatcacgacaagatggcgtgctcagacaatgcgaagagagccttgatcctgctggtcctcttctgcatcgtgcatggtgagaaggaagagtcaaagggcatcgatgcgaaagcgtacgtgcctggtgggtacttcgacatcaccaagttgggcgccttcggcaatggcatgacagacagcacgaaggctgtgcaggaggcatgggcatctgcgttcggaggcactgggaagcagacaatcctcatacccaaaggcgactatcatgtccgacaactcaacttcacaggccctcgcaagggcgacgtgaccattcaggttgatggcaatctgctggctaccactgacctaagccagtacaaggaacatggtcattggatcgagattctacgcgtggataacctgntcatcaccggcaagggaaaccttgac

SEQ ID NO: 65364 - DNA, 360 bp, Zea mays
  Clone ID: LIB3075-028-Q1-K1-E11
acgcgtccggtcgtgtcttccgctgtgttagcgtttacaacaaacaccacacgtcgtatagcggcagcccagtccacctgctccgaagccggcggtcgccgccggccatcgccgcggaggatatggcgtccctccgtgtggtgtcggtgctagtgttggtggcaatggcggcgagcgcgggcggcgtcgcggcgcggcctctggtagggggaggcggcgcgtgggagaacagggcgccgctgcagacgtcgcgccccttcaacattgcgcaccggggctccaacggggagcttcccgaggagacggcggcggcctacgcgcgcgccattgacgagggcgctgacttcatcgaggcggaca

SEQ ID NO: 65365 - DNA, 240 bp, Zea mays
  Clone ID: LIB3075-028-Q1-K1-E2
aaggaacctgaagatcaaattggagaagtacctggagtttgcaccaaaaaggttaagaacaggtgcatccagaagtggaggaagactctgatgaagatgagtttggagagatctaggccatcgtctcccagtcaactagggattgtggaggatcgtcgtcgccatatggtgtaatatcttttagttattttgtacagaatttctattaagtaataaagatatgacattgatttctgtacc

SEQ ID NO: 65366 - DNA, 421 bp, Zea mays
  Clone ID: LIB3075-028-Q1-K1-C9
gagcaagaccacctaggaggcctctctctccctctccccagccacccccgtagcgagagggagggcggaagaggatgagcgcgtccaggttcataaagtgcgtcacggtcggggacggcgccgtcggcaagacctgcatgctcatctcctacacctccaacaccttccccaccgactatgttccgacagtgtttgataacttcagtgccaacgttgtggttgatggtaacactgtcaacctcggcctctgggacactgcaggtcaagaggattacaacagactgagaccactgagctatcgtggagctgatgtttttcttctggctttctcactgatcagtaaggccagctatgagaatgtttcgaagaagtggatacctgaactgaagcattatgcacctggtgtgccaattattctcgt

SEQ ID NO: 65367 - DNA, 359 bp, Zea mays
  Clone ID: LIB3075-028-Q1-K1-E4
ggaaagggcaaaaaggcaggaagaggcaccactgattgagcaagcttttcaaaaacgtcttgaggaagagaagatccttcacgagcaagagcagcttcgggagattgaactcagcaagcaacaccatgccagcgacttgcaagagaaaaatagactttcacggatgttggagcacaagaatgctttacaggagagaatcatccaagaacgtgcagctgagtttggccgtctgaagaaagagagagatgaacggatgaatcggttgatatcttcaagaaagcgtgaaagggagacagtaaggaagttgatgttttatctgaacctggaggaacagcggattgaaatgctacgtgaggaag

SEQ ID NO: 65368 - DNA, 330 bp, Zea mays
  Clone ID: LIB3075-028-Q1-K1-E5
cggacgcatgggccgtggtctcgaagaaggcagcctctaactcgtcaccggcaacggcaccatccagggctatcacggatgccgagcaggctggtagataccgacacgccttactctcagacctacgcagggcaagaagcaaatactggacacccatgtcctcctagctgctcactcttaagagctggaagatctattgctgggactcagaatgttacaagcctgcacaaggatgaagcatggaacgtgaatgtacacatccatggctgagatcttgaacagggtcatacatgtggaacgatcgacgcgcttaatgttccattagcagat

SEQ ID NO: 65369 - DNA, 165 bp, Zea mays
  Clone ID: LIB3075-032-Q1-K1-E9
aaaataattctcagattttggataacgatctgctagacaaacgtgtcaagaagaaagttggcgggtgtaaactcagccttgggtggttggccagatacagtatttgattctctaatgtattcatgtatggatgttgctgatctcttttatgaacaaaacgtgctg

SEQ ID NO: 65370 - DNA, 141 bp, Zea mays
  Clone ID: LIB3075-032-Q1-K1-F12
tcggtgacattggatcatggctgacatcttcggcccacagatgtttctgctttggttgcctactcggatgcttgttgggccgggtgttctgacacccgtcggtcaacctgtgggtatgcggtttttcttggtgataacctc

SEQ ID NO: 65371 - DNA, 374 bp, Zea mays
  Clone ID: LIB3075-032-Q1-K1-F2
aatgaagagccgcagcatggcatcatcggccgcgctcttggtgctagccctcgcgctaggggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgttgggtttggggaaaaaaaaaaaaatggggggg

SEQ ID NO: 65372 - DNA, 355 bp, Zea mays
  Clone ID: LIB3075-032-Q1-K1-F3
cagagaacatcactacggagcaggggaagacgctaaaagatgcttggggcgacgtgttccgcggcctagaggtggtggagcatgcttgtggaatgggaacactgcaaatgggcgaatatgtatcaaatgtttctaatgggattgacaccttcagcattcgggagccacttggtgtttgcgctgggatatgcccatttaattttcctgctatgattcccctatggatgtttcccatagcagttacgtgtggcaatacttttgttcttaagccatcggaaaaggacccaggggctgctatgatgcttgcggagctagcaatggaagctggtttgcctaagggtgtcttttttggggg

SEQ ID NO: 65373 - DNA, 340 bp, Zea mays
  Clone ID: LIB3075-032-Q1-K1-F4
cactcccctaccgccacccctaaaactagccccattcccttaccagcgtccgatcacactgctgggtcccacgcttggatggattccgtcggtacaaatcggcccccgctgcgccccgttgccgccgcagctactcgacgcagcgcgctcctgcgcccccctagccacctcgggctcggcaatcgttttgcggagactaagcttgggatcgcgtcagggtgtggaggaggaggagggtattttggaaaggtacagggatttgatgccttgcggagtaccacgacgaaagttcagagcgggaaggcggggaggagtgtgaccaaggaaatgggacacactt

SEQ ID NO: 65374 - DNA, 339 bp, Zea mays
  Clone ID: LIB3075-032-Q1-K1-F5
acggttgtagccatcatcgcgtgctcgtcggatagtagagagaaaattgagatcgcaggcagtgtgattgaggtcgcaatcgcaccttcgcctaagccaactcaatgcttgtgaagatcgtaggcgcgcgccgcacctggctgtatcctcgtgtggcgaagactgtggctgggcgctgagaacagagatgtcgcgctggatgctcatcggagcttggtgacagaccgtcgtggtcgccctgggggtggaccctagctgcgcgtggaggccggtgccaaactctcccactctgtgactactataatgccatctccttccgcgccggcgttttgcatacac

SEQ ID NO: 65375 - DNA, 338 bp, Zea mays
  Clone ID: LIB3075-032-Q1-K1-F7
acgccaaattctgccgtgaagttttttagctactagcaggcgtcaaagggaattctgtgggcgcgtaccgtcaacagactggagaagaggatgctcagcttactccgctcttgcgccatggagctggagcatgtgctggtatcatagctatgtctgctacttacccgatggatatggttaggggaaggatcactgttcagacagacaaatctgcctaccagtaccgaggtatgtatcatgcactgggtacagtctaccgtgaagaatgctttcgtgctctatacaaagggtggcttccatctggaatctgagtcgatccatatgatggtcttaacttc

SEQ ID NO: 65376 - DNA, 367 bp, Zea mays
  Clone ID: LIB3075-032-Q1-K1-F8
ccggggacgagaacaactacgtgagcgtggccgccgcctacgagaaggccgcgggcgccgtcatcgcggcgacgccggacaacaagctccgcgctatggcgttcgcgttcgacggcgcggtggcgccggacccgggccggtgccccgccgtcgacaagcccttctgcgagacctacgccaagacggagaaggccttcagcggaaccatcgcctccggggacacgcccaagagcaagctggggatcacggacgccgtgctcaagctgaggctcgccaccgacgccaacatcaacaaggcctacgcggagggggacaaggacaagatcgcaaaaatccttggcttgccaaaaattttttaaaaaccccc

SEQ ID NO: 65377 - DNA, 370 bp, Zea mays
  Clone ID: LIB3075-032-Q1-K1-G1
agcccatgaagctctcttggggcgccatctggaggatggacactgccaaggcgctcaagggccccttctccatccgcctcaccagcgagtccggcaagaaggtcatcgccaaagacgtcatcccgccgaactggagacccgatgccgtctacacttccaacgtccaattctactagactttgaattcccttcgattcatccggcgcggtgggctatggacctgcagcagcaagctaattaagtttatatatattgcatgagagagcatgcaccgctaaccatatatactactgagacttctgaattctagtatatgtaatcctttttgtttgggtttaggagggcaaacttttttttccccccttttttt

SEQ ID NO: 65378 - DNA, 394 bp, Zea mays
  Clone ID: LIB3075-032-Q1-K1-G2
cctttagttgccaatttaaaggaacagtataaggaataccgatttgatggcccaaaataagcagatcattgttgtggtggctctcctttttcttgtggtggcaacatcatcatcagtgtgggttgcagaaggagccgatgacttaaaagtttcttgcgttaaagagtgcacccaaaattttaacactcccgagggcaagaagatctgtgaaacgatgtgtgccaaccctaaaggaaggcctatcgacagagttagagctgattgatcaatgctcatctttatttgtagctagctatcatgcatgcgatgatggccttcttgattattattatttcattccttcattggtttttttttgggggtttttttttttttttttttggggggtgttttt

SEQ ID NO: 65379 - DNA, 336 bp, Zea mays
  Clone ID: LIB3075-032-Q1-K1-G3
gttagcccgatcagatcgtttttccctcgaggtgagagtaagatgagggagatcctgcatatccagggagggcagtgcgggaaccagatcggctccaagttctgggaggtggtgtgcgatgagcacggcatcgacccgacggggcggtacatggggacgtcggacgtgcagctggagcgcgtcaacgtctactacaacgaggcttcgtgtggtaggttcgtgccgcgcgcggtgctcatggaccttgagcccggcaccatggacgccgtccgcacgagcccctacggccagatcttccgcccagacaacttcgtcttcggccagtccggcgccggc

SEQ ID NO: 65380 - DNA, 406 bp, Zea mays
  Clone ID: LIB3075-032-Q1-K1-G4
agagcatcatattgttcactcacgattcgtactgaagcatcaaaacagaaacctaaagctagacataatatgataataaagaactaaataaaattaagggttcagaacgaggttgttactcagcattaatcaaataaatgaagcccttggctggagttccaaactaaactactgcatcttgttttcctttatcatgcccgtacttgcttccttcttttattcataccattgattttatttagttcttaatcattatattattgatagatttatgtttatctattcttttctatattcctttattgttttctttttcattttgatctcttttttttcttttattgtgtttcttatttttttttattttcttacttattattgttatttatttttttctttccttttt

SEQ ID NO: 65381 - DNA, 328 bp, Zea mays
  Clone ID: LIB3075-032-Q1-K1-G5
atcgcgagggccgcccttttttttcttgctttaacatgcaagctaatgtagccataaatgggcaaagataatacagcatttctttggtatacaaggttatgcttccgtatgacagaattccagcttatgttggaacacttttaactttgtgccgcaatcaacactgcacatctcatttaaaaaacgaaggcctaatacatgtggaaattaaactaaaatctgaaagcttcacaaaatgttcgtatccgctcctctagcatactttggtgttgtaaaccacacctgtggttaccttaactagaaacaaggaactaacctgcatattaat

SEQ ID NO: 65382 - DNA, 307 bp, Zea mays
  Clone ID: LIB3075-032-Q1-K1-G6
atgaccgcaaaggattgctgcatgatgtgtttcacatactatctgatctggagctaataggccacagggtgaaggtggcgaccacaccgtacggaagagttgttgaccttttctgtatcactgatggcatggaactgctgcacagaatggagaggcatgaggagacctgctcggagctaacatgtaccctgggcccttacatcaactgctaggtcgtaccagcagaatggatccagcatgggttttctttcctgccgcctgagatcggctaggaactgttcatggcggagcttgctgacactgacag

SEQ ID NO: 65383 - DNA, 347 bp, Zea mays
  Clone ID: LIB3075-032-Q1-K1-H1
caagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttgtttcccttctgaagaagaactggcagaatgtgagatgccttctta

SEQ ID NO: 65384 - DNA, 295 bp, Zea mays
  Clone ID: LIB3075-032-Q1-K1-H11
tcggtgaaggctcatcagaaggcacttgtagatcatgggaagaatatagaccctgtgaaattgcaattagaaaaggagaggctggaaaagaggcagcatgaagagaaagcaaggatcgaggcccaggagaaggctgctgaagcagctgcacaacaaaagtttgaggaataaatgatgatgaagagaaagcaggaaagggaggcagcacgcctggcactacgcatgatgaataacactgttgatattgacaacagttgacttctaaaggatctggagaactttagtaaaaacaatg

SEQ ID NO: 65385 - DNA, 387 bp, Zea mays
  Clone ID: LIB3075-032-Q1-K1-H2
tttgatattgagttctctgtcacacataaggagttggatttctcccatttattggatcacctaagaaggattctcaggggtcaggtctcattatttgattggtccaggtcaacatcactagctaggaccttttctcctcgtgttttggagaaccaaattgatgccagaaaagagttggagaaaagccttaaagctacctgtgaagagtttataatgtccataactaaattagtagttgacccaatgctttcttttgtaacaaaggaactgccgtcaaagttgcattgtcctctggtagccagtgtcagaaattaaattcagttctagcaaaaccctttgaaagaaccttctaaaaatggggttcccccccttttttttttatttttt

SEQ ID NO: 65386 - DNA, 394 bp, Zea mays
  Clone ID: LIB3075-032-Q1-K1-H3
gttcttgctcgaggttttgaccaagcacaggttaaccttgtcatcaactacgacatgccaatcaaatttggtacaagagatgaacctgattatgaggtgtacttgcacagaattggcagagctgggcgctttggccggaaaggtgctgtgttcaacttgctgtgtggtcaaaccgataatgttgtgatgaagaagatcgaggactatttccagcacagtgtgcctgaggttcggaattggcaacgtgaagaagattttgaggctgctctcaaggatgcaggtttactttaaagtaaccacggaaacttgtggtgttttttgctgagcctgctgcacaacgtttattttggggtttttgggggggccccctttttttcccccttttttttttttt

SEQ ID NO: 65387 - DNA, 340 bp, Zea mays
  Clone ID: LIB3075-032-Q1-K1-E7
cggacgcgtgggtatttttagaccaatcgcaaacagaggtggttcatgttatacaaactgtatacgtagatacacgcgtgtgggattaaatcaatgattaaatcaatccctacttcctctgtggaaaaaaaatttgaccaaactgtactgtgatgtgtaacaatgccacaacacagtacttgaaggcaaacgtatgtagattaattagcagaacgacaacctgtgatccatccttgctttcttccatgaaatgaaacgcagccagcgcgacctggcatggccaggccatgagctagaagaagcagcctgatgcccaccggccttcagcacggcttgcccg

SEQ ID NO: 65388 - DNA, 367 bp, Zea mays
  Clone ID: LIB3075-032-Q1-K1-C9
cttctgcacttactccgacaaccagcccggcgtgctcatccaggtgtacgaaggtgagagggccaggaccaaagacaacaatctgctcggcaagttcgagctctctggcatccctccggcgcccaggggcgttccccacatcaccgtgtgtttcgacatggatgcgaacggcatcctcaacgtgtcagcggaggacaagaccaccggacagaagaataagatcacgatcaccaacgataaaggacggctaagtaaggaggagatcgagaagatggtgcaggaggcagagaagtacaaagccgaggacgaggaacaccataagaaggggaacgccaagaacactctcgagaactatgcctacaatatg

SEQ ID NO: 65389 - DNA, 390 bp, Zea mays
  unsure at all n locations
  Clone ID: LIB3075-032-Q1-K1-D1
aggaaacctagacaagcgaggcggcggccccgcgttctccgtctccgtctccgtctccggccgcccggcgtaaagaaaacgctccctcaccacagccgccacgccatggccgaggagaccgacaccaggcctgcctccgcgggctcccgaggccgccccgcgcccgaggacgacgacagggaggagggcgagatcaccgacctcgcctgcgctccttccccgcccgccacgcacccgctcgagcactcctggaccttctggttcgacaacccgcagagcaagtccaagcaggccgcctgggggagctccatccgccccatacacaccttctccaccgtcgaggaaattctggggggnggggggggggggccccccctttttttttgtttt

SEQ ID NO: 65390 - DNA, 304 bp, Zea mays
  Clone ID: LIB3075-032-Q1-K1-D10
tcgcaagacaaaacatggctgtgaatgtgagaaccatgtggtcgtcgatgcgggcacaggttgctatggttgtggcgttggtggtcttggtgagcggcgcatggtgcggtccttccaaagtccccccaggcaagaacatcactgccacctatggcaatgactggcttgacgctaaagctacatggtatggcaagccgactggtgccggtcccgatgacaacggtggcggctgcgggtacaaggacttgaacaagccccccttcaatagcatgggcgcatgcggtaacatccccatctttaagga

SEQ ID NO: 65391 - DNA, 173 bp, Zea mays
  Clone ID: LIB3075-032-Q1-K1-D11
ctttactcaaggaatggtggcaaaaactggattaaagcgatggttcttacagcgttcctgtttgcgttcttgagtttctcaattggcttcgcgctgaatacttttgctattttctaccgttcattagcagcaataccatttgtaacaatggttgttatgtatgtactttaggc

SEQ ID NO: 65392 - DNA, 403 bp, Zea mays
  Clone ID: LIB3075-032-Q1-K1-D12
ggacacaaaggaggcggcggcggctgcggcgggagcgagctagtcgcagcaactagcgggtctggtgattcccctgacgcagtcgccgtggatgaggatggggatctcgttctggaccggaggagaagaaacaaatatgctagaggtgaccgccatctgttcactattcagcatggtgttaccagctcgcttaagagcgttgggcttcagccgtgcaggtttggaaagcggccttactattatctgacttgattctgcacgaaagcttttcatcggcaaactttgatggtgttactgccattgagataggtgctggaacagggttggtaggtttagcactagctcgagttgctagaaggattttggtacagatagaggcactgatatccttgataattgcttg

SEQ ID NO: 65393 - DNA, 312 bp, Zea mays
  Clone ID: LIB3075-032-Q1-K1-D3
gtaacacagttgagcacgacgatgggatccgtcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgc

SEQ ID NO: 65394 - DNA, 309 bp, Zea mays
  Clone ID: LIB3075-032-Q1-K1-D4
gcgtgcagatcgactgcgtctacctcatccattcctctgctgatgccggtgctagctgccctgagggtggatggttcggtgcaccatcggcggttaccttccacgtcgggcagggcttcaagcccggccacttggtcctcacccccaacgttgtcaccatctctaacatggagatcaaggatcaccggggggacgactgcccctttacactcaaagcgggagcgactgtgacttggacgctcgacatccagaccccggtcatgtacctgatctgcaaccgcttatgtgccaagttcggttgctaccgca

SEQ ID NO: 65395 - DNA, 359 bp, Zea mays
  Clone ID: LIB3075-032-Q1-K1-D5
cggacgcgtgggcccggctgcagtcccccgccggtggtcacccataaggatgaccaccggcttcatggtggggagaagcaagccaggctgcggcttccctcctgccctcagcttcaaggatgttcatcatcctcgctggggtggaaggcgcgtcgagccggggttctgcctcccgcatgggccagcggcccgcttcttcctctagcattcgggggacgagaggggttcaccagccatgcgaaggaggcgaactttggctacgcggcgccggtcaggtgcaggcgctgacagctgctgcgtgcctggctcttggcctgcgtggccctgccgccgtctccgacaactgtcgcccttttttt

SEQ ID NO: 65396 - DNA, 386 bp, Zea mays
  Clone ID: LIB3075-032-Q1-K1-D6
gggggaaatgtgttaccatcaaaattagaggacatcacagagagtgactggacaaggttagagaattacgcaagtaccggagaaaaggttgaggtggagctgataaattgcagtgtgaaggggtttgttgtgtcacttgactcactgataggtttcttaccgtaccgtaatcttgctacaaagtggaaattcttagcctttgagacttggttaagaaggaagggtggcgatcctttcttgtacaagcagagtttgggattagaggatagttttgaggttaatgacacatacctataaccaaaatctagctcagtttccaaaatagctggttgatgacccataagttaaaaaaaattttttttctctctttttttttcttttttttt

SEQ ID NO: 65397 - DNA, 384 bp, Zea mays
  Clone ID: LIB3075-032-Q1-K1-D8
gagcaatggcctctaggtcatccatcctgctcgtcatggtggtgctagctacgctattcgtggttggttcgtgcaccaccccgctcaccttccaggtcggcaagggctccaagcccggccacttggtcctcacccccaacgttgccaccatctctgacgtggagatcaaggagcacggtggcgacgacttctcctttacgctcaaggagggtccgactggcacttggacgcttgacaccaagaccccgctcaagtaccccctctgcatccgcttcgctgtcaagtccggtggctaccgcatcgccgacgacgtcatccccgccaatttcaagggccgggcaaccccccaaaaaaacctttccccctttttttaaaaccccccaa

SEQ ID NO: 65398 - DNA, 368 bp, Zea mays
  Clone ID: LIB3075-032-Q1-K1-E1
cccacgcgtccgagtttgtggactggtgccccactggattcaagtgtggcatcaactatgagccaccctctgttgtccctggaggtgacctggcaaaggtccagcgtgccgtgtgcatgatcagcaacaacaccgccgttgccgaggtgttctcacgcatcgaccacaagtttgaccttatgtacgccaagcgcgcattcgttcactggtatgtcggtgagggtatggaagagggtgagttctcagaagcccgtgaggacttggctgctcttgagaaggactatgaggaagtcggtgcagagggtgccgatgatgagggtgacgagggagacgactattgagtagcctttgggggccccttttttttt

SEQ ID NO: 65399 - DNA, 213 bp, Zea mays
  Clone ID: LIB3075-032-Q1-K1-E11
tccacgcgttcgatcggtcaaagacaaaagatgattgctgtgagcatcatgtggtcattagtgcgtgtgcaggtgctggcggcgatggcactagcatttctggtaggcggtgcctggtgtggtcctcccaaggttcccccgggtaagaacattacagccaactatggtagtgattgtctagatgccaaggcaacatgggaatggcaagccaac

SEQ ID NO: 65400 - DNA, 403 bp, Zea mays
  Clone ID: LIB3075-032-Q1-K1-E12
tcgcaagcgcacaagatcaaatacctcgccgtcaacaatggcctccaggtcctccatcctgctcgccatggtgatgctggctgcgctattcgttgttggtttgtgcaccccccccctcaccttccaggtcggcaagggatccaagcctggccacctgatcctcacccccaatgttgccaccatatccgacgtggagatcaaagagcacggtggcgatgacttctcctttacgctcaaggagggcccgactggcacctggacgctcgacaccaaggccccgctcaagtaccccctttgcattcgctttgctgtcaagtccggcggctaccgcattgccgacgacgtcatccctggcgatttcaaagccgacaccacctattagaccacactcagcatctaatta

SEQ ID NO: 65401 - DNA, 339 bp, Zea mays
  Clone ID: LIB3075-032-Q1-K1-E2
cggacgcgtggggttccgcgcgggctcgcgcggctctctggccaccagaccatagaggatctctccaaggtcacttcctcgctcatgtcacctaagggcgaccaagtctaggcggaggaggcagcgggtcgagggtcaccgaagaggtgatgaatggtgtgcgcccccgtctggaacaacttcgtgctccgtacacagaggacaatgtgctgtgggtggtgttgtcggccatgtacaacatgaggtgtgtgggcatagggttgtccgagaacgacctcattgtgggagtcgactgcgtggtgtatgaagcagtggtcctaggagacttcccaagaattc

SEQ ID NO: 65402 - DNA, 354 bp, Zea mays
  Clone ID: LIB3075-032-Q1-K1-E3
agaacgtgaacctgccaccctacagcggcatgacggcgtgtggcaacgtccccatcttcaaggacggcaagggttgcggctcatgctatgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagcttcgccactgcggcatcatggacgtcgagttcagaagggtgcggtgcaagtaccccgccgggcagaagattgtgttccacatcgagaagggctgcaaccccaaactaccccttt

SEQ ID NO: 65403 - DNA, 384 bp, Zea mays
  Clone ID: LIB3075-032-Q1-K1-E4
cggacgcgtgggaacgagattcatagcctcacgcagcagattatgtactgctatgcagtgaatgggagatctgcaaacccagctcacctgtggctgacaggttgcagtggtgaaatggcgacccatcttcagagaattcctgggtatgataagtggatcattgaaagggcggccaggccttatattgaagcatttgaagaccgtaaagaaaacctcgtgtatcttacagcagatgctgagacagtgcttgatgatctagacatgtcgaaaatatacatcatcggcggcctggtggatcgaaacagatggaaaggcataacactgaagaagtcagcttgaggccaggggggggggaaaaaaaaaaaatttttttttttccccccc

SEQ ID NO: 65404 - DNA, 303 bp, Zea mays
  Clone ID: LIB3075-032-Q1-K1-E5
tcgggctcgtcgtcagagtcggagtccgagtcgtcgtactcggggtccagcgtggagtctgagatcgagtcggagttggattcggaggaggagaggccgacgcggcggcgcaagacgaggaaggaaagggaggatgaggagagaaggccgaggacgaaggagatggagaggagaaagaggacggagaaggcgaatgagagggacaggatgaagatgacgaacgaggacatgacgagtccctagctcatcgactagacttacatcgctgttcttaagcacttgtggcgatcattcgcgttgctg

SEQ ID NO: 65405 - DNA, 342 bp, Zea mays
  Clone ID: LIB3075-032-Q1-K1-E6
tccacgcgtacgtgctggtgcaagggatcttgccaagatacgagctgagagcatagatcggatcattcatccgtaatgccgaacatccagcagtgcttggatgccggcaagggtgaggcccagggcgagtaccaggcggagcacgcggagcacagcgtcaaggacaccgccgaaagcgcggacgtcagtgcgcacctgcagaaggaccgccccaccgacaccgctgagcaggtggagcacacggtccaaggcgtgaaggacagcgtcaaggacacggtggctggcgctgcgaacaccgtcacgaacacggtggcgggcgttacggacaccgtcacgaaacca

SEQ ID NO: 65406 - DNA, 305 bp, Zea mays
  Clone ID: LIB3075-032-Q1-K1-C7
acggcttctttaagcctgcggttaggggggcataacctcaaccggagaagacggccgagggctacgagctacgtaatcaaggtccggctagccacggattcaaggtccttgacagcgctcatttcccatccgcgtactagggggtgaggacgcatctgacaccgggacctaccaagcattgagacaagcgccgccaaaaggaagctctggcacctgttgactcaagcccaaggcccactggcgggctccactctgccatttacacacactgccgattaggctggtttaaggaggaaagggagtgg

SEQ ID NO: 65407 - DNA, 328 bp, Zea mays
  Clone ID: LIB3075-032-Q1-K1-A8
cccacgcgtccgcccacgcgtccggcttgcctcgctcggctcacaccccttttcgtctcgtctctgcctttcctccgcaaacacagagcgcaagaggagagagagagagagagtgagaggggagagagagggctagggttttgtgccccccacgcctcacgcatcgaatccgagccgggtcggggttgctgcgaatcgccggcggtgcttgggctgtgattccattgcaatggcatctgaaactgatgagaaagctaagatggagagtttgacatctgctgcagcctttgtggagggtggcattcaggatgcatgcaacatttgcctt

SEQ ID NO: 65408 - DNA, 391 bp, Zea mays
  Clone ID: LIB3075-032-Q1-K1-B1
gctacgcaccaccattatattgatcgatctatgctgctgctggtcgcaaacgcaccgcagcttcacgggcggccctctcccgaaaatcgagcaccagagtgttccaatcccttctccatataattattggtgttagtttcctgctttccctagtccctcgcaatcaacagatacctcatggacgatcaggagaacgagaatgagcacgagaagcatgccgatgctgggactgacgtcgaggacgaagaggaggacgaagatggccacaagcgtgtcgtcgttcttgggccccaagtccccctcaaggaacagctggagcttgacaaggatgatgagagcctgaagaaggtgggaaaaaaagggggggggggtaaaaaagggggtccccccc

SEQ ID NO: 65409 - DNA, 260 bp, Zea mays
  Clone ID: LIB3075-032-Q1-K1-B10
ggtcagctgaaggagctgcagacgactactaagcgtgcctgaagcagcttgttaagaacggtgtgatttctatgttagcggcgactggatttccgaggtttgatcttcagcttctgggaatgggacctgatggccacattgcgtctctttttcctggccagcctcttgttaacgagaaatagaggttggtcacatacattaaggattctgcaaagtcttcttcagagagaagttcattcacgttttcagtaatcaactca

SEQ ID NO: 65410 - DNA, 338 bp, Zea mays
  Clone ID: LIB3075-032-Q1-K1-B2
cgcctttgacctgctcgagaagtacagggagagccatctcgtcttcaacgacgatatccagggaacagcctccgtggtcctcgctggcctcctggcggcgctcaaggtggtcggcgggacacttgcggaccacacttacctgttcctcggcgccggcgaggccgggactggcattgccgagctcattgctctcgagatgtccaaacatactgggtctccgatcgaagagtgccgcccgaagatctggctgatggactccaagggcctgatcgtggtgtcacggaaggactcgctgcaggcgttcaagaagccatgggcgcacgagcacgagcccgtgg

SEQ ID NO: 65411 - DNA, 370 bp, Zea mays
  Clone ID: LIB3075-032-Q1-K1-B3
ggccggagatctctgaagccttcgacgcgtttagcatccatcatgttggcatactgcggaaagatcaaggatgagctcattacgaatgctgtctacattggcacccatggcaagggtatccttgctgatgatgagtccactggcaccattggcacgcgcctattccagaatcaataggcagaacgtcgaagagaaccgtacgaccctccgtgagctactattctagcagccctggtgctatacagtacatcacccatgtgatcctcttagatgacactatgcaccacaagaccaaggatggctatccatcttgatgatgtcctcaaggacgcaggcatcactgcatggacatcaaaaggggggggttttt

SEQ ID NO: 65412 - DNA, 337 bp, Zea mays
  Clone ID: LIB3075-032-Q1-K1-B4
gagaaggcaaagtcaaaggacaacgattcaaaagcgtccgggcccggtgggtccttcgacatcaccaagttgggcgcctctggcaatggcaagacggatagcacgaaggctgtgcaggaggcgtgggcatcggcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccttgtcatcaccggca

SEQ ID NO: 65413 - DNA, 348 bp, Zea mays
  Clone ID: LIB3075-032-Q1-K1-B5
ccgctttgagcagcttgaatttgcccaaaacaaaaggcagaatgcatggcagcagtttcaaaccaaggggaaagccaaaaaggtggggttcttctccggtcgcaagaaggagagcatcttcaagtcaccggacgaccacagaggtaaggtgggtgtcactgggagtggcaagggcctgaccgacttccagaggagggagaagcatctgcaccttaaaggtgggtccggggatgcagcggatgatgacgaggagtaaactgaagaaccgagcctctgtttgtatcccgccgaacagacatttccatacctgttctttagcgccgacatggcctcgaggggacttcttga

SEQ ID NO: 65414 - DNA, 364 bp, Zea mays
  Clone ID: LIB3075-032-Q1-K1-B6
tcgcaagaatcaaatcgttgtcttctcttggagcaagagaatctcgtcgatgacaagaacccggacagagcagcgaagccatctccaatctctcggaacaagagcagactcgcctggatcaccgtttcaaaggatttttttttcaaccgctggatgaagacagtgttatggcctcttctgcgagcgatcccttcttttccttgttgcgagcggcatattctcctcctttctccaacagcaatttctatctgtctctcgattgagactacgtgctgataacgtgttgtaatactcaatggttaatagtgaaaagtccttagcccattgactgggccagcactttccttttttttaaaaatttttt

SEQ ID NO: 65415 - DNA, 333 bp, Zea mays
  Clone ID: LIB3075-032-Q1-K1-B8
ggagaagaagtggagattgaatacgaggtcgatggttggtattatgtgaagaaaaggaggcctggaagggatggaaagatggcaggtctggttcctgttctgtatgtgagttcatgataacagccatgtgtatcgtttcccacacttgtggaagctgtttggagttcatgggcttaacaaaaaggcacactggaatgctcccgagagatcttcgcataaactcgtgcccgtcgtataggcacgtggccttgtggaagcaggtcatatccagtcatcttggggttcgtatgatgctgcagtgctgttcctgggaaagatttacgtgttgatttg

SEQ ID NO: 65416 - DNA, 353 bp, Zea mays
  Clone ID: LIB3075-032-Q1-K1-C1
aagtgaaatacgagctagacaagaagaccggaatgatcaaggttgacagggtgctatactcatcagtggtctacccacacaactacggtttcattccacgaacattgtgtgaagacggagatccaatggatgtgctggtgttgatgcaggaaccggtgatacctggctgttttcttcgggcaagggccatcggccttatgcccatgattgatcagggtgagaaagatgataagataattgcagtttgtattgatgatcctgagtaccgccacttaaccgatctcaaggagctttctccgcaccgccttaatgaaatccgtcgcttctttgaagactacaagaagaaccgaagg

SEQ ID NO: 65417 - DNA, 184 bp, Zea mays
  Clone ID: LIB3075-032-Q1-K1-C10
gttcgatccaagcgttcggtatactgttgctgttggagtcatgaagagcgtggagaagaaggacccatctggtgccaaggtgaccaaggctgtagtaaagaagaaatgatgcgtcctctcatgtgcccttgtttattttgtacttgtgcccgtatacttggatctgttaaaatctatttgttgt

SEQ ID NO: 65418 - DNA, 447 bp, Zea mays
  Clone ID: LIB3075-032-Q1-K1-C11
gcttcgcggacatgagctgggaggagttccgtgcaacccggctcggcgcagcgcataactgctgcgccacgctcgccggcgaccaccagatgcgcgccgtcgtcgccggcgtgctgccggagacgaaatactggagggaggatgggatcgtgagcccagtgaaaaaccagggccactgtggatcatgctggaccttcagcactactggtgcgcttgaggctgcatatacccaggcaactggcaagggcatactgtctttctgagcaacagctttgtgactgcggttttgcattcaacaattttcggatgtaagggggggcctttcatcccaggcctttgaatacatcaaagacaatggtggtctttgacactgtggaggtgctacccttaccaggggtcaacgggatcttggcagtcaaggcttataatgttggagtaaggtttgga

SEQ ID NO: 65419 - DNA, 337 bp, Zea mays
  Clone ID: LIB3075-032-Q1-K1-C12
cgccggtatggtgatccgcaggggttcttcgtacgccgtcgcggcacttctcgcgctcgcctctgtcgccgtcgtcgccggcgagggattcttccaggagaagttcgaagattgctgggaaagtcggtgggtcaagtcctagtggaaaaaggacgataacatggctggtgaatggaaccacacctgggggaaatggaatggagatgcagaggacaaaggtattcaaacctccgaggactacaggttctatagcatttcagctgaataccctgaattcagcaacaaggataagaccctggtgctgcagttctcttggaagcacaagcagaatcttgac

SEQ ID NO: 65420 - DNA, 342 bp, Zea mays
  Clone ID: LIB3075-032-Q1-K1-C2
aaccagcagaggctcctgttgatgcagcatcttcagcagaagacaggattgaaccaacagcaacttctccaaatccaacaacagcatccacatctcaatgtccaacagctgattaagcagcaacaatttctgaagcagtttcagcagcagcaaccgctacaatctcctcgtgttttagcatctggttcacagaaatctgcgaatcttacaggctcgcagccgggtacaccattgtcaggtggaactatgactggtggaagtggaagtcagggagctgaaggaactagccaacttcttgggaaaaggaaaatacaagatctggttgcacaggtagatcccttt

SEQ ID NO: 65421 - DNA, 336 bp, Zea mays
  Clone ID: LIB3075-032-Q1-K1-C3
gagagatacccgatcgccaccgccgaccggactcccctcaaaggcggccacagcacagcgagcatgggagaccggcatcagcatgggcctggcagcggcgtggaggacccggcgacgctgctgcggcgggtgcagacccgcgcgcccaactcgacgcaggtggtggggttcctgacgctgctcgtctctggcgccgtgctgctgctgctgacgggggtgacgctgacgggcgccgtggtggcgctcgtcttcctgggccccatcgcgctgctcaccagccccatctgggtgcccgtcgccgtcgtgatctccgccatcgtcgccgccgcgctctcc

SEQ ID NO: 65422 - DNA, 342 bp, Zea mays
  Clone ID: LIB3075-032-Q1-K1-C5
ggaggcggagatggcaccggtgtcggcgctcgccaagtacaagctcgtcttcctgggggaccagtccgtcggcaagaccagcatcatcacccgcttcatgtacgataagttcgacaacacttaccaggctacaattggtattgatttcctgtcaaagacaatgtaccttgaagatagaactgtgagactccaactctgggatacagctggtcaggaaaggttcaggagtttaattccaagctatatcagagactcttcagttgctgtcattgtattcgatgttgcaagcaggcagtctttcttaaatacatccaagtggatagatgaagttcgcactgagag

SEQ ID NO: 65423 - DNA, 357 bp, Zea mays
  Clone ID: LIB3075-032-Q1-K1-C6
gaatatctacgtagaaggatcatgggacaactggacatcaaagaaactggttgagaaatcgcggaaaagatcacaccattctattgatgctttcatctggagttcaccgttatagattcattgtagatggagaaagaagatttatacctgaccttccctgcgaaactaacaatgtgggtcagattttgaacctagtagatgtccatgacttcgttcctgacagcgtggaaagtgtatctgagctcatggcccctccctccccggactccagctacggtttccatgttcccggcgaaaaggagttctccaaggagccttctcagctgccggccccacttcttaacccccctttttttt

SEQ ID NO: 65424 - DNA, 364 bp, Zea mays
  Clone ID: LIB3075-032-Q1-K1-A7
catcgatgcgaaagcgtccgggcctggtgggttcttcgacatcaccaagttgggcgcctccggcaatggcaagacagagaggacgaaggctgtgcaggaggcatgggcatcggcgtgcggcggcactgggaagcagacaatcctcatacccaagggcgacttccttgtcggacaactcaacttcacaggcccttgcaagggcgacgtgaccatccacgtggatggcaatctgctggcgaccacggacctaagccagtacaaggaacatggtaattggatcgagattctacgcgtggataacctggtcatcaccggcaagggaaaccttgacgggcagggcccaagccgttgtttgggggggggt

SEQ ID NO: 65425 - DNA, 424 bp, Zea mays
  Clone ID: LIB3075-031-Q1-K1-F7
tcggtcgccgtcctcgggttcgcgttcgacgtgttcgcgttcgtggtcacccaccggggcgcgggcggcgccgtgtgcgggagcgggtacagggagtaccgactgggggactactccggctggctgcaggcgcggatcgccgagccggagacgtggcggcgcgtcgagagctgcctctctgaggcgcgcgtgtgcggcggccgggaattctacaggcaacacctctcgccaatccagtccggttgctgcaagccgtcgacgtggtgcaggttccggtacgtgaacgccacgttctgggaggcaccgagatcggggctgtctgcggcggcggtcaacgacggtgactgccgggcatggagcaacgaccagcaagtgctttgcttcgaatgcgacacgtgcaaagggcggcttgctggagaccgcc

SEQ ID NO: 65426 - DNA, 438 bp, Zea mays
  unsure at all n locations
  Clone ID: LIB3075-031-Q1-K1-G1
ctcgccgtcctcgtgttcgcgttcgccgtgttcgcgttcgtggtcacccaccggggcgcgggcggcgccgtgtccgggagcgggtacagggagtaccgcctcggggactactccggctggctgcaggcgcggatcgccgagccggagacgtggcggcgcgtcgagagctgcctctctgaggcgcgcgtgtgcggcggccgggaattctacaggcaacacctctcgccaatccagtccggttgctgcaagccgccgacgtggtgcaggttccggtacgtgaacgccacgttctgggaggcaccgagatcggggctgtctgcggcggcggccagcgacggtgactgccgggcatggagcaacgaccagcaggtgctttgcttcgagtgcgacacgtgcataggccgcgtgctggagaccgncaagaagaagtggaagaca

SEQ ID NO: 65427 - DNA, 243 bp, Zea mays
  Clone ID: LIB3075-031-Q1-K1-G3
tcgcttcacgtacttcaggctgcgttcgacccactagggcactggatgctgcagaccctgtgggggctcacaccggtgcgggatgcgactcatggagggcctactcgatgacgtacttcgagaggctgatggctcgactggactgacctgatacgttgcggccctgtcaaagccggctatatcaagcgctcatatgctgcaggacgctattacacggggcacacctctagtcaaatcaaggcg

SEQ ID NO: 65428 - DNA, 342 bp, Zea mays
  Clone ID: LIB3075-031-Q1-K1-G4
cacgtacaaaccgagagcacacaccgtcccccgcccgcccgccgccgcgacacgcgcgccatggccatgctggctcgctccgccgcgcacctcttcttcttccttctcctcgtctccaccgcgcccgccgtgcggaccatccccgacgaagcccgcggccccggaaacaacatccacgaggcgtgcagcaagacgctgttccccaaggtgtgcctgcacgcgctcaaggacaaccccgagtgccaggcggtggcggtcacgccgcgccggctggccgagctgctcgtgtacgtgtcggccgaggtgggcatgaccgttgccgcgttcgcgcaccacgagctc

SEQ ID NO: 65429 - DNA, 335 bp, Zea mays
  Clone ID: LIB3075-031-Q1-K1-G5
tgcaacggcctgggaggaccagtacaggctttcctgccgcgactgaaacgtctgcctcgggcgcacggaccgtgacgacaacgcgcacagactggatcaaggtcatgaactacagcagctgggtgaaggatcaggaaggctaccctgacaccttgctgggcaacaaaagctgtgtatatgatgtgaaccattgccttggccagtaacactacgggcatcagacctggcataatccatactgcttgtacaagtctgcgacgtggaccaagatccgggacgttaacgacacgttccggtacgtaacgatattcgacatcatttacgtgaacttcaat

SEQ ID NO: 65430 - DNA, 326 bp, Zea mays
  Clone ID: LIB3075-031-Q1-K1-G7
gacggcagaactgcgacgagcagtgcaggcagaacggcgagaagaaccccagggagcaggacaggcgcgacgctcggcgagatgtaccgagaactgccgctcgctctccaacatgatctgatcgatcttctttctccacggacgacaacagatagccgggcgttttgggccctcgcatcgtttggcgccgctgcttaacggtcgcatgcccatgcccgcgagcgcgctcttgcgcgacaataactgatgagttaattttggttttgctttgaccatttctataattttattttctgtatagaagcgctaaatttgggtcttggaaa

SEQ ID NO: 65431 - DNA, 448 bp, Zea mays
  Clone ID: LIB3075-031-Q1-K1-H1
gcagaactgcgacgagcagttcaggcagatcggcgagaagaaccccatggagcagttcgacgcgtcgctcgtcgagatgtccgagaactgccgctcgctctccaacatgatctgatcgatctccttctccacggacgacaacagagagccgggcgttttgggccctcgcatcgtttgtcgccgctgctaacgttcgcatgcccatgcccgcgagcgcgctctcgcgcgacaataactgatgagttaagtttgttttgctttgaccatctcacatcggtatttcctgtagagatgcgttaatttggtctcggaaacggggaggcgaattgaggtggaatatttataattcaagaaacacagttttggttctagaagaggatcgtcgatcatgctgctctactcgatctcctcttctcgttacgaatttaattaaccgttttgtatctat

SEQ ID NO: 65432 - DNA, 398 bp, Zea mays
  unsure at all n locations
  Clone ID: LIB3075-031-Q1-K1-H3
cggcgttcaaggccccggcgccgggcttcgccgtgcgcttcagccccttccacgagaaccggctcctcgccgccacgtcccagcacttcggcctcgtgggcaacggtcacctcatcgtgctcgacctcgccggcggcgggcccggggccgccccgacgccggtcttctccttcccgacctccgatgcgctcttcgactgcgcgtggtccgagtcccacgactccctctgcgccgccgtctccggggacggctccgtgcgccttttcgacgccgctcttccgccggcgcagaaccccgtgcggctcctncgggagcacgcacgggaggtgcacggcctcgactggaaccccgtccgcgggacgccttcattttcgccttctgggacgacacgctcaagc

SEQ ID NO: 65433 - DNA, 341 bp, Zea mays
  Clone ID: LIB3075-031-Q1-K1-H5
gagcagttctagcagatcggtgagtagaaccccatggagcagtttggggcgtcgctcgtcgagatgtcctagaactgccgcttgctctacaacatgatctgatcgatcttcttcttcacggacgactacagagagccgggcgttttgggccctctcatcgtttgtctgcgctgctaacgttcgcatgcccatgcccgcgagcgcgctcttgcgcgacaataactgatgagtcaaattcggcttgcttttgaccatctgacatctgttatctcctgtaagagatgcttttaatttgggctctgaaacggtgatggcgaattgacgtggaatatttattattc

SEQ ID NO: 65434 - DNA, 349 bp, Zea mays
  Clone ID: LIB3075-032-Q1-K1-A1
gagcaaccagcgatcgccccatggccgccatggctcgttccgtctccctcgtcgtggcgccccttctcctcctctccctcctcgtctccgccgcggccagtgcgcggaccgtgggcgacaccgtgcaggacgcgtgcagcaagacccagttccccaagatctgcgtggacagcctcgccgccaagccggagagccagaaggcgacgccgcgcaagctggcggagctgttcgtgaacatcgcggccgagaagggatccgggatggccaccttcgtgcaccgcaagtacagcgacaaggaggacagcgacatattcaagtgctacgacagctgctccgacgacgtggagga

SEQ ID NO: 65435 - DNA, 282 bp, Zea mays
  Clone ID: LIB3075-032-Q1-K1-A10
aggattttatattctattgggggcacagggcattgcatacgaaatggctatacaaacacgttcacagcgtccaccatgagtacgccacaccctgtggtttaacatcggaatatgcccacccagctgaaattttgttcctgggattcgccacagttgatggtcctgctcttactggccctcatctcttcaccctgtggctgtggatggtgtttaaggttttggatacagttgaatgttcacaagtggctatcaactttccatggagcccatcaaattttctgg

SEQ ID NO: 65436 - DNA, 300 bp, Zea mays
  Clone ID: LIB3075-032-Q1-K1-A11
gcgatccgcaggcgggctacacacacatacatggcggcggagggcgccggaggccggagacgagccatgcggtacccggctgtgtcggcgctcgtggtctccgccatcgcagccttctccggcgtgatcgtccttgccgtcgtccactcggcgtacgacgacgccatgtcgcggacgcggacgctgctgggccacaacctggatccgacgccgtggcacccgttcccgcacgacaagggccggccgccggcgctcgcggcgctgcggtacgcgccctccatagcctgcctgctcgcggta

SEQ ID NO: 65437 - DNA, 268 bp, Zea mays
  Clone ID: LIB3075-032-Q1-K1-A12
tcgcaaacactgaactacatatagctcagtgtttcgcttatgtacgttcatgtggttgttaatattttaccaacatactcgcatacaaaagcgaaacactgagctatatggaaaaaattataaaaaggctggtaaagcaaggcatacataccctgtgaatgtggatgctgactggtgcactgaaggtgttctaaatgactaggaagccctttgcctagatggtaccttttatgggaacgtggctaggtttatgaaccataagtgcatt

SEQ ID NO: 65438 - DNA, 370 bp, Zea mays
  Clone ID: LIB3075-032-Q1-K1-A2
gatccccccacaccttgagacctgcgttgtcacccacccatcaaggttggggccgccagcagagttcagccgttcctgttcctgataaaacgagagaaggatggcagtgtctcagggagctgtcctattcttgtttctcctcctcgtcgcagcagaggtgggaaccatcgatgccaaaatgggagtagccatgcccatgcatgccttgataatggagaaagcgaaacagcaggagaaggagaagaaggaggagaaaagcacggagaaggaagagagtcaatgcttatcgccgagtctccagttcgagggcttctgcttcaacagcgacagatgcgccgtaggttgttgccccaaaaattttttttggggt

SEQ ID NO: 65439 - DNA, 383 bp, Zea mays
  unsure at all n locations
  Clone ID: LIB3075-032-Q1-K1-A3
cggacgcgtgggtgggatctcaccgtttcttcctcgtctccgtctctacacggcggcgccgccgccgccagctgctgccaggagccaagcccaagcctgagcttaaaccatgccgattggttctcttttcgtgtcgaggctggccaggtctagccatgccctccccgctgccgccgccgcggccatctctcaggcgcccaggccccagcacatcgcatctcctatattctccggccttggagcagcggctcgtgatttcagctcaagggctctatggaagggagcattcgtcgatgccttcctggctagaataaagaagaacagagaaaacatgaatgggaagaagattntgggttccttttttccccggggggtttttttaa

SEQ ID NO: 65440 - DNA, 383 bp, Zea mays
  unsure at all n locations
  Clone ID: LIB3075-032-Q1-K1-A4
gctggaccaaagtttgagtatagatgggccgatggggtgcagatcaagaaaccaattgaggtttcagcaccaaagtatgttgagtacttgatggattggatcgaagctcagcttgatgacgaatccatcttccctcagaaactcggaaccccttttccacaaaatttcaaggaagttgtgaagacaatctttaagcgacttttccgtgtttatgctcatatttaccactcacattttcaaaagattgtcagccttaaggaggaagcacatcttaacacttgcttcaagcattttacattgttcacttgggaattcacgttgattgacaaggctgagcttgccaccncaaaacccctttttttttttttaaaaaattttttttt

SEQ ID NO: 65441 - DNA, 277 bp, Zea mays
  Clone ID: LIB3075-031-Q1-K1-F4
cgtcactcactgcatcgttcgttcatccatcaactactggaaattagagagccggatctcttggtcggagaacctgcgaggaaggactaaggagtcgaagatgactgcggcggtgctgtccgtgcgcacgacgacgacgtcgctgctagcagcagtcatcctgtgcctctgcatcgtctccctctccccccgcggcgccgctgccgcgcgggtctcccccggcgccagcccgatcgtggccacctgcatgacgggcccgtacccggagctgtgcgtg

SEQ ID NO: 65442 - DNA, 63 bp, Zea mays
  Clone ID: LIB3075-032-Q1-K1-A5
cggacgcgtgggcataaactaaataaattatttaaaaatatcaacccaggacagcagggcatc

SEQ ID NO: 65443 - DNA, 380 bp, Zea mays
  Clone ID: LIB3075-032-Q1-K1-A6
atttgaaacagttaagaattcatatataagagtgcatatatatatatataattctgccaagacaaaggtaatggagtcgtcacgcatgttccagccggccatcatcctgcttctcctgctcattgtgaccaccgatgtggcgcaggcggcgagggaatgcgagaaggacagcgagcgattccttggggcatgcatggcgtcggacaactgcgccaacgtgtgccgcggtgagggcttctccggcggcaggtgcagcaccttccgccgccgctgcatctgcactaagccgtgctaaattaacctactcccggcagttcgatggtggacgtttattctattttatttttttgggggggggggcccccccctttttttttttt

SEQ ID NO: 65444 - DNA, 238 bp, Zea mays
  Clone ID: LIB3075-031-Q1-K1-B4
cggacgcgtgggcggacgcgtgggcggacgcgtgggtttttttttttttttttttttggggtttttttttttttttttttatattttcctttttttgtgttaaattaatccgaaggctccaggcctgggggaaccctatcgctaattcccttaacggtagtctccgctaccatacattccatgaaacccaaagactttgatctctcataaagggccaccgaggtcctattagttacac

SEQ ID NO: 65445 - DNA, 401 bp, Zea mays
  Clone ID: LIB3075-031-Q1-K1-B5
ctcagatgttcttattttcaactcagggcattggtggactgccagcaaattatttgacatgggttgctattttgaggctggaggtgtgcttaaactgggaacatccattaacgctgctttcaaaatggcattggaaacttgggcttcatgggtgaaagagagaattgatttaaggcgaacacatgtattcttccgtacatatgaaccgtctcattggagtggcttaaatcaaaaggtgtgtgaagtaacacaacaacctaccgctgaggccaatggaaatgacaggagagaatttggggatatacttgctggtgttgtggcaaatatgaatggtcctgtcacaagactaaatgtgactttgatggggcccttttaagtggtgcttatattggactttggag

SEQ ID NO: 65446 - DNA, 331 bp, Zea mays
  Clone ID: LIB3075-031-Q1-K1-C1
gcggcactcgctcgtttgcccattgccctgccgtgtcgacgcagattgatccggtccgagccatcaccgtggcgtagcccagctccgtcttgtcgtcgtgggcgcgttcatggcggtccgaactatcaaggtgaccaacgtgcctctctcggcgaccgcggagaacatgaaggagttcttctccttctccggcgagatcgagtacgtcgagatgcgaatggactcggagacgtttcaggttgcttatgtcaccttcaaggagtttcatggagccgatacagctctgctgctctttggatcaagcatgtggtggcaatgtttccgtgaacat

SEQ ID NO: 65447 - DNA, 316 bp, Zea mays
  Clone ID: LIB3075-031-Q1-K1-C2
gttcgttcctcaagtgatcttaatcgtcgagaagttaccagctagcggagatcatcgggggtgtcgaacatggggcaatccttccaggccggcaaggcgcaggcccagggcgagtgccaggcggagcgcgcagcgcagtgcgttagggacggcgccggcgccaccgcctgcgccgtgaccgacaccgtcggagccgcggccgacagcgcgcagctgcaggagcaccgcgccgccggcaccgttcagcaggctgctgagcaggtggcgcagacggcggcgggcgcggtggcagccgtcaaggacacggtggcgggcg

SEQ ID NO: 65448 - DNA, 63 bp, Zea mays
  Clone ID: LIB3075-031-Q1-K1-C3
cacttgccgaaagggttacatcagcacaaaataatctcagactataattggtaattgtgggat

SEQ ID NO: 65449 - DNA, 352 bp, Zea mays
  Clone ID: LIB3075-031-Q1-K1-D1
ctcctgaccatttgccaaaccctacccatacccgcgtcgccgccgtcgccatgccgtccgagctcgacccgtcgcaggtggtggaggtcttcgtccgggtgacgggcggctaggtcggcgcggcgtcgtccctggcgcccaagatcggcccgctcgggctctccccgaagaagatcggctaggacatcgccaaggagacggccaaggactggaacggcctgcgcgtcaccgtcaagctcaccgtccagaaccggcaggtcaaggactccgtcgtgccttccgccgccgcgctcgtcatcaaggcgctcaacgagcccgacagggaccggatgaaggtcaagaacatcatgca

SEQ ID NO: 65450 - DNA, 375 bp, Zea mays
  Clone ID: LIB3075-031-Q1-K1-D2
gcaaggtggtttaatcacattgatgcgctcgtgaggctgagcggaattactgcagagggccaaggtgtgaaggttgaatcctcagcagttccttcagccccaactccagatgttgctgaagcacaggccccagctgctgaggaggaggacgatgatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatggccaagcttgaggaagctgttaggagtgtccagatgggaaggctgctctggggcgcattcaagctttgt

SEQ ID NO: 65451 - DNA, 434 bp, Zea mays
  Clone ID: LIB3075-031-Q1-K1-D3
cgaccccgagattgctgacatcatcgagcacgagaaggcccgccaatggaagggtctggagctcatcccgtcggagaatttcacgtcggtgtcagtgatgcaggcagtgggttccgtcatgaccaacaagtacagcgaggggtaccctggcgcaagatactacgggggaaatgagtttattgatatggcagagtccttgtgtcagaaacgtgctttggaggctttccgtttggacccggcgaaatggggagtgaatgtgcaacctctatccggttcgcccgtcaacttccatgtatacactgcactcttgaagccacatgataggatcatggctttggatctttctcacggtggacatctttctcatggtttccagactgacactaagaagatatctgcaactcaatattttttgagacaatgccttacagatt

SEQ ID NO: 65452 - DNA, 430 bp, Zea mays
  Clone ID: LIB3075-031-Q1-K1-D4
ggaccagaagaaaccagaggcgactccaggttcgtgggcgatgctgcgcgcgggaggtaggcagctccttgccccggggctccggcggctcggtctgggcaccggcgccgccggtgaggtgggcccggccgccgcggcggcggggatgagggcgtaccacgagcgggtggtggaccactacaacaacccgcggaacgtcggttccttcgacaaggaggaccccaacgtcggtactgggctggtcggcgcgccggcctgcggcgacgtcatgaagttgcagatccgcgtcgacgaggactccggtaaaatcgtcgacgcctgcttcaagacctatggctgcggcttcgccatagcgtcctcgtccgtcgctactgaatgggtgaggggataaccaatggatgaaggtctgacaatcaagaatactgagatt

SEQ ID NO: 65453 - DNA, 405 bp, Zea mays
  Clone ID: LIB3075-031-Q1-K1-D5
cggacgcgtgggctcgtctcaccctccctccctcacacaaataataaggaaaggtcccggccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaga

SEQ ID NO: 65454 - DNA, 302 bp, Zea mays
  Clone ID: LIB3075-031-Q1-K1-D8
tcggacgacaagatggcgtgcacaaacaatgcgatgagagccttggttcttctggtcctcttgtgcatcgtgcatggtgagaaggaagagtcaaagggcatcgatgcgaaagcgtccatgcctggtgggtccttctacatcaccaagttgtgcgccttcggcaatggcaagacatacagcactaaagctgtgcatgaggcatgggcatctgcgtgcggcggcactgggaagcagacaattctcatacccaagggtgactttcttgtcggacaactcaacttcacaagcccttgcaagggcga

SEQ ID NO: 65455 - DNA, 404 bp, Zea mays
  unsure at all n locations
  Clone ID: LIB3075-031-Q1-K1-E2
cacgacaagatggcgtgcacaaacaatgcgatgagagccttgttcctcctggtcctcttctgcatcgtgcatggtgagaaggaagagtcaaagggcatcgatgcgaaagcgtccaggcctggtgggtccttcgacatcaccaagttgggcgcctccggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatncaggtggattgcaatctgctggcgaccacggacctaagccagtacaaggaccatggtaattggatcgagattctacgtgtggataacctggtcat

SEQ ID NO: 65456 - DNA, 376 bp, Zea mays
  Clone ID: LIB3075-031-Q1-K1-E3
cggacgcgtgggcggacgcgtgggcggacgcgtgggcggacgcgtgggcgagaacatccggaaggttggcgaggcagagaaaaaccttggtgcaggtgatgtcaatgtctatgcacagatgattgatgatgctgagggcctggacaagattgagaacctgcagagccatgacaacaccgagatatatgagaaggctgtgaagatgctggaatcctactggctggaggaggaagatgatgccatgccctcaggcgacaatccccagaatggcttcaactttgggaaccagccctctgtttcatcatgtggattcaactttggctgaagatgcccatttggaatggccgctgtgccattatgccttggctagtgctct

SEQ ID NO: 65457 - DNA, 360 bp, Zea mays
  Clone ID: LIB3075-031-Q1-K1-E4
accgaccattcattcgcaaggccatcaacaatgtgttctaccggttcatctttgaaacgcagcgccacaatggcataggggagctccttgagatccttggaagcatcattaatggctttgccttgccaatgaaggaggagcacaagctattccttgcccgtgctctcatccccctgcataagcccaaatctgttgcgatctaccatcagcagctgtcctattgtattgttcagttcgttgagaaggactacaaattagcagatactgcgattaggggtctgctcaaatactggccagtcacaaactgtcagaaagaggtgttgtttctgggggagcttgaagaagtgctcgaggcaacac

SEQ ID NO: 65458 - DNA, 309 bp, Zea mays
  Clone ID: LIB3075-031-Q1-K1-E5
tcgcacgacaagatggcgtgcacaaacaatgcgatgagagccttgttcctcctggtcctctggtgcatcgtgcatggcgagaaggaagagtcaaagggcatcgatgcgaaagcgttcaggcctggtgggtcctttgacatcaccaagttgggcgccttcggcaatggcaagacagacagcacgaaggctgtgcatgaggcatgggcatcggcgtgcggagtcactgggaagcagacaatcctcatacccaagggtgacttccttgtcggacaacttaacttcacaggcccttgcaagggcgacttgacc

SEQ ID NO: 65459 - DNA, 411 bp, Zea mays
  Clone ID: LIB3075-031-Q1-K1-B3
ctctggggcagtgtcgtcatatccgtccttttctgggggtttgcaaatcagattactacagttgaagaggccaaagagttctacccgctgtttggccttggtgccaatgtggccctcatcttctctgggcgcacggtgaaatatttctcaaacatgaggaagaatttgggtcctggagtggatggttgggcaatttcgttgaaggccatgatgagcatagtggttgtactgggtcttgtcatcaccggtatctattggggagtgaacaagtttgttattgataactcatctgtgcccgtggttgagcggaataagaatgactagccaaagctcaacatgggtgaaagcatgaaaggtcttgtgtcatctcggtatgtgagggattttgcttcattggttggtgcttatgga

SEQ ID NO: 65460 - DNA, 224 bp, Zea mays
  Clone ID: LIB3075-031-Q1-K1-F2
tcgagaccctccccaccgtctacttatcctaccacaagcagggatcccaccatgccgcgtcggggtggtgagccatcgtcgtcgcagtcccagctgcagtttacatgctccatgaccaggaggctcatgctgcagagatggagcgcaccttcattgccatcaagcctgatggtgtccaaagaggcctgatttctgagattatgagcccatttgagagaaaaggc

SEQ ID NO: 65461 - DNA, 364 bp, Zea mays
  Clone ID: LIB3075-031-Q1-K1-F3
aagaaagcttctgtctttttcaagactaatgctgatgggaacacaacatgtgccaaggaaatgacaaagctctctggcatctctgaaatcatccccgagatggagatctgcgattttgactttgaaccctgtggctactccatgaatgccatccatggctctgcattcttcacaatccatgtgacgcccgaggacggtttcagctatgccagttatgacgttatgggcttggatgccactgctctgtcttatggtgaccttgtcaagagggtccttcggtgctttggcccctcggagttatccgttgccgggaccatctgtggggggcgtagccatgccgggacatggggaaaggcacttggtg

SEQ ID NO: 65462 - DNA, 148 bp, Zea mays
  Clone ID: LIB3075-030-Q1-K1-F4
atcaaatgcgtgcggcaaacgcatggaatgtgcttgcctagctagctaattgttgtttttttttttctttacttttcttcatacctgtctctctctctcggttgtttaatttttcttcatgcatgtaatataatgtgatatacccaat

SEQ ID NO: 65463 - DNA, 419 bp, Zea mays
  Clone ID: LIB3075-030-Q1-K1-F5
cgtcagcatccgtcgcattggccgagggtacctcctgccaaaaagaagaaaaaaaaagggttcacatgcgatgctgccgagaccggagagcacagtacacgacgggcactgacggcgcatcgggattgaagcagtcctccactaccactgccactccagatctgcccaaaacaccctgacggacggagggtatcttttcaacaagtgcaaggcgcctcgtgctaattccaaggtgtttttaggtcctcatgttggccatgaccgatgcatcgcgcgggtcgcctgcgagtgcgctttgcgttgatccaatcacaagcagcggggacaatcatgcatgcccccggccccgtcgtcccttcttttgaaaatctggccaaatcttgatcatgcttttcgcaaataatggtcggtggaatctt

SEQ ID NO: 65464 - DNA, 356 bp, Zea mays
  Clone ID: LIB3075-030-Q1-K1-F7
atcgatcattgtacagtattttgtgcgtagttgccttctgtcatcttcagggagtagtgcatcgagatttgaagccagagaattttctcttcacaacatgagatgaaagcgctcctatgaagttgattgactttggtctgtcatattttattagaccagatgaaaggctcaatgattttggtggaagtgcttattatgttgctccagaggttctacacagatcatacagtatggaagcagacattttggagtataagagttataacatacattctgttctgaggcattctggccattttggcaaggacataatttgggttcttccgggtcgtattgaggtctttttccaattttga

SEQ ID NO: 65465 - DNA, 376 bp, Zea mays
  Clone ID: LIB3075-030-Q1-K1-G1
cggacgcgtgggatcgagattctacgcgtggataacctggtcatcaccggcaagggaaaccttgacgggcagggcccagccgtgtggagcaagaactcctgcaccaagaagtatgactgcaagatccttcccaactcgctggtgatggacttcgtgaacaacggggaggtgtccggggtcacgctgctcaactccaagttcttccacatgaacatgtaccagtgcaagaacatgctgatcaaggacgtgaccgtgacggcgcccggggacagccccaacacggatggcatccacatgggcgactcatgcgggatcaccattaccaacaccggcattggcgttggcgacgactgcattttcatcggccctgggacct

SEQ ID NO: 65466 - DNA, 277 bp, Zea mays
  Clone ID: LIB3075-030-Q1-K1-G11
ctctttctcaacactacccggtttgcttgttagcacaaacagagcgatcgattgcagcaatggcgggcaaggtgggcctcctcctccgactcatcatggtcgccagtcgcctggctgccatcgccacagtagcgctcgcggaggaagccgatccgcgggcactgccggcacagtggaccacctggaagaagtacaaggccacgatggacgccaagacgcggcatgctttcgacggcgtggagggcgccgatacggcagataagcgggcccaggcggt

SEQ ID NO: 65467 - DNA, 392 bp, Zea mays
  Clone ID: LIB3075-030-Q1-K1-G2
catcgatctccccccagcggcgaggagagccggcggccacaggaaggagaaatggcttccgcacacaacgctctccgggtgtttttcatcctagccgtggtatgtgccgtatgcacagcgaaaaggacaggagccaacaaggaagaatcggcggcagcccccggtggcgctgctggaggcagcggcgggacgttcgacatctccaagctcggcgcgaccagcgacggcaagacggactgcacaaaggcaggccaggacgcgtggacgtcagcgtgcgaagcgaccggaagcgccacggtggtgatccccaagggcgactacctggtcgggcctctcaacttcacttggccatgccaggggagcaacaatcgcattcaactggatgggaacct

SEQ ID NO: 65468 - DNA, 384 bp, Zea mays
  Clone ID: LIB3075-030-Q1-K1-G4
cgtgggcgaaaccatcctgtttggcgacagtgaccccacctccagcaagcccaagttcggctcgtactggatcaaggacggcaaggtcttgggcgccttcctggagggcgggtcaccggacgagaacaaggccattgccaaggtggcgaaaacccagccgccggtcgctaacctcgaggagctcaagaaggatggcctccagttcgccagcaagatctgagacgctcccgttccatgtaaatttccgtgtcatcgtgaaggttcttctggagctctggtcatgattgagaaatgttctgcttgctacagatattatactacatacgtgactacgtgatatattctgttttcttgatgggatatctgtacgtgggtacacttaca

SEQ ID NO: 65469 - DNA, 399 bp, Zea mays
  Clone ID: LIB3075-030-Q1-K1-G5
ccacgcgtccgcggacgcgtgggacgtggccaaccatcaattcaatatggtggtggtcttcttgcaggacctgtgcattctgttgggcctcaagtacctcgcagcggctctgattctgatagatggcagcaaaagggtctcatgccttcccctgtcacacccatgcaaacaatgcacaaagcagagaggaagtatgttgttgggaaagtttctgatgaggaggaggcgaaacagaggcagttgaaaggcattcttaacaagctgactccacaaaactttgaaaaactgtttgaacaagttaaggaagtcaacattgacagtgtagcaactcttactggggtcatttcacaaatatttgacaaagctttgatggaaccaactttttgggaaatgtatgct

SEQ ID NO: 65470 - DNA, 362 bp, Zea mays
  Clone ID: LIB3075-030-Q1-K1-H2
agcgtgcaaagacacctgctatggagatctaaggctacagttgtgggaaaagaaatacgatggtagcaagggagagatgatactcgacgccacaagcaacatggcagcactagaagttggcggaggcccctggttcaatgggtggaaagggacaactgttgtgaacgaggttgtaaataacattgtgggcacgccagtcgatgtagagagcctcctcccaatcccatttcttaagcccccaggcctataggatcaccaacgaatgtcacaatgaagaagtatcacggatatcaatgttgatcatacaagaaaactgtgcccaggtcaataataattcatgatttttacttgttttttactac

SEQ ID NO: 65471 - DNA, 386 bp, Zea mays
  Clone ID: LIB3075-030-Q1-K1-H3
cttcagtgacttcaagatgattgacatcaatggatatgcatgctttctgacgagaactggctacaccggcgaagatggtttggagatctctgttccgtcagagaatgcagtggatcttgcagaggccatcctagagagatcggaaggcaaggtgcggctgaccggcttgggcgcccgtgacagtctccgactggaggcaggcctgtgcctgtacggcaacgacatggagcagcacatcacgccggtggaagccggcctctcatgggcgatcggcaagaggaggagggcagaaggcggtttcctgggcgcagacgtgatcctgaagcagcttcaagaagggccaaagatcaagcgcgggggcatggtcacgcaaggggccgccgcgc

SEQ ID NO: 65472 - DNA, 326 bp, Zea mays
  Clone ID: LIB3075-030-Q1-K1-H5
cggacgcgtgggctgggtgtatcttgcttgttgcttgatgccctgggaagcatttgatcctttgcgaaagcgctggatgaggctaccgagaatgccatgcgacgagtgcttctcctgtgcagacaaggaatcacttgccgtcggaacacagttgcttgtcttaggtcgtgaatatactggccttgctatttggatgtacaacttactgactcgcagttggttcccatgcacttcaatgaatctgccccgcttcctttttgtctcgggaagcttaagtgagattgctattgttgctggtggatgtgataagaatggaccagtgctga

SEQ ID NO: 65473 - DNA, 338 bp, Zea mays
  Clone ID: LIB3075-030-Q1-K1-H6
cccacgcgtccgttctaattctttgggcccgagaaatgcaagccgtgggggagccgttaccgccgccagcctctcctgcccccgttttcgttgccgtttcttcattagcgcgaacaaagttttgtgccggtctatcggccgccgctttcctcccctattcatcaagactgcaataactgtcgctacctatgcttctcacctgtgatttttggacacaatatgttaaggtccattcaattctaatgagacgcctgatgaggctactagcaaacaacaccatgtgttcggattgtcattggttattgatgtcttgtgaatgaataatataaatttttttt

SEQ ID NO: 65474 - DNA, 450 bp, Zea mays
  Clone ID: LIB3075-031-Q1-K1-A1
gcaaaaggaacataaggatagaggagagaaataaacaatggggaagggagatgtggctaccaggtcaaaatctcaaaaatcaccagcaatacagaatgagcagagtacacctgctaacccgcccacagcatatcctgattggtctcagttccaggcatactataatgctgctgggacagctccagtgaccccacctttttttcatccatctgtagctccaagccatcaggggcacccatatatgtggggtccacagatgatgtctccttatgggacaccaccaccatatgcagcaatgtatgcacaaggttcaccatattaacaggcaccaatgccaccgggttcacacccatacaggccttaacctatgcagttaccaaacgggacagttcaaacttcaacatttggtgcttgtgggacagcgacagattaattaaattaaaaataagc

SEQ ID NO: 65475 - DNA, 443 bp, Zea mays
  Clone ID: LIB3075-031-Q1-K1-A2
gccagatcctccacagcggccacgagtacggcgagagcgtgttcaggagctacgacgactggaacgccaccgccagggaggccgtcttctggtggggcaaggaggaggccatctacgacaaggacaaggagaagtgcaagtacggcaaggtcttcaaggagtgcggccacttcgcgctcatggtcggcaagaggagcaccaaggtcggctgcgcacgagccgagtgcttcaagggcggcgtcttcatcacctgcaactactatgcaacggacctggacaagaacaagaacaaaacaccaaacgataactgactctatccacccatctgttcgtttctatgtacgtacgtacgtagtagcgctgacttatttactgagtgatgattggattgttaattaactactactgaagcaattgcctgattccgaggttggagatgatga

SEQ ID NO: 65476 - DNA, 447 bp, Zea mays
  Clone ID: LIB3075-031-Q1-K1-A4
ggtagatgcatatgataaggagcgatttgctgaatcaaagaaggagctcgatgctctcctgtctgatgattctttggccaatgttccatttctcatccttggcaacaagattgatatcccatatgctgcctctgaagaggagctacggtatcacctaggccttagcaacttcacaaccgggaagggcaaggtcaaccttggcgactccaatgtccgtccacttgaggtcttcatgtgcagtgttgttcgcaagatgggctacggtgatggtttcaagtgggtctcccagtacatcaagtatggccctcgccgaagcgcatgctcagcccggcgaatttttttgccttgttcgttccggttgttccgtgacgagaacgaacgatggtcgctaggaaaagatcatggagggtatgaagaggaaaaacagtgcttaacattgttgaacat

SEQ ID NO: 65477 - DNA, 362 bp, Zea mays
  Clone ID: LIB3075-031-Q1-K1-A6
ctacaagatggcgtgcacaaacaatgcgatgagagccttgttcctcctggacctcttggggatcgagcatggtgagaaggaagagtcaaagggcatccatgcgaaagcgttcgggcctggtgggtccttctacatcaccaagctgggcgcctccggaaatggcaagacagacagcaccaaggctgtgcaggaggcatgggcatactcgtgcggcggtactggtaagcagacaatcctcatacccaagggcgacttccttgtcggacaactcatctttacaggcccttgcaagggcgacgtgaccatccagctggattgcaatctcgatgcgaccacggttcttaactcagtcaatggaccat

SEQ ID NO: 65478 - DNA, 371 bp, Zea mays
  unsure at all n locations
  Clone ID: LIB3075-031-Q1-K1-B2
cacatgctggtggtggccaaccaaactatttgccccaaatgcaaaacccacagacgggctacaaccctggcggtgctcctcactaccagcaaggtgctgctcctggctaccaaggtggacctccggggtatcaaggtggttaccaagggaacccaggccctgcctaccaaggtggtaacactggttatcaaggtggcaacccaccacctccctaccaaggaagcaacccaccacctccttaccagggaggcagcccaccagggccaccacctccctaccgaggaggcagcccaccagggccaccacctncctaccgaggaggcaaccccaacgtaccgtcatattcgggtggtggcaatcctggctaccct

SEQ ID NO: 65479 - DNA, 376 bp, Zea mays
  Clone ID: LIB3075-030-Q1-K1-F3
gggtgcttaaaaaaactatttcatgtctaagcatgaaagagaaaaaaaaacgaatgtgatagttttagcataaaccataagaagacatgtatcaataccagtggatcatgtcttccacgacacaaataattaaccaaaaaaagggaattttcttgcaaagggtaaaagaaccctctattcccttcaagcaagggtcgcttctgcactcttcccaccctcaccaccattagcagaagatacattgttggcctctgcctcagcaactgcatccatttcctctgcaatggcgtcaacttctccaagcgggcgaacctgcttctcctctggaagtggcttcacaaatccgtcaacaaaacaagtgccccaataaatacct

SEQ ID NO: 65480 - DNA, 381 bp, Zea mays
  Clone ID: LIB3075-030-Q1-K1-D6
tcgcattatgtgctccgtgaatgatgacactactgaatttgagaaataccttgttgaggatcagaccttggatgggtccccgatatctagctccacaggtttcagctcattccttgatgaggttagaagtaaagtggctgagcatggcatttgaggaccagtgtcacctgtctcccgattgctgaactgtgatgataaacgggtgatgactgatgacccatgcaacccagaaatactgtcatgaatagaaagagtaagtgctttgctggtttaccggcatacgtttttgtatgtgtgctgtgtgttcgaatgatgcttgtcgccattttttaccgacagctagatgaattttaaagcttttcttttacaaaaaaataaaaa

SEQ ID NO: 65481 - DNA, 387 bp, Zea mays
  Clone ID: LIB3075-030-Q1-K1-D8
aaaagagatttaacatgaggttggcaccagaagaggagtcacacaagcttactgggtttgtgcataacgctgtcacttgcatcgggatggaaacaaacataccggtcatcatagatgaagctatcaccaaattggatgaggatttcttctggttgggtggcggagaatttgacctcaagctcggaatgcgaacctcacaattcttaagtgtctttagtccattcgtggtgaaatgcagctgatgatagccgtgcagcctaaaagaagcttctgattcatttatttctaccgagcctccatgcatccatcacatggaggtacaccacaatactattgggttttgcttggatctggtggtgggattgtatttttttattggacaggctt

SEQ ID NO: 65482 - DNA, 362 bp, Zea mays
  Clone ID: LIB3075-030-Q1-K1-D9
ggagctggacggcattgagcggtaccgggataaggagaggagggataggcataggagggaggagaaggatcacaatggcaggggaagaagggacagggagaaagagaaggacgaccggagaagggacaaggatgatggcaagcatagggatagagatagagatagggagagagacagggataaggatagcaagtacagagaccgggataaggagccagaacgtgaacgtaaccgtgaccgtgaccgtgaccggggcaaagatcgggagcgggaaccacatcggcagcgtgacaaggaccgtatcataaatcgtgataaggaagcagatcgtgataaggaaagggaagcggagggacaaggga

SEQ ID NO: 65483 - DNA, 391 bp, Zea mays
  Clone ID: LIB3075-030-Q1-K1-E1
acgaaacaagcgcacaagaacaaatacctcgccgccaacaatggctccatgtcctccatcctgctcgcaacggcgatgctggttgtgatgtttgcggttggtttgtgcaccaccccgctcaccttccaggttggcaagggatccaagcctggccacctgatcctcacccccaatgttgcaaccatatccaatgtggagatcaaagagcacggtggcaatgacttctcctttacgctcaaggagggaccgaccggcacctggacgctcgacaccaaggccttgctcaaataccccctttgcatctgctttgctgtcaagtctggtggctactgcatcgccgacgatgtcatccccgccgattttaagggcgggaccaccttcaaaaacacac

SEQ ID NO: 65484 - DNA, 361 bp, Zea mays
  Clone ID: LIB3075-030-Q1-K1-E10
tcgcggacgcgtgggcggacgcgtgttttgtgtttctaatcagagcttttctcctgaatatgagcatggaaatgacatttctcctaagaatcatgttgggactaatacgatgatggggttacggaatggcttatttacttgtttgatcggtgctgctattagtgcaaattttacattgtcaaatacaaatatttgctatggtcttattggcgaagaaattttaccagaactagattcttcaaactcctttataaaaattatttcatcttcattaatgtcaatattggactcgttttctactctacaaaggatgtctgtgtcaactggttagcgtaatatttggcattcagttaaaatattt

SEQ ID NO: 65485 - DNA, 446 bp, Zea mays
  Clone ID: LIB3075-030-Q1-K1-E11
cgttttgaagccaccaggtgcttggcgaactgcatcacgcgcagccgcctccggtgggctcccttccgcggcgccggcgggctcccatcctcggcgcctgaagctatatatctgctcggcgtccatggtcacaggattatatggttgtccatgtcctcgcgccgaagcaagtgatgatttagattaaagaaatgtagaacctgggacatgctctcttcagtttgcacatggtcacaagatttgcaacacatatatagtttgcacattctgcctgctcacatggactcagaagcaacaatacatcatcaacatcgtgtctgcaggactgcacattagcattcatcccgttggctgttagattggcttcagcaacgtgatttttatactttctctatatcctggctttacagttttttttaaaaattccatactctatattttctttc

SEQ ID NO: 65486 - DNA, 261 bp, Zea mays
  Clone ID: LIB3075-030-Q1-K1-E12
acgaaggatgcaaaccagcgctggtttgtgcctttacatttagagctggtgctttggatcaggggaagcaaaatgcagcgaaggccaagattcccttttacggaagttacatggaatctgatccagtgaaaattgctgttgagggtgtggagaggttcaagaaagaaaactgtgatctcatcattgtggatacaaggggaaggcacaaacaagaagcagcactctttgaataaaaggcggaagttgtggaagcaacaaaac

SEQ ID NO: 65487 - DNA, 447 bp, Zea mays
  Clone ID: LIB3075-030-Q1-K1-E3
cgagaaccccgagaagagcatcgacaccatccacatcgacggctacgccttcttcgccggcggcatgggccccggcaaatggacgccagcgtcccggagcacgtacaacctcctggacacggtgagccggcacacgatccaggtgtaccctatgtcgtggacggcggtgatgatgacgttcgacaacgcgggcatgtggagcatccggtccaacatctgggagaggcagtacctcggcgagcagctgtacgtgagcgtcatctcgccggagcggtcgctcatggacgaagacaacatgccggagaccagccttctctgcggcaaggtcgtcggactgccaatgccggcgggctaccctttcgtctagagcatgcatcttgggttgccctttctttctttcatcacacgggcgcacgggggctggatacacaatttaaaaggaacgtg

SEQ ID NO: 65488 - DNA, 325 bp, Zea mays
  Clone ID: LIB3075-030-Q1-K1-E4
atcaaggccttcggcaagtacaagtctgactacgtgaaggaccccatcccgagggacgtgtgggagaagatctacacctggctcgccaagcccggggccggggtcatgatcatggacccctacggcgccaggatcagctccatcccgcaggatgcgacgccgtttccgcaccggcagggcgtgctgttcaacatccagtacgtcagctactggttcggcgagggcgacggggcggcgccgactcagtggagcaaggacatgtacgcgttcatggagccgtacgttagcaagaaccctaagcaggcgtacgccaactacagggacc

SEQ ID NO: 65489 - DNA, 305 bp, Zea mays
  Clone ID: LIB3075-030-Q1-K1-E5
cgattctgtctccctcaggtcgagattcgatagttcccgtgttcgaccatccgcgctgtgaggttctccgatggccgagaagtcacccagctccgcgccgtagggtggttctggtgggaatgaatcattcgataatcttgtaattcaagctccacagcttatgagggaggattacatacagaatgctgtgaagcttctttcacatccgaaagtgaagggttcttcagtttttcacaggcgtttctttctggaaaagaaaggccttacaagggaagaaattgatgaggccttttgttaacatcttg

SEQ ID NO: 65490 - DNA, 367 bp, Zea mays
  Clone ID: LIB3075-030-Q1-K1-E6
gcgcgacagaatacatttcagatgtagtagtgttaggcactgtatgacagcatgagtgctgcgggttaatgctaataatacagggttaactgaacaaaatggatgatgaaacactaactagctcattcgcctcactcagctccataataatataaggtatctaatgattatcagactactagtacagaggtggaattgagaaattaatttcaggtttcacctatcaagggcttgttcggttagctctcaatccatgtggattgagtgggattggataggttttaatcccaaataagatacttgttctgaattttttgcaattccatgcaatccatgtgtattgggaataaccgaacaagccccaata

SEQ ID NO: 65491 - DNA, 248 bp, Zea mays
  Clone ID: LIB3075-030-Q1-K1-E7
tcgaacaccaacaatcggggggagaacgagaatgccatcaaacgccgtggagaagcggacgcacgcaagatggagaggattccgaaacctaaggaaggcgagggtgtgaaacgtctgaagctggaaacaggagcgggagcagcaattagggtcttggaccatgccatggatatcaacggaccaaggggccgctgcctaccaaggaaggcgacatgagattggcagctaggacagacggaactatatac

SEQ ID NO: 65492 - DNA, 400 bp, Zea mays
  Clone ID: LIB3075-030-Q1-K1-E8
ctcatctctgcgcgcgtgatggacgcccgtctccgcctcggcttcttcctcctcctcgtggccgcggcgttcgcgccgctggtctccgcgcagctctctgcagatttctacaagacgtcgtgccccgacgccgagaacatcatcttgggcgtcggcgagaagcggttcaaggcggaccccggcaccgccgccggcctcctccgcctcgtcttccacgactgcttcgcaaacggctgcgacgcgtccatcttgatcgaccccatgtcgaaccaggcctccgagaaggaggcgggccccaacatcttcgtcaagggctacgacgtgatcgaggagatcaagacggagctggagaaggaatgccccaactgggggtcgggcgcggacatcatcttggtgagcg

SEQ ID NO: 65493 - DNA, 400 bp, Zea mays
  Clone ID: LIB3075-030-Q1-K1-F1
atccaaaaagagagagtggaaaagatggcgcggttgatcacagtggtgtggtgcgcggtggcggtgctattatgcgccgcggccggtgcgtcgtgggtggaggaggcggcgaacccgatacgaatggtgtctggcgtggaggcggaggtggttcgggtgatcggggagtgccggcgtgcgttgaagtttgctaggttcgtgagcaggttcgggaagagttaccaaagcgaggaagagatgaaggagaggtacgagatattctcgcagaatctcatgttcatccgctcccacaacaagaagcggttgccctatactctttttgttaatcattttgctgattggacttgggaggagttcaaaaaacacaagacttggaactgcccaaaattggtctggcact

SEQ ID NO: 65494 - DNA, 302 bp, Zea mays
  Clone ID: LIB3075-030-Q1-K1-F12
ggatctactgcgcatacaacatatcggtgatgtgattgatattttgcaaacaaccacacagcatctatatgacccggatgaactcctgacattcgcgtttgacaagatcggttcaatgccaacaaatacaatcacaaaggaaaggaaaaagcaggagactgttgtcctggctgagctagatcaaagaacaagacggctgagatcactcaagatggatggatagggtggaaaatacaagttcttgaaagctgtagtcttggcctattcgggacctgggaccacaacgtatgcttcaacgaccg

SEQ ID NO: 65495 - DNA, 442 bp, Zea mays
  Clone ID: LIB3075-030-Q1-K1-D5
cctcgaccatccctgcaaattaccgcgatggctcccaagatcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgtcattcttcccacgctgctcttcgtcaccgacaagaaactcggcgtcctcaactacaccaagggcgacgaccggcaaatgtactttggggcttccggggccccct

SEQ ID NO: 65496 - DNA, 286 bp, Zea mays
  Clone ID: LIB3075-030-Q1-K1-F2
cttgtgtaactgaaccagaggattgctagcgtcttggatcgaaggggattatcgaaggggattgaaggagattaccttctattcaattttgattagggagggatttaattctctcaaatcctcttcgatcgagacgtaatcaagtaagccttaagatgtgtaggctgtggcttcttgtgtaactgaaccagaggattgctagcgtctgaatttttcgttgttcggagtagtaagtttacagtcaaaaaatataaaatgtaattgttataattttcttttttgttta

SEQ ID NO: 65497 - DNA, 468 bp, Zea mays
  Clone ID: LIB3075-030-Q1-K1-B7
ggactgatgagcagttggatgatctgtttttcagtcttttaggacatgtttggatgcagccctggcctggaccgcctgctggcttatgcagctttcccgtgccgccatccaaacatgcccgcccttattttgtcgtcgtaccaatatttcgatgtgattctgcatccgcatctgccagagtgctgttgcaacgttgcatcctatcctggaaggctggaatgtttatttggtgctcggcatctctctgaactttatgtttccccggcgtaccatgctagtgtttttcaatggagccattattgcacttcgctgtgctaatacgtgccttaattactgttactcgttatttgctattcggatggttcatgtaacaaatgtggattgagcaatctgggggtttcaatcaaaatccaaccgtgaccttcatcctgaaatgaaaatagagatgtttttttttcaacaaaacaa

SEQ ID NO: 65498 - DNA, 375 bp, Zea mays
  Clone ID: LIB3075-030-Q1-K1-B8
cacagagattatcccaggaaccactccattttggaattctctgcgtcagcgaagctcctgccactttgttcaccaggttctgtatcgtcggcagcaccctcaggtagcagaacccgtacagccacagatgcagccgccgccgctgctcctgagcccgagaagccccatgagcgagctgcggaggctgcacatgccgtcaagcccgcgcaaggtagcgtcgtcctcctcctcctcgtcgtcgtcgtctgccgtatcgtcccctaagcacgttggcgaggatcagaagcaaagaccagctgcgcctgagaaccaagccaccatcgctgactcgatagtgtgatccatcagccatggtggtggagagactgtggcatt

SEQ ID NO: 65499 - DNA, 282 bp, Zea mays
  Clone ID: LIB3075-030-Q1-K1-C10
ggcggaggaggtggtgagcactttgctggtcaggggcttcgtgctgagcaaggacgcgctgcggcgcgcacagtccttcgacggccggcaccagcagctgctgtccacggccacggcgcgggtggcgtcgctggaccgccgcctgggcctcagcgacaagttcagcctcggcacggccgcggtccgcggcgcggtgcgcggcgtcaacgagcgctttcaggtcacggagcgcgcctggggggccttttcggcggccggagaggtcgtggccggcatcctcta

SEQ ID NO: 65500 - DNA, 453 bp, Zea mays
  Clone ID: LIB3075-030-Q1-K1-C11
tcgcctcaacacccagaacctgccgttcgtcaaggaggtcgggctcggtgctgaccttgtcaggatcgacgcccactccatgtgctcgcccggcttctcctgcgactccgcctaccaggtcacctacatcgtgcgcggcagtggccgcgtccaggttgttgggatcgacggcacgcgagtgctcgagacccgcgccgagggaggctgcctcttcatcgtgccaaggttcttcgttgtctccaagatcgccgacgaaaccggcatggagtggttctccatcatcaccacccccaacccaatctttagccacttggcgggccggacattggtgtggaaggcaatattctcggcggtcttgcagtcgtcggtcaacaccacgccggaaattgataaacttgtcctgagcaagaagcttgacttggagatctttttttggccttcaaactgatttat

SEQ ID NO: 65501 - DNA, 349 bp, Zea mays
  Clone ID: LIB3075-030-Q1-K1-C12
cgctgctcaactccaagttcttccacatgaacatgtaccggtgcaaggacatgctgatcaaggacgtgaccgtgacggcgcccggggacagccccaacacggatggcatccacatgggcgactcatccgggatcaccatcaccaacaccgtcattggcgtcggcgacgactgcatctccatcggccccgggacctccaaggtgaacatcaccggcgtgacctgcggccctggccacggcatcagcatcggaagcctaaggcggtacaaggacgagaaggacgtcacggacatcaacgtcaaggattgcactcttaagaagacgatgttcggcgtccgcatcaaagcgta

SEQ ID NO: 65502 - DNA, 383 bp, Zea mays
  Clone ID: LIB3075-030-Q1-K1-C2
aaattgtatgaggttcacaggagctttcttggtgctgagcatatagtcataatgttggagattctatctgccattgcatcacatgcaagtgaagtgaactctgaatctaacttgcacaggaaactacataaagcatgctctattttggaggtacctgagccagcggttatccatttcgagagcgagtcctaccagagctacctcaaacttctccaagctcttcttcatgataacccatctttgtcagaaactatgaatgtggagtcacaaattatgctcgtctgtgagaaaatactgcgaatgtatctgacctgcgcagagcatgaactgtctaatggtgtttctggtaggggtccaactttacaacggatgcctctgggtac

SEQ ID NO: 65503 - DNA, 416 bp, Zea mays
  unsure at all n locations
  Clone ID: LIB3075-030-Q1-K1-C3
tggtcgattacgatgagatctctgagaaaatggcgagaagtgcgagagctaggaggcatgtggctcatcggatcaagtccacccatcccattccttcataccgatggaaggcaaaggcaatgaaaaaatccaaccgaaagcaagtgttgccagccttgcaaaagatggactgggaagatgccaattgctctgtgtgcatggaatacccacataatgctgngctcatcctctgttcatcccacgataagggctgccggtcttacatgtgtggaactagctaccgccactcgaattgcttggatcatgtcaagaaagcatacaccaagggggcattgcttgaggaagttcctgcaaatagcgttggcactgatcttgattcagcgccattgtatgcagaaaaaattgaggccattgac

SEQ ID NO: 65504 - DNA, 415 bp, Zea mays
  Clone ID: LIB3075-030-Q1-K1-C4
tctggggctagagctactgattctgcaagaattgctaaattcacaacggaactatctaggccagctgttatattagacaaattgcgtgaactatcttggagtggtgtgcctccatatatgcgacctaatgtatggcggcttcttttgggatatgcaccgcctaataaagatagacgagaaggtgttctaacaaggaaaaggctggagtacgtggaatgtgtttctcaatactatgatattccagatagtgaacgctcagatgaagaaattaccatgcttcgccagattgcagttgattgcccaagaaccggacctgatgttacatttttttagaatcatcaagattcataaatttctttgaacgcatttttgtatacatggggctatttgtcacccaacaaggtgggttaccttc

SEQ ID NO: 65505 - DNA, 380 bp, Zea mays
  Clone ID: LIB3075-030-Q1-K1-C6
cggacgcgtgggcaaaaatgaacttgatgatgttattgaagagcttgagaagatagcagttgttcatctactgcagaacaggtcaataatatctttaattggaaatgtgcagaggtcgtctttgattcttgaaaaggctttcaatgttctacgaagaaacggtgtcaatgtccagatgatatcgcaaggggcgtccaaggtgaacattttcttggtggtccatgacagtgaggcaaaacagtgtgttcaagccctccactccgcgttctttgagaatggtttcttgttggaagctgatgagttggatgttcagcatgatggctttacatcgcattccaatggcacaatccacaggcattaaccgaagatttgatattcat

SEQ ID NO: 65506 - DNA, 263 bp, Zea mays
  Clone ID: LIB3075-030-Q1-K1-C9
cctgtccatgagcagctgcgcggacgggctggtggacgcggtggacggctccaccgccatcaccgtctccaacggccacttgacgaggcacgaccacgttatgctgttcggggccagcgacgccgcgtccaaggacagggagatgcaggtcaccgtcgccttcaaccacttcggcaaggggctggtgcagcggatgccgtgctgccgtcacggcttcttccacgtggtgaacaacgactacacgcactggctcatgtacgcca

SEQ ID NO: 65507 - DNA, 331 bp, Zea mays
  Clone ID: LIB3075-030-Q1-K1-D1
tctctctctttcatttctatagccagcaggtagcaggcaggcaaccggccggtatattagtagatcttcgatcgttcatccaagctaataagtcagtaagcagcagtaggtcgaaaatggcgatgaggtcgctagcgctactggtcctcctcagcctgctggttgttggtgtggcgcatgcggtggagttggagatggagttggtgcctgctgatgcaattgcgatgactatggatcatgagccgccgacctcctccgcgacgcgctggacaacctcaaggccaagatctacgggaaggccatggaacagctgaccgcggcgatgggcgcc

SEQ ID NO: 65508 - DNA, 435 bp, Zea mays
  Clone ID: LIB3075-030-Q1-K1-D10
gagagagtgaaccgatcttctgttacaggcaatagacttaaagaagcacaacacataaacaaatctttgtccgctcttggagacgtcatattttctctatcgcagaagaatgctcatgtaccctaccggaacagcaaacttacacaagtcctacagagttctttgggtgcttactattgctgattgttctatatactatttacatgttatcagttatctaatatttttcatctgcaggcggccatgcaaaaaccttgatgtttgtgcagatcaacccagatgtctcatcttattcggagactttaagtactttgaagtttgctgaaagggtttctggagtggagctaggtgccaaggcgaataaagaaagcaaaaatattagagaatttatggaacaggtgataaattattgttttccttttgcccgacccttat

SEQ ID NO: 65509 - DNA, 389 bp, Zea mays
  Clone ID: LIB3075-030-Q1-K1-D11
gttcttagggaaatttggatccataccattaaaagatcaccactttggatccataccattactatctcacttacatgtgggtccacatgagtcaatgacatgtggggtccatggtatatatctaaagtttggatcttttaatggtatacatccaattgttcctagttcttaactgtgttgcttattccatcaggacagcacgtcccaaatgattttgtgttaactagcaaacagtttgagataagttatgttttgcaagattgacatattggtatatagtccgtatttttcttgtcttctcgttcttgctcacatgtgttacatttgaaattcggtataaaccttattaatatggactgttattggcttgtgcctcatttacatcttgc

SEQ ID NO: 65510 - DNA, 373 bp, Zea mays
  Clone ID: LIB3075-030-Q1-K1-D12
ggaagatctttacaatggaatctcaaagaagctctctctttcgcgcaatgtcatctgctccaagtgcaagggcaagggctcgaagtctggtgcttcaatgaggtgccctgggtgccagggctcaggtatgaaagtcaccattcgtcagctggggccttccatgatacagcagatgcagcagccttgcaacgagtgcaaggggactggggagagcatcaacgagaaggaccgctgcccatggtgtaagggtgagaaggtcgttcaggagaagaaggttcttgaggttcatgttgagaagggaatgcaacacagccagaagatcacctttcctggtgaagctgatgaagcgcctgatatcgttactggagacatt

SEQ ID NO: 65511 - DNA, 351 bp, Zea mays
  Clone ID: LIB3075-030-Q1-K1-D2
ctcctcttctccctcctcgcctactacctgcactaagcggagcgcggcgggcgcggcggcgagggcgggcgcggcgccgcgctcctcttctccctcctcgcctactacctgcactaagcggacggacggacggacgcgcgcatggcattggcatgcatggactggtgaacatctatgcatgcatggacgacgtcacttgcaacgctgttcccatatagtactactggtctgctatgaatatctatgcatgcatggtaacggggtgcggtatttaattattattattacgtagacattactatgtaaaaatcatgtgttcgcggaaagtcgttctggaatcttgggatggaa

SEQ ID NO: 65512 - DNA, 285 bp, Zea mays
  Clone ID: LIB3075-030-Q1-K1-D4
ccacgcgtccgcggacgcgtgggaaaggatgaatttgtgagctacgcaagcacagaagctaggcgtttatctgaagcagcatttggtgaggctatgcttcacactattgggtatatttacgtgcggcaagcagcaagagaacttgggaaaagtagaatttatatgggtgtaccggttatagctgagtgggttagagacaaaggacaccacattaaatcgcaagttaatgctgcttcaagggctatttttctaatacaactttaagaaaggatgaaaaagatggaa

SEQ ID NO: 65513 - DNA, 432 bp, Zea mays
  Clone ID: LIB3075-030-Q1-K1-B6
agcagatccagaaatcattaaattacagcttgaatttctttgatatgaaaaaattcacctcgaatacaaatgtccacaggatacaggaagctccttacaatactactaacctcatttctgtacatgatccccagacctcagtttttttttccatcacaactgttctgggagataggtgcatccacatcctggactggctggatccatcctccaggaaatcctgctatgtgttgaagaccgaattttttgtaaactactactactactaccgtttggcactgcagacccttttgttatttgtggtcacggatgaaagttgagatccctggagcaaggtctcatgtggagaacccccttattcatcacgtattctgggaactcatgcatggcaaaacgccatgctgattgttggacatgaacataatggttacg

SEQ ID NO: 65514 - DNA, 317 bp, Zea mays
  unsure at all n locations
  Clone ID: LIB3075-029-Q1-K1-H5
atgagaggcaggcgtgtttgccgatatgaactgtgttgttgaggtatgacagatttatggggatagaagaagaggctcctgtttgccgtgtgagcagcagatttgatgtattatttgttggctaataaacagctattgtacactgtagaggcaaaagaaacaaattaacgtggtttccattttctttatatgttttggggatacctgaggagcggtttatatcatacatttttattgacataattcaatagggantgttatgtgcgatacttgtcaaaaaaaaataagaaatcatggagaaacaacggctgtgataa

SEQ ID NO: 65515 - DNA, 365 bp, Zea mays
  Clone ID: LIB3075-030-Q1-K1-A1
aaataattgggaataaatagttcgtgaatccctgaagcgtgcatatatatattcctgccaagataaaggtaatggagtcgggacgcaagttccagccggccgtcatcctgcttctcctgctcattgtgtccaccgatatggcacaggcaagggaatgcgagaagtacagggagcgatttgttggggcatgcatgatcgcagacaactgcgccaatgtgtgcctgggtgagggcttcttggccggcaggtgcagcacctttcggcgccgcttgatgtgcactatgcagggctaaacaagatcgctccatcgctcgccatgcatcgacaacctattcttaataaagggcattatttcggtcttattt

SEQ ID NO: 65516 - DNA, 354 bp, Zea mays
  Clone ID: LIB3075-030-Q1-K1-A10
tttccaagctcctcctcgcgattccaatccacgcacgcctcctccgcttccgcctcgctcaggagattcggatttgattatattaccctgattcgtttaaaaggatgggttgagctcttatagtcagtgatggaacacaaggaggcgggctgccagcagccggagggcccaatcctatgcatcaataactgcggcttcttcggcagtgctgcgacgatgaacatgtgctccaagtgccacaaggagatgataacgaagcatgagcaggcccagctggctgcctcctccatcgatagcattggcaatggcggtgacggcgggaaaggaccttgaattgctgcatctgtaaatgtg

SEQ ID NO: 65517 - DNA, 386 bp, Zea mays
  Clone ID: LIB3075-030-Q1-K1-A12
cccacgcgtccgcccacgcgtccgtccacgcgtccgggaggttgatgttgaagtgccaactgatgaggatgagacaagtgaagaagaggattcaactccagaaactacagaggaagagacagaagaagacgaagacgaagagaaagagaaaaagcccaagaccaagacaataaaggagactacttctgagtgggaacttctgaatgatgtgaaggctgtatggcttcgcagcccaaaggaggttactgatgaagaatactcgaagttttaccactcactagccaaggacttcggtgatgacaagcctatgggttggagccacttcactgccgaaggagatgttgagttcaaagctttgctctttatttccccgaaagctccacatg

SEQ ID NO: 65518 - DNA, 427 bp, Zea mays
  Clone ID: LIB3075-030-Q1-K1-A2
tcgcccacgcgttcggccacaacagcctacagttattttctgcgtaccaaagttgtcggagaggaaattctccggctggatggcggaacgtactcgtcataaatcctaagatgatgaggggcctaagcgttttgcctgctagatggattcgagatgaacacaagaacacacaagggtttagagtggttcatgccgtcggagcgtaataccctactccactgtcggtgtattggatgagagtctgagtgtctgagtgagtgtgtcctgtaacaatcggtgtcctcccttttatagctcaatggagacacgtacaaggatactgagccccgacatgtgggcccagaggcagaatataaggaagaaactaatgtatgttacgcctgagcgatcttcgagcgccattaacggcatatgtcataattttatt

SEQ ID NO: 65519 - DNA, 326 bp, Zea mays
  Clone ID: LIB3075-030-Q1-K1-A3
tcgttcgaccacgcgtacgtccacgcgttcgcaaacactggatgtgttgatacttcaggacctgagtcgtttgcgaaattggatatcctggtacttgagggtgacttcaatatatacgaagatgaggattggtctgaagaagagtttgaaagtattattgacatggagcgtgaagggaagagacctcttttgacaggtgacctgcataatgactttgaaaaaaagtgtgggaaccataggggagcttacctttactgactactgcatttggattagaagcaggatattttatactttggctgaggattgctcctggctatttattg

SEQ ID NO: 65520 - DNA, 420 bp, Zea mays
  Clone ID: LIB3075-030-Q1-K1-A5
cccacgcgtccgcggcaagatcggcatcctgctggacttcgtgtggtacgagccgctgaccaagtccgtggaggacgagtacgcggcgcaccgggctcggatgttcacccttggctggttcctgcaccccatcacctacgggcactacccggagacgatgcagaagatcgtcatggggaggctgcccaacttcaccttcgagcagtctgccatggtcaaaggctcagcggactacgtcgccatcaaccactacaccacgtactacgccagcaacttcgtcaacgccacagagaccaactaccgcaacgattggaatgcaaagatttcgtatgagcgagatggtgtgcccattggcaaaagggcgtactcggactggctttacgtccgtccatgggggctctacaaggctctgatttggac

SEQ ID NO: 65521 - DNA, 359 bp, Zea mays
  Clone ID: LIB3075-030-Q1-K1-A6
gtcgccttcagcaacgccgaccacaaggacagtagcaccaaggtggaacagccggcggacagctccttgaagccggcgagcctgaacgcgttcgacatcatcttccactccagagggttcgacctgtcaagcctgttcgaggtggaccaagagcagaaggccagcaactcgcggttcatgacccagaaaccggcgtcggcgatagtgtcaaagctggagcagatcgctgagacagagcgcttcatggtgaagaaacaggacgggctggtgaagctgcatgggttcaagcaagggaggaaggggcagcttgcgatcgactgccgagatcttcgatgtgacaccgtgctttcacgtcgttg

SEQ ID NO: 65522 - DNA, 374 bp, Zea mays
  Clone ID: LIB3075-030-Q1-K1-A8
gttccatggagccgatacagctctgctgctctctggatcaagcatgtgtggcgatgtttgcgtgaacatcgcaccggtggaagactacgaactgccaccggaagcgtactcccatgcaggagcaaggtctccgggtccgggaacgccgacgggggaggccgtgaagaatgcggaggatgtggtgagcaccatgctggccaggggcttcgtgctgagcaaggacgcgctgcggcgcgcacagtccttcgacggtcggcaccagcagctgctgtccacggtcacggcgcgggtggcgtcgcttggaccgccgcctgggcctcagcgacaagttcatgctcggtacggccgcggcccgcggcgcgacgcgcggcgtc

SEQ ID NO: 65523 - DNA, 390 bp, Zea mays
  Clone ID: LIB3075-030-Q1-K1-A9
ccctccctcactcagccaaacctgacatcagcctattacaagcgtcagtagagatctttcagatggccatggccaagcccccgcttcagacggccgcgatcatcttcctcgtgctcctcgcgaccgcgtcgtgcctccacaccgtcgacgccgccgctttagggttttgctggggcaagtgcagcgctcggtgcgcgcgggcaagcgcgcggcgggcgtggaccgcgtgcatgagctcatgcggcctctgctgcgaggagtgcaactgcgtgccgcgcgacattcatgactgcccctgctacagcaacatgttcaccaccggccccaagaagatgcccaagtgccccttagactgagactgtgaggtcggctcacactgcggcatccatg

SEQ ID NO: 65524 - DNA, 424 bp, Zea mays
  Clone ID: LIB3075-030-Q1-K1-B1
ggccactgaggtaaatacaagtgatagccgtgttgaagtggactccaagatctagaagggtgttgggggggagcacaacacaaattctatcaaagagcttatcagcaacacgcctctaaattataatgacaatcgtttctttgggaaattcagatagtaaacaaaaagtggctatttcttcagaaacgcaaggttgctttacaattgtattatgagaaaatatttgatgatgagaaatggaggatctggcgaacgacttcatgagtatagttgcagatagaaaagacaacactgacgatcaaatggaaccatcaattttggcacttgatcgcaacaacacatgtgagctttttttgctgataatctgatggcaaaagcaaaatcatgaaaatatgatggcataatggttatttctgaagttatt

SEQ ID NO: 65525 - DNA, 407 bp, Zea mays
  Clone ID: LIB3075-030-Q1-K1-B12
cggagatggagagagcggcccccgtgaggagctcccacacctcgacggctggcctgctcgcgtggcctcaccccgatggcgccgggtcgctgccagcacgccggcctaaccagccgacggaggaattcaggaatgtggtgtttggggggcagctcacggagggggccgacggcctcaacaagacgaagaggaagacgggctcctcgcccaaggggaaggagacaacagggaccgggatatccaaggccgagagcgccgccgccgccgtcgcaactgcctcccgtgatcgtcaggctagccacatcaccttttcccaggacgggaccgttcctaccaggaaggcaactttcagggctggggtggcaaggcaacgtgagcttaaccataccgtcgagagtgagggggac

SEQ ID NO: 65526 - DNA, 300 bp, Zea mays
  unsure at all n locations
  Clone ID: LIB3075-030-Q1-K1-B2
ccacgcgtccgcagcgaaccaagagagcagggtgtgggcgaagagaccccagccagtcgatcgttcaagaaaaataccagcttaccaacaacagcagcagcaagcccacccgttcgacgacatggcccgcctcggcgccggcgccgtgttggcgctcctagtggcggtcgcggcggnggccgcgttccttgcggtgccggcctcggcgaagtccggggagctgagcgcgatggggttgctggcggcgaagggcggcagcggcgcgggccctcataattgctctggctctgtgggcgattg

SEQ ID NO: 65527 - DNA, 378 bp, Zea mays
  Clone ID: LIB3075-030-Q1-K1-B3
ccgcatccatccatccatccctaaaaatcaaggctacacaccaacttactttctaggtctcaaattaaatggcctcctcgtcctcctccttgctgctggcgtcgatggcggtggcggcactctttgtcgtcggctcgtgtggcggcgcgctcaccttcacgatcggcaaggactccagctccaccaaactatccctcgtcactaacgttgccatctccgaggtgtcggtcaaggagaagggcgccctggactggtcggatgatctcaaggagtcgccagccaaaaccttcaccctcgatagcaaggagccgattaaaggccccatcttcgtccgcttcgctgtgaaaggtgggggctaccgcgtcggcgatgacgtca

SEQ ID NO: 65528 - DNA, 246 bp, Zea mays
  Clone ID: LIB3075-030-Q1-K1-B4
aaaaaaaaaaaaaaaaaaaaaaaaaaaaatattaaaaaaaataaaaaaaaaaaaaaaaaaaaaaaaaaagggaaaataaaaaaaaaaggcgaaagctttcttatgctataatataaaataatatatttttaaaaatggggtgttgaatttaaataaatcataatatttattacaattgtccgtacataaaaaacctttggttttacgaaacttattattaattccaattatattcccattttaaaa

SEQ ID NO: 65529 - DNA, 386 bp, Zea mays
  Clone ID: LIB3075-030-Q1-K1-B5
cgcgtccggaagagaagatcgacaagagattggcggtaatggactcctcggagctgcacatactggccttgcagagggtgaagcaggtggagccggagaacgcgagcaagatcctcggctgcatcctcctggaggaacccgacaaccaggatatgctgcagctcgcctacggcaacgacgccgaggtgcacgccaagatcagccacgccaaggccatgctggacgccatcgtcgcgtgctgctcctcgccggccttcggctaccactactggccgccggtgcccaataaggcgcaagcagaagagtacgcgttgcagccgcagcactacaagggcggagggtgctactacgcctctgagaacgcgctcatctacaatggcgggggg

SEQ ID NO: 65530 - DNA, 329 bp, Zea mays
  Clone ID: LIB3075-029-Q1-K1-H4
gacagggcaagcgatggtggtctgcatctactacgagcccattacccccggccagtgctacatggtggtctagaggctcggcgactacttcgtagagcaaggcctgtgaatggattcatgtatccttgctcgcttgtccatggttcgcagcaacgataccaacacccgcattatttaattggtagcctcctctagctacgcacgcatttttagtctcctacacgcccttggattgtgcgtggctctgttaatcatctctcatccttcgtctgccatttctcccctgagatttttgttccttgttggtaccatgcattttggcaaataaa

SEQ ID NO: 65531 - DNA, 143 bp, Zea mays
  Clone ID: LIB3075-033-Q1-K1-B6
cgttcgcgacgggtgcggccagtgcggagcttcggctttgtgcatacaactccattcaatagccatggccacaaagtgtttgtccaaagcccattgatacccggtcatggcgatggatctaatgtgccagtcatggatgacac

SEQ ID NO: 65532 - DNA, 407 bp, Zea mays
  unsure at all n locations
  Clone ID: LIB3075-033-Q1-K1-B7
gcgaccatgtcggggcgtggcaagggcgggaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgccctcaagcgccagggtcgcaccctctacggattcggcggctgagaggcgctaccgncgctggtggccgtggcaaaagtcttgggtcgcggtcaagaaatcgagagtattctggatgacgtgcttaggttcgt

SEQ ID NO: 65533 - DNA, 138 bp, Zea mays
  Clone ID: LIB3075-033-Q1-K1-B8
cagtcgcatggctcgagcgaccatgcttcggcttggcaagggcgggaagggtctttgccaatgcgtagccaagcttcaccgtatggttctacgcgacaacatccatggcatcacgaaccggcagatgctcaggctgat

SEQ ID NO: 65534 - DNA, 266 bp, Zea mays
  Clone ID: LIB3075-033-Q1-K1-B9
ggcttctactccccctcttaccaagtcctcttcgggttagggttacttaaggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctacgagaactccatgctcgacgctatcg

SEQ ID NO: 65535 - DNA, 421 bp, Zea mays
  Clone ID: LIB3075-033-Q1-K1-C1
gcgtgtcgccatgcacgatcgactatgtctgctcgccacaaggcctgcaactgtctgttgaaatgccgtgtccagcgggagcgagaggctctgcgcgacaacatgaaggcattgcgaatcctgatatccggaggctgcttaagatgggcggtcttaacctcatttgggggctcatgtacgaggagaaccgagagaggctcatgatcttcctcctgaacttaatgcgaaacggcaagacctactcggagcacagcccgctaaagagcgttagcgcatgaacgcagctacagaatgaagcgccaaggtcataccctgtacagattcagcagctgacaggcgctaccgtcaatagtattcgtggcaaaaggcttagatcgccgtcaagaaattgtgagtcatctggatgacgtgcttaatttcc

SEQ ID NO: 65536 - DNA, 427 bp, Zea mays
  Clone ID: LIB3075-033-Q1-K1-C10
gagtcatggggttttacaaaggaaatggtgccagtgtgatgagaattgttccttatgctgcattacatttcatggcatatgagcggtaccggtgttggattttgaataactgtccctcactgggaacagggcctttagtagatcttttagccggttcagcatcagggggaactgctgtattgtgtacttatcccttggatttggcccggactaagcttgcctttcaggtcaatagttcagatgaactcagcagagctttgaaaaggggaagtccccagccagcatatggaggaatcattgatgtctttagatgtgtttactcagaaggtggagtgcgggctctttaccgaggtgtaggtccaacactcatggggatacttccttatgctggtcttaagttctacatatatgaagggctgaaggtcat

SEQ ID NO: 65537 - DNA, 268 bp, Zea mays
  Clone ID: LIB3075-033-Q1-K1-C11
acgcctcgcaggtaccgattccaattcgacggacgacgccacgcgtacgcttcattgacctcgacgacagctacaactgaagtgcgcgctcgatcgattacaccctgactgtagagaccgtgcagtggcagaacacacatcgaggctgagctgatcaaggagcatgctcaactttgtctgctccttgatctgcctgcagaacgtcaagtataatggtggcgcacctgtatgatcacttaagtgcgaaactatcagaggatgcacttta

SEQ ID NO: 65538 - DNA, 114 bp, Zea mays
  Clone ID: LIB3075-033-Q1-K1-C12
acggtccggacggcacggccaagacttcgggtgcccgtgcctttgccaaggagctaaatggcttttcttttaacaccccaaggcctcttacctaatgcacttcgtgcatggtta

SEQ ID NO: 65539 - DNA, 282 bp, Zea mays
  Clone ID: LIB3075-033-Q1-K1-C2
cgcttgacaccaagaccccgctcaagtatcccctctgcatccgcttcgctgtcaagtctggtggctaccgcatcgccgacgacgtcatcccctccaatttcaaggccggcaccacctacaagaccaccctcagcatctgattagcctcttatgacgaataatattttgagagagctcatctggaccatgtgccagcgagctaatatttaatttttttctttggttatattgaagcaccacatgagccaagaaaaaagttatgctacatgtcccttctcgcgc

SEQ ID NO: 65540 - DNA, 409 bp, Zea mays
  Clone ID: LIB3075-033-Q1-K1-C3
ggctgggcgactacctgctcgaacaggggatgtaacaacaaccccttcccctggaatgcatgttgatgatgttgctcgttccaacttcgttttcagtaataataacaacaaagcgaagaccctgctacataccctatttgcttgagcggatctcgtccgagccacaagataccacatgttgcgctgggaatattcagttactatgacccgctttagttgacctatttttttggggggcgcggttcgatcattctggctgtagcgtgaatcgcatggacaacagaatgcacttgctaagcaaatattgctcttatgcatatatttgaagaaccatgtacaagcccgactttcgcaaagtaatgctggaaattgagttataaatcacacgacatactttaaaccatctgct

SEQ ID NO: 65541 - DNA, 326 bp, Zea mays
  Clone ID: LIB3075-033-Q1-K1-C4
cattaacaccggcgccaccgccagcacacaccagctcgccggagatcacaagaagatacaggaccgtgctcctcgacgccgcccgacatggcggacgccgcctctggccgcggccacgtcgtctaccctccccgctccgccgaggacatcttcaaggactaccgcgcccgccggtccgccatcctccgcgccctcactcacgaggtcgaagacttctacgcgcagtgcgatccagacaaggagaacctgtgcctgtacggctacgccaacgaagcgtgggaagtggcgctgccggcagaagaagtgcccacggagctgccggagcc

SEQ ID NO: 65542 - DNA, 429 bp, Zea mays
  Clone ID: LIB3075-033-Q1-K1-C5
acttatacgttcacttatgcgtgatggtactgagtatgttgctcggtactctcgcaagtctctccgagtacttggaagtgtgggtgagccaatcaaccccaccgcatggaggtggttttatgatgttattggtgactcacgatgccccatatcagatacttggtggcagactgaaactgggggattcatgatcactcctttacctggtgcttggcctcaaaagccaggatcagcaacgtttcctttcttcggtgtgcagccagtcattgttgacgagaaaggtcgagaaatggaaggagaatgcagtggatatctttgcataaagaaatcatggcctggggctttccggactctgtatggagataaagagagatatgagacgacatacttcaaaccatttgctggatattatttctcgggcgatggctg

SEQ ID NO: 65543 - DNA, 413 bp, Zea mays
  Clone ID: LIB3075-033-Q1-K1-C6
gccggtcgccatggcaccgttacggcgctgggcagacctgccggcagatctcctctgccgcatcggagaccggctcgacctcaagtggtacgccagcgcgcggggcgtctgcacggcgtggcgctgcgcgctcccgccgccgtcgcccgcgctcctcgtggtcgctgacgacgctcgatgttgcccctacgctgcctccctccccacgcggaggtcattcgagctcaccgccatcgtctcgggaagccgctgcattggctccagcaacggctggatcgggctcttcggcgtcctcttcaacgggaagaacgtcttcgggcttcttaaacccatcggccgttgggagaaccttcttccggcggttgtccaataaaagccgttgggtttccaaggccgctttaacccgaagcccg

SEQ ID NO: 65544 - DNA, 421 bp, Zea mays
  Clone ID: LIB3075-033-Q1-K1-C8
cacaataagatggcgtgtatagacaatgcaatgagagccttgttccttttagcgctcttctgggtcgtgcatggtgagaaggcaaagtcaaaggacaacgatgcaaaagcgtccgggcccggtgggtccttcgacatcaccaagttgggcgcctacggcaatggcaagacggatagcacgaaggctgtgcaagaggcgtgggcatcaacctgcggcggcaccgggaagcagacgatcctcattcccaaaggcgacttcctcgtcggaccactcaactttacaagcccatgcaagggcgacctgaccattcatgtgaatggcaatctgctggcgaccacggacctaagccagtacaaggatcatggtaattggatcgagattctacgcgtggacaaccttgtcatcaccggcaagggaaagc

SEQ ID NO: 65545 - DNA, 434 bp, Zea mays
  Clone ID: LIB3075-033-Q1-K1-C9
gagacttcctcgcctacatcccatcccgccgccgccgtctctacggtcgctaataagcagccgcatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgacgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttatgaatgtttttttttcctttctctttctacttgattttcat

SEQ ID NO: 65546 - DNA, 430 bp, Zea mays
  Clone ID: LIB3075-033-Q1-K1-D1
gccatgtatgtcgccatccaggctgtgctttccctgtacgccagtggacgtacaactggtattgtattggactctggtgatggtgtcagccacacagtgccaatctatgaaggttatgcccttcctcatgccatcctgcgccttgaccttgctgggcgtgacctgactgacagcctgatgaagatcctcactgagagaggttactccttcaccacctctgctgaacgcgaaattgtaagagacatcaaggaaaagcttgcatatgtggctcttgaatacgaccaggagctcgagaatgccaagagcagctcatctgtggagaagagctacgagctgcctgatggtcaagtgatcaccattggggcagaaaggttcagatgccctgaggtcctctttcagccttccttcattggtatggaagctcctggca

SEQ ID NO: 65547 - DNA, 248 bp, Zea mays
  Clone ID: LIB3075-033-Q1-K1-D10
tcgcatggccgtgctttctccccgcatttcctttcgacgccggtcatctccgaccagggtggcgaatcattctcggcgcgtgggcatggggctacggagttggacgttgagcatacacgatggggtgtccatgaacaatgagcgttgaagacaccgtaatagctcgccgaatcttgccccagcgaggattaccgccgtgcgccactcgaccgtactccagcgagcttaatactcgtgaggtcacgtgt

SEQ ID NO: 65548 - DNA, 394 bp, Zea mays
  Clone ID: LIB3075-033-Q1-K1-B5
ccgagaccgagcgtgagagagagatcgggaggggagtgacgcagtcagagctcgggagcggcaggaagagagaaaagcggaagagcttcgtcgacagctcgtgtacagagtcgctctgtcctcgatagatggcttgggagggtcgtacaggcgtcccaatggtgtcatgaccttaccccacagaacttgggcagtcgtgcggaactttctcgacgacgtcgaggaaccaccggacttccgccctgcgccgtggtcagtgctgatgctcgcgtggctcacccgaggttacgagttgactgaacatcaccctggttactgggatctcaagtgccaagcgcgttgagcccttgatccactcttggtacccaataatgatctttattatcactattca

SEQ ID NO: 65549 - DNA, 352 bp, Zea mays
  Clone ID: LIB3075-033-Q1-K1-D11
cgagcgcaagaatacgacaggctcggccacactctggcgctgtacgaactggagcactgcgagcggtgggcgtcggtgaccgttctgggagtgggagagggcgaacacggacgacgacaaggtccggggaagaagaagatgggtggctgtccggggatggggagcaagagcaagtcgttgttctgcggggccttcaatctcttctccagatagccggcgccgccgcttgtttttgttcctactgccgtgacaaaccttcttgtgatttctttatttgcctttttgctagaagttcttattttcatgtgtaaattttgtaccattgccgtgggttagaaaatcacatttttcc

SEQ ID NO: 65550 - DNA, 369 bp, Zea mays
  Clone ID: LIB3075-032-Q1-K1-H5
tggcaattgagaaagtcttcatggctgacaacaactcagttatagcagacgaggttctttcacatagactaggacttattccacttgatgcagatccaagactctttgaatatatctcataaaacgatgtcccaaatgaaaggaatactattgtttataaactgcacgtttcttgtccaaagaattctcaacgaattacagtgaaatctagtgaactagagtggttaccagaaggtagccaattaagcatgtcagcccctgcacagtctggagacaaacagaagactttcacttccttcagtcaaagccaaaaggagatcttagaaaagcctcttggtgttggacaagagtttttttaaaaattttttt

SEQ ID NO: 65551 - DNA, 180 bp, Zea mays
  Clone ID: LIB3075-033-Q1-K1-A1
cagtcatctcctccatcaccaccaaactcaacaacagccagctcgcgaaaataatgaagagccgcagcatggcatcatcggccgcgctcttggtgctagccctcgcgctagtggcggacaccgccccacaggtagcggaggcaaagaagaagagagcggcggagagcggcgaggcggcgg

SEQ ID NO: 65552 - DNA, 331 bp, Zea mays
  Clone ID: LIB3075-033-Q1-K1-A10
cgcaggcccgattccaattcgacccacgcgtacgcgatccgcgccactccattcgcacctgacctgcggatctcatgcaagctcaggatggcggccttgcactgtgcaggaggccgactgtctcacctagcacagctgcctgactctgacacgcgctaaccgccctggctagtaccagcatgcagatcaacgtggctgctactacaaatcggacgtacagagtctgcatagcctgaaccatactggcatggatcacgacactgcaccagaggtgcatagcaacagttcagtacaagaactctggcccatccatggcgcaaagcaaaggttc

SEQ ID NO: 65553 - DNA, 251 bp, Zea mays
  Clone ID: LIB3075-033-Q1-K1-A12
tgaaactctggttccgacatacttataccacgctcatggaatcaatcatcatagaaatcctacaagagactacctgtttggcccatccctggagcatactcgtcgtgcagtggatcatatccattgtaatgaagtgcacggtcgaagcacctgcgtccactgacaggctggaaggggacgaaacaccaatataggtctgcgtttgttgatcacttacagagatcttactcctgacgtagctttgcatcatg

SEQ ID NO: 65554 - DNA, 238 bp, Zea mays
  Clone ID: LIB3075-033-Q1-K1-A2
attcttaggtgcattaatcatttgtcgggtgatcctaattgtctcgagacacttcaacgcacagatgcagtcaaacatctgataccgattcttgagctttgtgatggacctctggtttttcaaatacatagtgaggtcctcaatgctttgttcaacctttgcaagattaataaaagaagacaggaacaggctgctgaaaatggaatcattcctcacttgatgaatcttgtcatgtcag

SEQ ID NO: 65555 - DNA, 230 bp, Zea mays
  Clone ID: LIB3075-033-Q1-K1-A4
cagacagggcgggggcggcgcgctcgcccaccaccaccaccaccaccaccacggtgatccagtccaccatgcagtcgatcaaggaggtcgtcgtcggccactccgacgccgacatcttggacaccctccgcgagtctaacatggaccccaacgagacggcgcagaagctgctgaatcaagatccatatcacgaagtgaaaagaaaaatggacaggaagaaagagagtgct

SEQ ID NO: 65556 - DNA, 332 bp, Zea mays
  Clone ID: LIB3075-033-Q1-K1-A5
cggacgcgtgggttcgacgccactctcacggccctccttgagcaagagcaacaccacggccttgacaccggggaccttccgcagatcgacggcctttcagaagtagcatactacccaaccgccaccgatgaggccaccatagggcaattcaaccagatggggcttccgacgaccttagctgaacagatgcttccaatgcagatgaacagcagtgcatccgccttgatggccctcacttcagactaccatgaggggttcacaagggccgtaggttgaagggtcaagggtctggatggaactatggatcaattggaaactggagccattctttc

SEQ ID NO: 65557 - DNA, 406 bp, Zea mays
  unsure at all n locations
  Clone ID: LIB3075-033-Q1-K1-A6
gagatacccgatcgccaccgccgaccggactcccctcaaaggcggccacagcacagcgagcatgggagaccggcatcagcatgggcctggcagcggcgtggaggacccggcgacgctgctgcggcgggtgcagacccgcgcgcccaactcgacgcaggtggtggggttcctgacgctgctcgtctctggcgccgtgctgctgctgctgacgggggtgacgctgacgggcgccgtggtggcgctcgtcttcctgggccccatcgcgctgctcaccagccccatctgggtgcccgtcgccgtcgtgatctccgncatcgtcgccgncgcgctctccgcctgcgccttcgccggcggcgggcttcccgtggccacctggatggaccggtactttacgggccggcaaccc

SEQ ID NO: 65558 - DNA, 422 bp, Zea mays
  Clone ID: LIB3075-033-Q1-K1-A7
gcgattcgacacaatatatcttaaacatgttgagtttgacgataatggattcaagatatgttaccctatgcattttcttagtacttgccttacatggagatactactttggcagaaacttgcaggcagtatgttgaagggcagccattctgctttaaagcaatgtgcaaggcaaattgttttatggagggaaaattctctgatggttcttatgtaaagggttacagatgtgaatcacgtggattccactcggtgtgtgattgccttttgtgcaaaaattagttgtctaaagacaaggggagatatcttcttatgttactatgcattatttaagaatattgtctaaataattatacgatagcttagttaaatagtttgtttatttatagaccaatgtagcgctaggtaactagttgggaattt

SEQ ID NO: 65559 - DNA, 413 bp, Zea mays
  Clone ID: LIB3075-033-Q1-K1-A8
cggacgcgtgggcgctaaggaggcgcccgccatggaggacctcaactacccgtccatcgtggtgccgtcgctgcgcggcacgcagacggtgacgcgacggctgaagaacgtcggccgtccggccaagtacctcgcgtcctggcgcgcgccggttgggatcaccatggaggtgaagccgagggtgcttgagttcagcaaggtcggtgaggaaaaggagttcaaggtgacggtgacgtcgcagcaagacaagctcgggatgggctacgtcttttggaggctcggctggacagacgggacccactatgtcagaagccccgtcgtcgtcaacggccttgcatgatctatcccagttggggctacttgaagtccctaactacttctactacctggaggccctggggaattttggggcc

SEQ ID NO: 65560 - DNA, 257 bp, Zea mays
  Clone ID: LIB3075-033-Q1-K1-A9
gaccacgtgaacgaccaaaccatatcatgatcgacgttgtgaatcacgcttggagagacggaagttgctacatacattaatggggcgggtactacactagcatgaagtgctgacatgccttcattgccgaacatagtccgaatctcatagactttctcaagccattcaaccaacaaccttttcaaaggcagatgtatcgcactcctcaagtcaagatctcttcgaagcgagctacagtatgtcatcaacggtctagc

SEQ ID NO: 65561 - DNA, 413 bp, Zea mays
  Clone ID: LIB3075-033-Q1-K1-B1
cccagggtccaacgcgcggctcttggccacggtggttgccggtgcggtcctagccgcggagctgtccctcatctctgcgcaggccgctggccatctggtccagagccacatgaaatacaacaggtccagcaaggcccttgcagaggaaacagacaaacccaagaaatgttgaataatatcaagttgttgttttataaccctttgggagaacggagcgaaaagggtcccacaggatgattccttgcggcatgctcgggtggaaagggaaaaaaacccttctggcgaaaagagagaattcagtcgactcgtcatatttaccaagcggtgagacctgttgtggatcctggagtatgacctatttaattcgttgatgttgtcggtataggtcctctacactacactcgttgaccccg

SEQ ID NO: 65562 - DNA, 341 bp, Zea mays
  unsure at all n locations
  Clone ID: LIB3075-033-Q1-K1-B10
ccgccatcgccgccgcgacaccctcctcaccctcagggggagcgtcacggcggcggggagatgccgtaccaggacgcggaccacaggctccgcgcgctggtcgggagcgtcgagggcttcggccgccacgccatcgggggcctctacggagccatccaccgcgtcacgtcgctccaagacgacgggcccgggagtctgagggaggcgtgccgcgcggaggagcccctatggatcgtcttcgaggtgtccggcaccatccacctccactcctacctccgcgtctcctcgtacaagaccatcgacgggcgcggncagcgcgtagtgctcaccgggcaggggct

SEQ ID NO: 65563 - DNA, 358 bp, Zea mays
  Clone ID: LIB3075-033-Q1-K1-B11
accgcatgggctccatccggatcaagaaggggaggaaaggagaggttaggaaagtctgtaaccagcacctgttatcagcctgatctgcgtctgcattcagcagcatgcgtccgtacatcgtcgtcggagtcagctcatcagcgtgccagcaccagtatacacacgggactagctcgttcgtggttactacgtttggggcctcgcgttgcgtgattagagctatctttgatgcatgtgacggcagtttaagttagagaagattatcttggtcattgactttaaggtcgcgtgcagtttgtgccagaaaatgtgtaactgcgtatgcatgcaactatgcaagtacagtgttcaaaataaa

SEQ ID NO: 65564 - DNA, 416 bp, Zea mays
  Clone ID: LIB3075-033-Q1-K1-B12
accacgcgtacggccacgcgtccgaccacgcgtgcgcccacgcgttcggcgagaaatcccccatttcatcagaaagcgcgattactgctaaacaagagcctatatccaggtctataccaatcggatcgatcgcgaggaccttatcatgggacgacgcttcccaagaggctccttcgcagtgttctaccaaaggagacagcaaccacgagcaggagcagcacgagttcgtcgagaagacgctggcatccgctggcttctgcaacgagaagacccaggacatctttgcccggtggcattcgctcgaccggcccttggaccccgccgtggtcgagcagctgctggaacgcaaggtggaggacgccaagtgccgagagaggcggtcgaaccagaggctcctaatcgactctgtcaacgcc

SEQ ID NO: 65565 - DNA, 268 bp, Zea mays
  Clone ID: LIB3075-033-Q1-K1-B2
agctgatgagctttcaaagattgtgagcttggaggcaaaatataagtgtacaaagcaagaagttgaaagggcagttgtttcctgtgaaggtgatctagaaagggccgaggaggccttgaagacacacaagcaagaatcaactgcaatcccaccaaagcctgaggggtctggctattcaagtggcttgcctaataagccccaagttgtacttgcacagaaccctgcaaggccttaaacaaatggattatcatcagtaggatctcatcag

SEQ ID NO: 65566 - DNA, 327 bp, Zea mays
  Clone ID: LIB3075-033-Q1-K1-B3
gcgaccatgtcggagcgtggcaagggcgggaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgacatggacgtcgtctacgccctcaagcgccagggtcgcaccctctacggattcggcggctgagaggcgcta

SEQ ID NO: 65567 - DNA, 390 bp, Zea mays
  Clone ID: LIB3075-032-Q1-K1-H4
cgcgagggccgcccttttttttttttttttttttttttttttttttttttgataagaacggcgaacagcagggattatttgctccaccactacagggccatttatttactcgcaatataaaattaccgatcgggacttaactacacacgcaagcaattagttcatgcgcttattaggttgtgccactggccaccactacactacattacactagcacaagcaagcagctacacatacttgtccatatcacataaacgaaacagcatatataagaagatgtcccaacatctttgcaccacgcgcgagatcaggggccctgcaggccgaactcttcagggcgcggcccaccggtttttttttcccctttttttttccccccccccttttttt

SEQ ID NO: 65568 - DNA, 228 bp, Zea mays
  Clone ID: LIB3075-033-Q1-K1-B4
gccatggcactgttcaagtgcatgtgcatcttcttagtctcgcttctactcgccctcaccttcaccaatgcccaggaagaatcttcacatcggactctcccaccgttcccctgcatcccaggccagccacggcccccgcggttgccaccttgcccgccggcaccaaccgagtgctacacgtcgctgtcgggaatgatgccgtgcgcggacttcctcaaccacaacgag

SEQ ID NO: 65569 - DNA, 440 bp, Zea mays
  Clone ID: LIB3075-003-Q1-K1-A5
ccacgcgtccgaggacatgcaaagtcacaaagggaggccaaatagcaaaattcacagcgctattggccactgggaattacaatggtgttgttggcttcgctaaggctaaaggcccaacagccaagattgcaatacagagagcgtatgagaaatgcttccagaatctccactacatggagcgatacgaggatcacacaatcgctcatgctatccaggccaaatatgagaaaacaaagatatatctctggcctgggccaatgaggagtggaatgtctgctgctggtaggactgttgagactgtgctgtacttggctggtttcagcaatgtcaagacaaagattatcggatcaaggaacccacttaatgtgattaaagctctcttcatagctttgaatgctattgaaactcccaaggatgtccaacagaaatttgggcgtact

SEQ ID NO: 65570 - DNA, 336 bp, Zea mays
  Clone ID: LIB3075-004-Q1-K1-G6
tgacggctgccggcatcgcggaggaggctgtgcggcggtgggtggacgcctccgagtgacggctcatcctctacggcggtctggccactgagctcgagtccaacagctccaacctcaactacccgttctggagcactaagtgccttctctcctacccttacctaatcctcaaggtccacatgtactatcttgaagctggcgcacacattataatcacagcatcttatcatgccactattcaagggtttgaatcaaagggtttttcaaaagaacatagttaaaacttactaacaaatagtgtctatattgcactggaagctcttgagatgttcttga

SEQ ID NO: 65571 - DNA, 105 bp, Zea mays
  Clone ID: LIB3075-005-Q1-K1-A5
taatttcaagcgttcttggtcaaagtatcgcccttgatcactatattcggcaggtcgatgatatggttgaggaattcactgaaattaatcgtggcatggtaaaga

SEQ ID NO: 65572 - DNA, 430 bp, Zea mays
  Clone ID: LIB3075-005-Q1-K1-B8
cacggagagaagttgatgaggtgaaggagttaatcgagatagtgagggagtatgtccttggtctgaggatggaactcaagagaaaggaactgagggatgatgtgacccgtcaacaggagttggctgcttacttcacaaactgcaagcttcagagagttcatatgaggcttgtgctcgctagtgccatggctctttgcttcaagcagaaaaactatgcaactgcggcacactttgctaggatgcttcttgagaacagccctcaggaggcccaagcaaagaaggcccgacaggtgctgcaagcttgccatgacaaggacgattcccaccaactgaactatgacttcagaaatccattcgttgtttgtggcgctacgtatgttcctatctatcgtggccaaaaggatgtttcgtgcccatactgtggatcccg

SEQ ID NO: 65573 - DNA, 382 bp, Zea mays
  Clone ID: LIB3075-005-Q1-K1-E3
taacaagttgaattcatcatcgacatatccattgctggagctgttcttcaagaaccaggaaaagttctacaattctgccacatcatctctctcgggcccttccgtagctctaggaatgtcgaagatggctgcgcagactgttggtaactcagtatccgagtttctgtcgggcttcagcgatgggaagacagactcggcagcgagagtttcattcaagtacgggtgcacgaggggagtctttggcgcgccgttcttctttgtgaatggcttcctccagcctgggggcggatcgcctatcgactacagcacgtggatcggcatcctagacccccttggttcccagaacggtgaacggatcgagatgtttacttcgatgtaagtg

SEQ ID NO: 65574 - DNA, 329 bp, Zea mays
  Clone ID: LIB3075-006-Q1-K1-A2
tactgattcccctatgcgctatgttgatatcggcattcccgccaataacaaggggaaacagagcattggttgtctgttctggctgctcgcccgaatggtcctccagatgcgcggtacaattcttccaggacacaagtgggacatcatggtagatcttttcttctacagagacccagaggaagcgaagcagctggaggaagaagaggctctggttgcacctgactatggcgcggttgcagaatacactgcaccaggcgctgacaactggggcggtgaatggggtgctggcgaagctgcagctccagctgctagcattccagctgctggcg

SEQ ID NO: 65575 - DNA, 368 bp, Zea mays
  Clone ID: LIB3075-006-Q1-K1-B2
cttcgagagaaacgttacaattaactatccgtttgagaagggtcctctgagtccccgcttccgtggtgagcacgctctcagacgttacgaatctggggaagagcgttgcattgcttgtaaactatgcgaagctatatgcccagctcaggcaattacaattgaggctgaagaacgtgaagacggcagtcgccgaaccacaaggtatgatattgacatgaccaaatgcatttactgtgggttctgccaagaggcttgcccagtcgatgctattgttgaggggcctaactttgagtttgctactgagacacacgaggaactactgtacgacaaggagaaattgctcgagaatggtgaccgctgggaaactg

SEQ ID NO: 65576 - DNA, 436 bp, Zea mays
  Clone ID: LIB3075-006-Q1-K1-H12
taaacaagcgcacacgaacaaatacctcgccgtcaataatggcctccagatcctccattgtgctcgccacggcgatgctagctacactattcgcggttggtttgtgcaccaccccgctcaccttccaggtcggtaagggatccaagcctggccacctgatcctcaccccgaacgttgccaccatatccgacgtggagatcaaagagcatggtggcgatgacttctcctttacgctgaaggagggcccgaccggcacctggacactcgacaccaaggccccgctcaagtaccctctttgcatccgctttgctgtcaagtctggtggctaccgcatcgtcgacgacgtcatccccgccgacttcaagggctgcaccactttatagacgacactcagcatctaatcagcatcttgagatgaactatattttcaaagagc

SEQ ID NO: 65577 - DNA, 440 bp, Zea mays
  unsure at all n locations
  Clone ID: LIB3075-007-Q1-K1-F11
ggagaaccagcagcctccaataagagccagccagagaaactaataaaactctcgccgccgccatgcgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgncgcctcggggccctccgccagcagcggcgcgcccgccctcgccgccgcgcccgccgcgctcctcttctccctcctcgcctactacctccactaagcgtgtgcgtgcgtacgtacgcgcgcatggacgacgatggatc

SEQ ID NO: 65578 - DNA, 392 bp, Zea mays
  Clone ID: LIB3075-007-Q1-K1-G1
tatttttggtaaaagctagtggtggtacgtgctgatctcaacggtcatttgaaggcattgaaagattattttcttttagcaaaaggtgactttttccagtgttttcttgaggaaagccgccaattaatgcggttaccacctcgtcaatctacagccgaagcagatctcatgattccatttcagctggctgcactgaagactatcggtgaggaagacaagtactttaccagagtctcattaaggatgctatcatatggtatgaaaagtagcacgtctcagaaagatcttcaaaagcctaatgcttcagagctttcttcacaaggaaaagctgcatcagaattgacacttgatgggtgggatagtattgctctggaatattctattgactgggc

SEQ ID NO: 65579 - DNA, 459 bp, Zea mays
  Clone ID: LIB3075-007-Q1-K1-G7
caggttcccctaggagcaaatggttgtgcatattttccttttgaagacctttgtgataaacctttaggtgcagcagattactttggactctttaaaaaatttcacaccctggcacttgatggtattccaaagcttgggtctagtaacagaacagcagcttatcggttcgtcacactgattgatgttatgtacgagaacaaggcaaggctgttatgtacagccgaggctggaccagtaggactgttcgagaatatcgtgactgttgctgaagcacggaaggtttcaccaagatcttcacgctcacagaaaagcgacgacactgacctatgcgtggacaatgagcttggatttgccaaggatcgtacgattagcaggttgacagagatcaacagcagagaatatttggaggacttcgaaatgagattgaggcaacagcagcagctgcccttgcaaggtcta

SEQ ID NO: 65580 - DNA, 379 bp, Zea mays
  Clone ID: LIB3075-008-Q1-K1-C7
tccagctgatatcatccaaaacaagcccaatagcatgatccaaaaagagaaaagtatgtgtgttatctagcacgatgccatccttatctaacttgaactatttttagtatgtaaaatttgcattatagattttcttattggtactgaagaagttggtgattcttttgaggatatttcaggaagccctggtgttgaagctgcaaaggattttaatgcttctgcaaatgctggaacaagatcaagtgtagacactcatattagctggaacaacaagccaaaaattgcttcttgatgtagaggctattataaatcttcttcgttgtctgaaataatctcagcccgggacaccaattcaaaaacaaatgaagaagtcaagaca

SEQ ID NO: 65581 - DNA, 353 bp, Zea mays
  Clone ID: LIB3075-009-Q1-K1-E10
gacgtcgtgggcaccgagcctgcctgctacctcaccttgaacgcgcagccgccgcctgcgccacgcgtgaagaagcagccgcctgcgctccccccgaatcaccgcccggagctccgcgacttcggcggcgtcacgcagcctcagcacgggagcgcttcagcgtcgtcgtcgtcgtcgttgcggccgttctacaacttcatgccgctgccggttggtccagttcgctgtgagaggcccctgagcgagatcaaggccgacgtctccgacggcgtcgacctggaactgaagctgtaaggagcgcatataactggaaccctcactccctctggtggatgttccttcctgcaacggga

SEQ ID NO: 65582 - DNA, 465 bp, Zea mays
  Clone ID: LIB3075-009-Q1-K1-H4
tagttttgtctaataacaagggattgaagtgatgatcatcatgacaactcatttggtacatcgtctattgaatttttagaaagatccagcttcaccacatcacttgtctcccacgcggcagctggtacactggtcactccaaggccactcaagtccagttcctttgaagataaggacaagcgccttgctgcatcaacttggtcatctttagatggcgtgcttctggatcctgatgcttcctcatcagatgaaagccggctgcgcagatactctagcgctgccgacgttggtccagatgccatggaacttctatgcgtcctgattcgattgccagtaggcatcatctacgtgaatgaaaacattatcctaacacttactgcttgcattattgattggagcctacagatacagccgtagtctcaatctggattgacagatcaatcagtaccatctatgatgacttct

SEQ ID NO: 65583 - DNA, 181 bp, Zea mays
  Clone ID: LIB3075-010-Q1-K1-E8
ggatattgctgagttgggctggtcacgtgtgttctcatttctgtagcaggcatacagctttcagctctgccttcttctttcttttttttttctagcgtttatgaaattctatggaacttgtacgctgacgaataacaacgcaactctcacgaataacaacgccaattcttaaagttcatcg

SEQ ID NO: 65584 - DNA, 440 bp, Zea mays
  Clone ID: LIB3075-011-Q1-K1-F4
cgagaggagaaccagcagcctccaataagagccagccagagaaactaataaaactctcgccgtcgccatccgagcgaacaagccaaccgaccccgtccccaaggcaatccgccgtcgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgtcgcctcggggccctccgccagcagcggcgcgccctgcctcgccgtcgcgcccgccgcgctcctcttctccctcctcgcctactacctccactaagcgtgtgcgtgcgtacgtacgcgcgcatggacgacgat

SEQ ID NO: 65585 - DNA, 400 bp, Zea mays
  unsure at all n locations
  Clone ID: LIB3075-012-Q1-K1-F8
cccgggtcgagcgacgcgtncgcgatccgatccgccgagtgcacaccatcttttctcactccgatcgaatcgatggccggcgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccgtcgacggcgccgtcgtcgcctcgaaggccggttccgacgacgtgggtgccgccttcgncaacagcaccgncgtcttcggtgaggacctcaagaactgggatgcggacttcgtcaaggtcg

SEQ ID NO: 65586 - DNA, 325 bp, Zea mays
  Clone ID: LIB3075-013-Q1-K1-A9
gtggcttctcctccccttcgggtcgtgttttgtttcgggagggtctccggggtcgggttgcggggtgaagcgatccagaatgcggccttcgatgttgagtaccgctgcttcgtcggcggcctcgcctgggccacggacgaccactcccttcacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacg

SEQ ID NO: 65587 - DNA, 383 bp, Zea mays
  Clone ID: LIB3075-013-Q1-K1-G11
gtgtttatgcccgaactagataaatttgtggtgggggtcattggcgacatcttaatttgattgcgagaataaggaaaaccttcaaatcatcttcgaattgtgctgactcgacttcgggaacacaagttgtatgctaaattcagcaaatgtgaattttgggtggaccaagttcccattcttggtcatattctgtcagctgaaagagtagtcgtggatcctaggcaagtgacgaatattatagagtgcaaaccatctaccacgggtcacctagttcgaaagtttctttgggatgtctagatattaccatcaattcatccccaactttttcaaaatatccaaacctattactaaactattgaagaataatgtgaagtttaattgga

SEQ ID NO: 65588 - DNA, 344 bp, Zea mays
  Clone ID: LIB3075-014-Q1-K1-F12
catgagggagtgcatctcgatccacatctgcttttccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgttccccgtgctgtttttgttgaccttgagcccactgtcatcgatgaggtgaggactggcacctatcgccagctcttccatcctgagcagctcatcagtggcaaagaggatgcagccaacaacttcgctcgtggtcactacaccattggcaaagagattg

SEQ ID NO: 65589 - DNA, 401 bp, Zea mays
  Clone ID: LIB3075-015-Q1-K1-D12
ctcagaagtagtttccaactggtttctttcttctgagtttcaattggtctgtgggcgggtttgattattggttgggtcacacaatactacactagcaatgcatacagtcccgtgcaagatgttgcggattcatgcagaactggtgctgacactaatgacatttttggtcttgctcttggatacaagtcgattatcataccaattttcgctattgctgttaccatctatgtcactttctccattgctgcgatgtacggcattgcatttgccgctcttggtatgctgagcacaatcgcaactggtcttgctattgatgcttatcatcccatcagtgacaatgctggaggtattgctcagatggctggaatgagccacaaaatccgtgagagaactgatgctct

SEQ ID NO: 65590 - DNA, 284 bp, Zea mays
  Clone ID: LIB3075-015-Q1-K1-G2
tatggatcttgattctagccgccaccgctgatcatctgacatacgtcgagaagacgcctgctcctcgactatcgatacgaaggcgtctactacgaccttcacacacgtcgacagcctcaaataacctagaggctgaccctgacggcaaaacctattgcgccaggtgactacattactaaagatgacatctaggtctcggtctgggtaccatcaaaacctgactctgaggttacatatatgccataccgatggtacgagaccgtctctgacgatgtagcctcaag

SEQ ID NO: 65591 - DNA, 387 bp, Zea mays
  Clone ID: LIB3075-016-Q1-K1-F11
ggcggctgcggcggagcacggaggcgatttatgaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgagaggtcatttctatcctgatgcaacgccatgtacttgttgatggcaaggtcaggactgacaagacctaccctgctgggttcatggatgtcatttccatccctaagacaatggagaactac

SEQ ID NO: 65592 - DNA, 341 bp, Zea mays
  unsure at all n locations
  Clone ID: LIB3075-018-Q1-K1-A8
agcggctgcaccttcaaccacagatacgtgaaatccaacccgcgggaggtggagaacgcgacctggatgctgacggtgttccactgcttcggccactacttctgcctgcacttcgaggcgttccagctcgggatggcgcccgtgtacatggccttcctccgcttcatgggggacgagaacgaggccaagaactacagctacagcctcgaggtcggcgccaacgggaggaagatggtgtgggagggcaccccaaggagcgtccgcgacagccaccgcaaggtgagggacagccacgacggcctcatcatccagaggaacatggcgctcttcttctncggcgg

SEQ ID NO: 65593 - DNA, 370 bp, Zea mays
  unsure at all n locations
  Clone ID: LIB3075-018-Q1-K1-H5
taccatatcttggagccgtaggcgccattaagaggaagggagggagagagaaacgcgcggtcacccgtgagagagaaagaggagctcgtgccctagccgctgcagtaccgcccaggggagttccgtcgtagagagagaaccagggtgttggccgccgtcgtcgtgcacctgcggcgttccccggactcgtacggtccgtgtgcggtgcccgccatggagcgctgagcatgctcgttgcgtcatcgtgcgactggaactcgactcgttgccgaggacaatccgtcaattcgtcgtggggatcgagcttagaagcctcgccgcgccccgaggacattnacctggttctctctgtgaaaggttggccgatcga

SEQ ID NO: 65594 - DNA, 394 bp, Zea mays
  Clone ID: LIB3075-019-Q1-K1-A11
gcatcctgctgtgttagacctactgctgcgccatggcctagccggactacagcctcgccgacatcgcctaccacgtcatcaagctgggcatccgaccgtacattccgaggagctgaccttggccgatggcggacatcatgacgcggagctgggacgggaacccatacaaccggccggagatgtccaacgtggtggcgctgctggagaagatcgacaccggcagcttcaagggtggcatgacgcccgtcgacgacgtcttgcacgggtgcacctgcttcggcttcaaccgcatcgtcacctaggctagctctctagctcgtcagctcagacatcagttaaattaataataagctacagctaagtatgcatggccggccatgggcattgatcgatc

SEQ ID NO: 65595 - DNA, 371 bp, Zea mays
  Clone ID: LIB3075-019-Q1-K1-D3
tagcacgccagatgcaaacctatcaaatgtagaatgtcattagtggcataactcctgatatcatggaaaaccatcttgctgaaatgcagtatcagaagttacctcggaattttgtgcagtgggttaatcacggtgataccttttggtactaagatcgcaattactggaattcaatatgtcgccagcttcacagggtgggcattaacacggatctgagtagtagattatagagtgatatggatgctgcggcaaggcatttctcccgtgatatactccgcaccatccccaaagtcctttattggtccacgtgtttttacaatgggtgagtagatagatatctttctgttgaaagaaaatagagatgataatta

SEQ ID NO: 65596 - DNA, 460 bp, Zea mays
  Clone ID: LIB3075-020-Q1-K1-E4
cacggaaccagaaagcaaacgcaaacaagaagcaaaccagcaatggcccgcgcctgcgtcttcggcgtcgggctcctcctagccgccgtcgccatggcgccgttcgcgggcgcggcgcgcatcgacgtcgtcgagggcaggtccatggcgtccgcggacgcaccggaggccgccgccgacgctcccgctcctgctcctggccccgactcctcctcgaccccgtcgccggcaccctccagcagcagctcttccgactagccgcccggcagagatatctacggcgtccgatcagtctttggcgccacctataacctatcggatcctgcaaagctatatatgattctatggtataatgtgtgggtgcggcaaacgcgcggaaataatggtgctgcgtgattggttttctctctctttttttggttaataatggaaaacaggcatacggcgatgttttaacatg

SEQ ID NO: 65597 - DNA, 437 bp, Zea mays
  unsure at all n locations
  Clone ID: LIB3075-020-Q1-K1-E6
gaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgccgcctcggggccctccgccagcagcggcgcgcccgacctcgccgacgcgcccgccgcgctcctcttctccctcctcgcctactacctncactaagcgtgtgcgtgcgtacgtacgcgcgcatggacgacgatggatc

SEQ ID NO: 65598 - DNA, 454 bp, Zea mays
  unsure at all n locations
  Clone ID: LIB3075-021-Q1-K1-C7
aagctgaccagcatcgactgcagatgcagatgctgctgcaagatgcaggcgctatggcggagaagcgagaggggagagagagggccaaacaaagatatatcgagaagaggaagaatagaaggttctgcaagcagatcatgtatgcttctcgtaaggccagagcagacacgagatggcgagtgaaaggccgctttgccaagcaggcttccgctagcttctagtgatctccctgatctgctttcacagtcatttttgtgttgtcatctcgctcgcactttgctcaatccctcttcggcttcaacaacaaatttctcttgggtaatttattttccataatttacatatattttccctgcttgtcagatgtaatatttntctttcctttctttcaagaactaaatgcaattcaatacgtatgtggatcggactatatatcatcgataaacatgagtta

SEQ ID NO: 65599 - DNA, 453 bp, Zea mays
  Clone ID: LIB3075-021-Q1-K1-D4
agaagatcacaaaggctatgaagatggttgcagcatcaaagctccgggcagttcagacggggactgaaaatgcacgtggcttgtggcaaccgttcaccgtccttcttggggatgctcctagtgttgacgtcaagaagaatgtgattgtggccattacctctgataagggactctgtggtggtattaattcaacatcagtgaaagttagcagggcccttcacaaattgacatctggtccagaaaaagaaaccaagtatgttatattaggagaaaagggcaaagttcagctgttgcgtgactcaaaggacagcattgaaatgactgcaactgaactgcagaagaaccctatcaactacacacaggttgccgtgctcgcggatgacatattgaaaaatgtggaatatgatgctctgagggttattttcaacaagttccaatctgtcatatcgttaa

SEQ ID NO: 65600 - DNA, 316 bp, Zea mays
  Clone ID: LIB3075-021-Q1-K1-E1
tatatatatggtgtgtgtgagtgtgtttggaacttggtttaatttgtgctatcgctaaggcgtcgtcgttgactttctaaagggatttgatagtgttaatttgcctgtttgggccgataaacaaaccatgcgctcgtattgcacggcacggctggtacagtagttatacatgacgagtctaaaaccgtgctgcactgcacgtgtcgatacggttatcgtggccgtgtaaggccttgttcgtttgtgccggattggtgggtctgaacgattcctaaccggattgcttctctaatttatacaaactttgattagctgg

SEQ ID NO: 65601 - DNA, 452 bp, Zea mays
  Clone ID: LIB3075-021-Q1-K1-E5
cacggaatcgtcagcaactgggacgacatggagaagatctggcatgagaccttctacagcgagctccgtgtggctcccgaggaacaccccgtcctcctcactgaggcgcccctgaacccaaaggctaaccgtgagaagatgacccagatcatgttcgagaccttcaacacccccgctatgtacgtcgccatccaggccgtcctgtctctgtatgccagtggtcgtaccacaggtatcgtgctcgactcgggagatggtgtcagccacactgtccccatctacgagggatacgccctcccccacgccatccttcgtctcgacctggctggccgcgacctcaccgactacctcatgaagatcctgactgaacgcggctactccttcaccaccactgctgagcgggaaattgtcagggacatgaaggagaagctcgcctacattgccctggacta

SEQ ID NO: 65602 - DNA, 363 bp, Zea mays
  unsure at all n locations
  Clone ID: LIB3075-025-Q1-K1-A12
aagaagtcgcctaattctttcgatcgaattaggcgccttcttcgtcccacgctccgtctttatttgtaatctgaagctgacaggaacatttgagtggatcatggacggattggttggcctcttgaaagtccgggtggtgaggggcattaaccttgcctaccgcgacgcaagaggcagcgatccgnatgtcgtcctacgacttggcaagaagaaacttaagacgagcgtgaagaagagatctgtgaaccccatctggcacgatgagctaactctgaccgttacagatcccagcctagctctgaagcttgaggtgtttgacaaggacacgttcagcatggacgacccgatgtgggacgcggagat

SEQ ID NO: 65603 - DNA, 407 bp, Zea mays
  Clone ID: LIB3075-025-Q1-K1-E9
tagacactggctgctgctccgcaaggaaactgactcccccgaccgccgttcatgctcctggctggctcgctggccgcctcgacgggaacgctgccgcagaatgacgactggggctggtgttgttgttacagtatggtccttttctttctttctttctttcccctttcatccattaagctctgtgatgtagctgcccgtactgttgattcatgaaatcatgctagagattttttcctggcagtaagtgcgtgcctgtaaaactgtcgaactatttggacgaaagttgtacactgcagtatgatgtaaccatcaaaatctcccctaaaaaaaaaaaaaaaaatttaataatatttttatataacattaaataattttattttagtttttttaaaatacgttttctacat

SEQ ID NO: 65604 - DNA, 214 bp, Zea mays
  Clone ID: LIB3075-026-Q1-K1-B11
ggaaaacatgtgtgatcggtttcgtcttattttaattcgcagaaaacaagcactcaaatagggggggggcctcctgtctaaaaggtccaagcttaccttacgcttgcatactacaggcatatctgataatatagtgacaccaaacttgaattgactggctgaggctttacaactacgcgactgggaaaacgctgacaatattcaaattaataaa

SEQ ID NO: 65605 - DNA, 242 bp, Zea mays
  Clone ID: LIB3075-026-Q1-K1-C7
gacgggagcacacagctagctagccagccagccagcagccagcttgctcgccgcgcccggggttcttcctcgcctccgtgggggtccgttccgtcccgaccgccgccgccgtcgcattcagggatggagatgaagaacatcgcctgcgccagcctcgtcgccgactcggcggtcaccgtggcactcgccgcggaagcttctcatccagaaccgaccaggggatcctcaaccgtcgcgcccaa

SEQ ID NO: 65606 - DNA, 309 bp, Zea mays
  Clone ID: LIB3075-026-Q1-K1-E7
tagtgctgttgttatgcgggatagcgatggaaaatccaggtgttttggatttgtcaattgggaaaatgcagatgctgctgctcaggctgttcaagagttgaatggcaagatattcaatgataaggaactgtatgttggaagagcacagaagaagtctgaaagagagatggagttgaaggagaaatttgaaaagaatgttcaagaggtagctgagaagttccaaaacacaaacttgtatttgaagaacttagaggagaacattgatgatgagaaattgcgtgaactctttgctgagtatggcaatattac

SEQ ID NO: 65607 - DNA, 462 bp, Zea mays
  unsure at all n locations
  Clone ID: LIB3075-027-Q1-K1-A4
tgcggcttgagcaggagacgggagacatgggtagcttcgttaagctggcgaggagggcggtggagacggacgcgccggtcatggtcaagatacaagaactgcttcgaggggccaaggatgtcatgtcgcttgcgcagggagttgtttactggcaacctcctgagtcagcaatggctaaggtcgaaaaaataattagggaaccaacgcttagtaaatatggctctgatgatggtcttcccgagcttcgagaagcacttcttgaaaagttacgcagagagaataagcttactaagtcatcagttatggtcactgctggtgcaaatcaagcttttgtgaacttggtcctcactctttgcgatgctggtgattctgntgtcatgtttgcaccatattatttcaatgcctacatgtcattccagatgacaggtgttactgacatattagttggtggttctgatcaca

SEQ ID NO: 65608 - DNA, 466 bp, Zea mays
  Clone ID: LIB3075-027-Q1-K1-A7
gacagctgcgaacggggccatttttaggcgggagcgcgggcggcggtgctagcagattgggtggtttgagtggttgggccggctcttcgaaacgccccgccgcggcgatgggatgcttccattccacggccaagcggcagcatcctggctacgaggaccccgtggacctcgcctcccagacctccttcagtgttagtgaggttgaggctctattcgagctgttcaagagcataagtggttcagtgattgacgatggcctgatcaacaaggaagaattccagttagcattatttaagaatcagaggaaagaaaatcttttcgctaatcggatatttgaccttttcgatgtcaagaaaaggggtgccattgattttggtgactttgtccgagctctaaatgtgtttcatccaaatatcccaatggatgaaaaaattgatttctcgttcaagctatatgatatggatag

SEQ ID NO: 65609 - DNA, 468 bp, Zea mays
  Clone ID: LIB3075-027-Q1-K1-G8
aagcgaaaaagtgaagcctgttccttactatgttcaaggatttttgctctctcagagaaaaagcaataaaaaaaaaaaggaaaaaaaaaaaaaaaaaaaaaaaaaaaaaaaaaaaaaaaaaaaaaaaaaaaaaaaaaaaaaaaaaaaaaaaaaaaggcgatcagagcgaggcacgggaagggcaacgacagagccatgagttacaaaaaggtcccggagtcttatccgccaccagggtactggaagccgtaccaaccgcccaaggttcaaccgaaggggccttactacccgtcgccgaattaatgaattctggggtaccagggttactttaacgacggacagaaaccctacggttatccgccgccgaagggtgggtattacaataagggtaacaaccaccataacgaccaccatgaccataatcatggtaactatcactaacaccacgaatatgatgactgatgcctt

SEQ ID NO: 65610 - DNA, 456 bp, Zea mays
  Clone ID: LIB3075-027-Q1-K1-H2
aagccatatcgccaaaacgatggtgctcttctctctattgggacactttgtgatatactgaagcatacagatccatataaatcagagcttgagacaatgctggtccgacatgtctttgctgaatttagcagtcgtgttggacacctgcgagcaaaggctgcatgggttgctgggcagtatgcccatatcaacttttcagacccgaacaattgtcgtcaggctatgcactgtatagtttcaggaatgcatgatccagatcttactgcgagggttgattaggtctttgcacttcgttcatttgctgaagcctgcaaagatttaaatgagattcgacctatacttactcagctccttgatgaattttttacgctgatgaatgaggtcgagaatgaggatcttgtgttcaccctagaaaccattgctgacaaatcttgtgaagagatggcaccttatgca

SEQ ID NO: 65611 - DNA, 368 bp, Zea mays
  Clone ID: LIB3075-028-Q1-K1-C2
tagcaagtcgcagcaggtttccgcgagttccatcaggcactcgttgcaggacaggttgagtaaggtttccggcaaggggcggccggatgagatcactgtgaaattgtgcactagcacagcccctccattaaaactaattgacataccgggcgttgaccaacggagcacggatgaatcaataagcaactatgctgcacgcaacgatgcaattctactagttatcattccagctcttcaagcgcccgatgtggcatcttctcgagctctaaggattgccagagaattggactcagaaggtactagaaccattggtgttctaagcaaaatcgatcaagcttctggagaacagaaagccctgggtgctgttc

SEQ ID NO: 65612 - DNA, 318 bp, Zea mays
  Clone ID: LIB3075-028-Q1-K1-F4
ccagcaaagggagagcgtcgtggtgatagagataatgcggtggtggtgctcatggttggatgaatgggggtgtcgggctatgcgcggttgacgtcctcatcggagcaaaccccttcaccgttggttgcctcgtgccgtggcctgggaagtcgatgactgctcatcatggtaggaggccccgaccgaccgtgcaaccgtgtgccgacgctgtggctgtgcgccaatgaaatcacggtcaagaacaggtaccacaggatgaggcgcttggaggatgctgtgatgagttcgtgagtggtctaggccgtcgtctcccagtca

SEQ ID NO: 65613 - DNA, 77 bp, Zea mays
  Clone ID: LIB3075-028-Q1-K1-G4
tacactacctcacacgatacattctcttctcatgtacgagtacaattccaaggaattggcaatggattaaggacatc

SEQ ID NO: 65614 - DNA, 327 bp, Zea mays
  Clone ID: LIB3075-029-Q1-K1-C2
aagccaccaagcctgagggatggttggatgatgaaccttatgagattgatgatccttatgtagtcaagcctgaggactgggacgatgaggaggatggtgaatgggaggcgccaaatatgcacaatcccaagtgtgaagaggcacctggatgtggcgagtggaagaggccaatgaagcagaatcctgcttacaagggctagtggcatgcacctattgttgacaacgctaactacaagggaatctggaagcctcatgagatccccaacccttagtactttgagcttgacaagcctgactttgatccaattgctggtattgggattgaga

SEQ ID NO: 65615 - DNA, 253 bp, Zea mays
  Clone ID: LIB3075-030-Q1-K1-D3
cccacgcgtccgtaccatcccgacaaagatggagcatgtcttctacacttactccgacaaccttcccggcgtgctcatccaggtgttcgaaggtgagtgggccagtaccaaagacaacaatctgctcgtcaagttcgagctttctggcatcccttcggcgcccaagggcgtcccccagatcaccgtgttgttttacatggatgctaacggtattcttaacgtgttatctgaggacaagacctccggtcagaat

SEQ ID NO: 65616 - DNA, 425 bp, Zea mays
  Clone ID: LIB3075-030-Q1-K1-E2
taggtatcaaagctaaagaagctatggatatgggagagcttgtttcagataacttggttgtggggattattgatgaagctatgaagaaaccgtcatgccagaaaggtttcattcttgatggcttccctagaactgtcactcaagcacagaagcttgatgagatgttggcaaagcaaggtgctaatgttgacaaggtcctaaactttgcaattgatgatgctatattggaagaacggattactggccgttggatccacccacccagggggaggacttaccatacaaaaattgcaccttcaaagtttccaagagttgattgatgtaacgtggagagccattgattcaaaaggaggatagacacttgccgaggtttttaatgtcaaaggtttgaagcctttcacaaacaaactgagccctgggattga

SEQ ID NO: 65617 - DNA, 339 bp, Zea mays
  Clone ID: LIB3075-032-Q1-K1-C4
tattcgtccaaccgcaattgctccatccaaccttgaagagatgtatgcttcagacatgggtatgtcgccaagattctccaatgatcaagttcactcagtctactcaccagcacacaaatcagcacttctaaacaagtttcatcatcagcaaaagggcctactgtcgcctgtcaatactaacaggatatactcgcctaggggtcttgatccatcagttctccattctccatttggtggtatgtgtcctcggtcccctcggactatggagccagcatctcccttaactgtctgtgtcggggctactgctacgcagcgtgatatgttggatcagttctcttc

SEQ ID NO: 65618 - DNA, 201 bp, Zea mays
  Clone ID: LIB3075-033-Q1-K1-A11
taccatctgaacgaccaataccatatgatgattgaggtgtggaatccccttggagttgtgggtgttataacggcctttaaggggccttgtgctgtgcttggttggaatgcttgcattgcttttgtgccgtagaaatatgctgtcttgtgttaaggtgctcgaacatcttcactgatcactattgcattgaccaaaatattg

SEQ ID NO: 65619 - DNA, 429 bp, Zea mays
  Clone ID: LIB3075-033-Q1-K1-G1
tagagttcttcgagcaataagattcgctgctagattcaactttacattagatgaagatttgaaggaagctgcatctgatgaaaaggtgaagtcagagcttggcacgaagattagtagagaacgtatcggtcacgagattgatctcatgatgtcagacaaacaccctgttaaagcaatgtgtgacatccgcgatttggggctattttatgttgtattttcttttcctgaaaaatccaaccctcctgtttttgacaagtgtgattggcagtgggtttcacatattggagccacttgggatcttgcataatctattggcaggtgggtggtcaacaatgggtcttaactcaagtcgcaagatgagccaagaaagctgtacttggatagtgcattattcaacccccttcgaagtatggtctacctggacaaaag

SEQ ID NO: 65620 - DNA, 425 bp, Zea mays
  Clone ID: LIB3075-033-Q1-K1-G2
acgcagttaaccaacgccagagaaggagtgcgttgggagagagagcagagcgcagcgatgaggagagcagtgagggccgccgctttggggacttcttcaacaacgccatatgggctcgggaatcaggccggtgaccttcgcggggtcgacgtggattcgtctgggaccgcgacgggtgagtccgagaactggggcaccgctaatcgctcgccggacgtctggcgcgctcaccaaatcactgttcgccgtggtccggtctctgcgccacccgattgccgacgagcaagccaccgtggaatctgaggttcagcaagtagagatagctgagcaggagctcattgaatgagaagaacaggtggtcgaagaggagtcgcctaacactgaggagttcgatctgatctaagtggcgtttctcagttgacttt

SEQ ID NO: 65621 - DNA, 411 bp, Zea mays
  Clone ID: LIB3075-033-Q1-K1-H2
cttccagccgccgccgcgtccgcctcgccaagcgcagcagccgccgcagcacatcgctctcttgatctgagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctggccccatcaataagcctaccctggagatcattcacctggttaccgatgccaaccccatccaggtcgtcggcgacgccaacattaa

SEQ ID NO: 65622 - DNA, 398 bp, Zea mays
  Clone ID: LIB3075-035-Q1-K1-B12
tagctatagctatttcttctcgcctctcccaccggcccggtcgcccggagtagcaagcgtctccgagccgatccatcgtgcgagcatatgcacggcgatggaggcgagagcggccatgagctggtactgcggctcccttctggccgtggccatcgcgctgttcctgtccgtgtccctcggcgtgcgcgccgccggcgccggcgccggcgtcgacatcaaggtgtcgtgtgcagcgacgccggacccggacgtgtgcctacgcgcgctccaggcggacagcgactccaagaccccgcgggacctggcggaggcggcgctccgcgcggcgacgaccgcgggcggcgcggcgggcgactacgcgcggcacgagatggacgtggtgaaggacaacgacatgt

SEQ ID NO: 65623 - DNA, 474 bp, Zea mays
  Clone ID: LIB3075-035-Q1-K1-C3
tacgtcgatgatgttgtggaaggacgcgtggcacccgacaacagaattggaaggttcatctctgatgcttttgcttcggtgccgaaattgtccccggctgctttcgataagcttttcaatgacaagattcaggataaccttgcgctggtatacctgtcaagcatcacaaggacacaaatcagcatcgccgagaagttgaacactgctgctcaagtgctgtacggttgggcggtgtggcatctggtttggacgtggatggcttgatgctatctgggatgctgggcgtaagtgtgattggtgacagaaatgcatttttgtactcattattattattgctaaatgagagacctgatggaaagggttagccaacgatgagatcccataatgttgccagaatgccagtagagtggtggatggccagatgtttctggtttgataggattctgggctccagggttgatatttgtaatgctt

SEQ ID NO: 65624 - DNA, 353 bp, Zea mays
  Clone ID: LIB3075-040-Q1-K1-D3
aagaagttcaagctgtaaccagagcagtacattctgaaggttggtgaaggacaggctgcccggtgcatcagcggattcacagctatggatatcccaccaccccgtggccctctctggatcttgggtgatgttttcatgggagtctaccacaccgtcttcgactatggcaagctgagggttggcttctcagagtctgcctatggatatggtttggcagcaacccgcccagaggcaaacgcgtaatttgtgtgtttatgcgaccggcgatgtgtgtatatatgctactacatgtttagtgatgctttccgatacctgatactacgcccgtctgttttaacgtggcgcaagaataa

SEQ ID NO: 65625 - DNA, 450 bp, Zea mays
  Clone ID: LIB3075-040-Q1-K1-E4
cccacgcgtccgaagcaactgaaaacagccgttcgatctcctctccctctccctctccgatcgattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtcgttggcatctacgacgagccgatgacgcctgggcagtgt

SEQ ID NO: 65626 - DNA, 197 bp, Zea mays
  Clone ID: LIB3075-042-Q1-K1-F3
tatcattctgtcaagaggaaaccttggaattgaccttccacctgagaaggtctctttgttgcaaaagtctgcgcttcacaaggtgcaacatggctggaaagcctgctgttgttactcggtgtcgggacaggatgactgacaacctcaaaactactcgcgcaaaagcaactgatgtggcaaatgccagtcttgatggg

SEQ ID NO: 65627 - DNA, 391 bp, Zea mays
  Clone ID: LIB3075-043-Q1-K1-B12
tacgagcaagccttaacccggcaagactccaccaccggtcttttctacgactgctccgcccacatgctctgggtcggcgagcgcacccggcagcttgatggcgcccatgtggagttcctgagggggatcgccaacccccttggcatcaaggtgagcgacaagatggagcccggcgagctggtgaagctgatcgacatactgaacccgacgaacaagcccgggaggatcaccgtcatcacaaggatgggggcagagaacatcagggtcaagttacctcaccttatccgcgcggtccgccaggctggacagagtgtcacctggatcactgacccgatgcacgggaacaccatcaagactccttgcggacgaaagactcggccatttgactcca

SEQ ID NO: 65628 - DNA, 377 bp, Zea mays
  Clone ID: LIB3075-043-Q1-K1-F12
tccagatcgagaagaagaagcaggacgacgccctcgacgacctcagcggcgtgctgggccagctcaagggcatggccgtcgacatgggctccgagcttgacaggcaaaacgaagcgctggatcatctgcaaggcgacgtggaggagctcaactccagggtgaagggagcaaaccagcgtgcgcgcaagctcgtcgccaaataggccgcctagctcgaacgtgggagcttgcgcattcctgggtctggtttgcgccacgattcaccctcgccggctgattgcttgctgtaacatgcatgtattcgctctccattgcattgcattgggagcgttttttctgttcaacagagaatgttctttctccttgcattgttcacc

SEQ ID NO: 65629 - DNA, 270 bp, Zea mays
  Clone ID: LIB3075-044-Q1-K1-A1
atagactgtactatttacattaggatagaaagactggttaccttagcctaagaccaggcaaaataattacaccccgtaagtcaagaatatggtcacgacacaggtcacagcgagctgaacaatctgcagtcaaaaactggcagctactagccgctactgacaaacagaattcacatgactagctggccaaggaccccctacaaaaagcaacgactcatcacttgggtccaagaattcgaggttttgtttgccagtactgatccaagcgct

SEQ ID NO: 65630 - DNA, 318 bp, Zea mays
  Clone ID: LIB3075-044-Q1-K1-B1
tatgtgagttcgttggtcttgatgctgaaatggagattaaggagcattattttgaggtctgtgacattatagatggcttattcgtatcaatatttaaacacttgtctgaaaactgcaagaaagaactcgaatcaataaacaggcagtatccatttgaacctctgaagtatctagacaaaaccttgaagctcacttatgaagaaggaattcaaatgttgaaggaagccggaacagaaatcgagcctatgggtgacctcaataccgaagctgagaaaaaacttggtcggcttgtcagggaaaagtatgacacagattttt

SEQ ID NO: 65631 - DNA, 266 bp, Zea mays
  Clone ID: LIB3075-044-Q1-K1-H8
aagcaagcaaccgcgtgccttttggagacgcgatgtcgtccggcaacaagatcagcgtggccttgctgagcgtgggcctagtgggcctgctcctctgccacctcgccaccaccgccttcgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccgggg

SEQ ID NO: 65632 - DNA, 216 bp, Zea mays
  Clone ID: LIB3075-046-Q1-K1-C2
tacgcgacgattgcctggacagtgcctgcgattttttccgcgatactcctgactctcatgtgggggctgaccgttaagcaggaagagccaaaggccatggattcgaaagcttctactcctggagctttattctacatgatctcgataacatcatcggccaatagctagacagacagcacgtaagctgtgcaccgaggcacgtccatcggcgttcga

SEQ ID NO: 65633 - DNA, 390 bp, Zea mays
  Clone ID: LIB3075-046-Q1-K1-E8
taataagatggcgtgtatagacaatgctatgagagccttgttccttttagcgctcttctgtgtcgtgcatggcgagaaggctaagtcaaaggacaacgatgcaaaagcgtgcggtcccggtgggtccttcgacatcaccaagtcggtcgccttcggcaatggcaagacggatagcacgaaggctgtgcatgaggcgtgggcatcagcgtgcggagacaccggtaagcagacgatcctcatactcaagggcgacttcctcgtcggaccactcaacttcacaggcccatgcaagggcgacgtgaccatccacgtgaatggcaatctgctggcgaccacggacctatgccagtacatggatcatggtaattggatcgagattctacgcgtgga

SEQ ID NO: 65634 - DNA, 442 bp, Zea mays
  Clone ID: LIB3075-046-Q1-K1-F6
tatgttggagagattttttttacccgagaagctgcgccgcgccccaatctgatcatctgcatgcgctgaagatcgttggtgcccgccatgcttcccgatgattgctgccacatcgtcgctgaggaaatttcaagccccatagctgcacatatactcgacttctactacggcgacgacggcctgggcgatgacctctttgccgcggtgactgccacctctggcccattccctgccactgacgatgatgtttcttcgtctaccgctaccacccctcctatctgcggctacagtgaagacaccgcagctgctggtggagccacagcctacaccccgttgacatccttcgacaccactctcacagccctcctggaggaagagcagcaccatgggcctgaaccccgggtccttccgcaaatcgatggcctatcagaggtagcagcat

SEQ ID NO: 65635 - DNA, 406 bp, Zea mays
  Clone ID: LIB3075-047-Q1-K1-C1
tacctacatgaacgcggggattcccaagctgttcaaagaggatgaggagaaagaacagcttgcaaaagatgtcgcaaaagattggaatgctgtgtttgaaaggagcatcaatacattgtttttgactgaaatggtccgtggcttgatgctaactctcaagtacttctttgatagaaatgtcacaattaactatccgtttgagaagggtcctctgagcccccgcttccgtggtgagcatgctctcagacgttatgaatctggggaagagcgctgcattgcttgtaaactatgcgaagctatatgcccagcgcaggcaattacaattgatgctgaagaacgtgaagatggcagtcgccgaaccacaggatatgatattgacatgaccaaatgcatttactgtgggttc

SEQ ID NO: 65636 - DNA, 380 bp, Zea mays
  unsure at all n locations
  Clone ID: LIB3075-047-Q1-K1-G1
gaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgccgncgnctcggggccctccgtcagcagcggcgcgcccgtcctcgccgtcgggcccgtcgcgctcctcttctccctcctcgcctactacctccactaagcgtgtgcgtgcgtacgtacgcgcgcatggacgacgatggatccgttcaccgt

SEQ ID NO: 65637 - DNA, 436 bp, Zea mays
  Clone ID: LIB3075-047-Q1-K1-G2
tactaagaggaccaacacttgagaaaagacctgggaactgggaagcagtcactagccatcaattttgacagagtagatccagcaccatctgttcattgaacttgtgagctcgatggatgggtttttctgcagttagcggggtttagttaagttcgaaggataatgcagtagacaacgttggtcacgtgtggtggtgaggttccaagtaagagagagcatcacactcacgtaacaggaatgatcattgatggattgaggcgccttaattgaaattggtgccttccacctcatggatgcaggttaattcttttcttcgttgattttttgacccctcttgctttgtccttctgtcaataaggacatacacaggttaaaattcaaattctttgctcttagttgttgcacattgattgtcctatcactattatgttgatgc

SEQ ID NO: 65638 - DNA, 436 bp, Zea mays
  Clone ID: LIB3075-047-Q1-K1-G6
catggctgcggtgatggggctccggcgagctattcccattacccagccacatctaccgttgaattgagagttgttgaactacaacatgcgctcaaaaacctcttagccccttcccctgagcccgaacaacgccgagggcgtgatacattggcggcgacaacctctctttctctcactacctctgacctatctgcatgcatcaagcgggatgctcatgggtttcatcacgtgaccatggtttgagggcaatggatggaggggcctcgagttttatactcccagaccacgtggatcaggatttaaccggtgatcgatctccgatgattgagggacgcttaggtgcgattcggatcgagatcgacttcaggtagaggaaggtcctggcggctggggcccaatagcagatgcgtgcgtgacgcgtgtgagggcagtctga

SEQ ID NO: 65639 - DNA, 443 bp, Zea mays
  unsure at all n locations
  Clone ID: LIB3075-048-Q1-K1-A1
gaaggcagagggcgacggccaggaggaagcggtcaatagaagacaaaattttaccctaaaagagactagaaaaaacatctccgactatgtcatcgtcggcgttcggcgacttcggtccgctcaccgagcgccgccgcgctgagaaggcgcggcagcagcgcaggcgcatcatgatcgccgtcgggactgtctccataatcgccatactcatcgtcattggctggtacgcggtcatgaacagcgggaagaagtcgtccagcgacggtgaccacaaccacaagtcttcgtcgtcgcgggccaaaggcaagtccagcggcggatcggactcggaagcggaagcggaaacggaaacggaatcggggtcggattcgaagacggatctgaaggctgtgtncaagagcatcaaagcgatgtgctcgcagacagactacacggacgcgtgc

SEQ ID NO: 65640 - DNA, 439 bp, Zea mays
  unsure at all n locations
  Clone ID: LIB3075-048-Q1-K1-A2
cgtgcgggcatacattttggaatccttgagcagactggaggaaaatcttggcatttacacaatcagacttgcttctggtgacgccagaaattgtcaagaagacatactgtttgaagatcaggcaagagctgatgcatcgccttccagctgtgacgagtcgagtggtgtagcaagccttaaaattcagatttctctgttgaatataagactgagggcacttgaagaggatcaggagttcctcaatcaggtattgagttcgctccaatgtggtagtgatgggctgcagtgtatacaggagataagcaggcacttagcagagttgcgaagagttgtggctcactaaaatgaaaatggttttgccccgagttcacactttntggccgtcatgaggttctcctttgtaacggcaaacctatttgcagtcatctagatagcaggc

SEQ ID NO: 65641 - DNA, 440 bp, Zea mays
  Clone ID: LIB3075-048-Q1-K1-A3
atcgcccgcaccaacacgcattgctgtcgaccgcaacggcagtgtgaagaatgcttccgtcgctagggccaacttgacatctcctcggccatcagagatcatctctgccagggacagcaattcgacgacccagcaagaagtgaaggcgctcctctctcagatgtcatctgtacggggcctcgatggttcttccagtgaaggatctcctagccccggtaccagcgctccgaacgaagagagcaaccctgcgactgcgagcaagaggccgtatctcgagaggaactactccgtgctggaaccttcagaagggagccagctcgccgacgacgtggaatgggaaagctctctcgagaacgtgaagaaacagcttgagatcaacaagaaggcgatggccgctctttacaaggagcttgagggagaacggagcgctttcgcggtcg

SEQ ID NO: 65642 - DNA, 326 bp, Zea mays
  Clone ID: LIB3075-048-Q1-K1-A4
gcgtgcgaatttatttatgctgatttatgcgatgccaaagctgtgaacaaaattgaagccttccgggtgcgggaggcaaccggggaagaactctaccatctccaatgttctctctggatagcggatccacaatggttcttcccagaacccgggcaggctctaattgatatatgctgagtcaggcgacgccaatgctgttaacaaaatagtctactagaacccattcgatgctcttatgcactttgatgctgctgcttatgttgaacagagcacactgtatccactcaggctctaccacaccgtaacgcttaacacgttggcagttc

SEQ ID NO: 65643 - DNA, 458 bp, Zea mays
  unsure at all n locations
  Clone ID: LIB3075-048-Q1-K1-A7
cgggnnaggaagggggggtcgacccaaacnaacgctttttttggttttttcctccacaagttgaccgcccggctgtgtcgatgcgccgaggggtcaggttcatggangggaagggtgatcacatcgccgtgattgtgggcaccgtgaccgacgacaagaggatcagcgaggtgccggcgatgaaggtctgcgcgctcaggttcactgagacagcgagggccaggatcatcaatgctggcggagagtgcctcacctttgaccagctcgcgctccgtgccccacttgggcaaaacacggttctgctgaggggtcctaagaacgctagggaagctgtcaggcactttgggcctgcaccaggagtgccttacagccacaccaagccttatgttcgctcgaaaggtaggaagcttgataaggcgagaggaaggaagaacagcatgggctttaaggtctaagtg

SEQ ID NO: 65644 - DNA, 418 bp, Zea mays
  Clone ID: LIB3075-048-Q1-K1-A8
actcggcgatctttcttccttcctctgtgatccattctccagcgcagcgaagtaaacgtgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtcgttggcatctacgacgagccgatgacgcctgtgcagt

SEQ ID NO: 65645 - DNA, 416 bp, Zea mays
  unsure at all n locations
  Clone ID: LIB3075-048-Q1-K1-B1
cgaccacgcgtccgtctgaggtgatgacaacagcttgtagcgagtcattgacctcatctatcactatgctcatgggatcctagcaagagaccaaagnacagaatcctccagcataccttcttcagggttgtacatgtgttccgcttcctgtccgtcggaaagcttcatcgcttcctaaaacacctccatgtgttggatcaaagagaatttccgagaacagcgttgctagaagattctcgaccgggactctatctacgatgaaatctcatagcaatgcacctgcaaaatcaaacggtttatctaggactggtgtacaaagaaaacttcacttggatcgtcagccaccgcagaagagtacaaaaccgaccgataacagcaatatgctagctacaaatcgggtcccagcccggaacagc

SEQ ID NO: 65646 - DNA, 453 bp, Zea mays
  Clone ID: LIB3075-048-Q1-K1-B2
ccggtcgaccacgcgtccggaccagttcatggagtgaccactccgggataacattgcagccatgagggtggaatgggacgcgcttagctaattaattagaagaacctgggggtgtagttggctttgccggaagggccatcaatgagggccgggcgcgtagtgctcgctctactaaggtggggtgcagaggttcaattgatttggttttgttagtcacctaccttggggaggtgtactgcgtttgtacgactggcgaaacctaacgagcagctatgcaccaggggagtctttgtaaaggctatgtagttgttgggggctttcgtcttctgaaggtcctcaaaaacatgattaacaatgttttcccaagtgtaatatatatatacaggagccttcggaatcggaatgaagttgtccacaatacgaaaagcatggttggtacgaaggtcataacca

SEQ ID NO: 65647 - DNA, 445 bp, Zea mays
  unsure at all n locations
  Clone ID: LIB3075-048-Q1-K1-B3
cgcgtcgcatccgctccacaggatcctctgcgccaccgcaaccgtgtgaccgcccgtgccggcggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggaggagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgnatncattcgcgcctaccggtccaagatcgaggccgagctcgcccgcatctgcgacggcatactcgcgctc

SEQ ID NO: 65648 - DNA, 435 bp, Zea mays
  Clone ID: LIB3075-048-Q1-K1-B4
cggacgcgtgggtctcaaggacatcaatcgtggtctgcgcacagagattaggcaaaggatgggcgaggatctggacagtctggacttcgacgagctgcgcggcctcgagcaaaacgtcgacgcggctctcaaggaggttcgccataggaagtaccatgtgatcagcacgcagaccgatacctacaagaaaaaggtgaagcactctcacgaggcgtacaagaacctgcagcaggagctaggcatgcgggaggacccggcgttcgggtacgtggacaacacgggcgccggcgtcgcctgggacggcgcggcggcggcgctgggcggcgccccgccggacatgtacgccttccgcgtggtgcccagccagcccaacctgcacggcatggcctacggcttccacgacctccgcctgggctagcgcatccatcaccatgc

SEQ ID NO: 65649 - DNA, 435 bp, Zea mays
  Clone ID: LIB3075-048-Q1-K1-B5
cgagtccgacgacatgggctatgcatttacgctcaaggatggcagcgctctatagcttccgtgtctccttcactgtctccaacaacatcgtttcaggcctcaagtacaccaacacggtctggaagactggagtcaaagtggagaaccagaaaatgatgctagggacattcagtccccagcaagagccgtacgtttacgagggtgaagaagagaccacacctgctggcatcttcgcaagaggttcctattctgctaagctaaagttttttgatgatgatggcaagtgttatttggagacgagttactactttgagattagaaaagagtggccagggccagcaacctaatgatatatggagcggcggtgttggattcgttaaacacatacatgttagaactcttagttaagacaagcagaagatctattatattcta

SEQ ID NO: 65650 - DNA, 399 bp, Zea mays
  Clone ID: LIB3075-048-Q1-K1-B6
cgactaccaccgtttcaccggcgacaaggactgcgacgatgcattcggcggcgtggaggcgtgacctcctctaccaccacctctccccttccacctcggctgccatcgccgccttcagatccgcctcccagcccgggctcgctccccaagggttgtttggagcggatggcgcaagatgcatgtctgcgatggcgccggcggtcaaggggtccgggcatctcgtccgcatgggcaccggagggaggtcttctgtgagtggaatcgtagccaccgtgtttggagctactgggtttcttgggcgctatcttgtgcaacaacttgccaagatggcgtctcaagtgctctgcccattcagagcgtgtgaggattctcctcgtcacctgaagactatgggtgact

SEQ ID NO: 65651 - DNA, 424 bp, Zea mays
  Clone ID: LIB3075-048-Q1-K1-B7
cggacgcgtgggcataaatgtctacccctcctgaatttttggaaagcactggtggtcttcatgactctagagaatctacagatgttgagtcagtaatccgaactgtcagattagtttctgagagtcttgcgagacacatctatggattgagagggaggaatatcgatgtttttgcagagaatagcagcttagccatcaatcctcgctacgtccggtcctggttggatcttttgtcacggacaccacgagtcgcaccttttctacagaagaatgatcccttcatagcagcgctgaaaaaggaactgtccgagcacacgtctgatgtgcatgttcaaagtgatgcgcttgaaggcatgttcactttctatgatacaactaaagcgactctaaatgtgtaccaggttgcaagtgttacctttgatct

SEQ ID NO: 65652 - DNA, 365 bp, Zea mays
  unsure at all n locations
  Clone ID: LIB3075-048-Q1-K1-B8
ccttttcgtccgtttattcttncnnnatcatttgtccaccgttcgggggggcggctgttggggctactgccgctgcnncagcggcttcagctttcgccggagatgtgagagcctccgtgccgttggagatggctgcggttggggcagggaccgggagcgaggtgatagaagctgggcgcgtcgcggagcttgatcctgctcgacgcggtcggggaggagcagctgctggacgccgataagtacgccatcatgcgccgcgtttacatcaacgcgcgcgacctccgcatcctcgacccgttgctattcctacccctccacaatcctaatgcgccagcgtgccatcgtcctcaatctcgagcatataa

SEQ ID NO: 65653 - DNA, 441 bp, Zea mays
  Clone ID: LIB3075-048-Q1-K1-C1
ccgcatccacaacctgcctctctcgtcccctggcggcgtccgcggcaggatggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatgtcgatcccaagggtggacgcctcatcaccaaccaggggag

SEQ ID NO: 65654 - DNA, 426 bp, Zea mays
  Clone ID: LIB3075-048-Q1-K1-C10
tattgcttcagtggaacggcatgcatggtcccctctcccctctaggtttactggcggctcgtctgcggcgagttctcatctgtctgtcgaggcattgatcgatatgtttgcttcattttcctgcttcctgccttgtgattatctggtgtgtgtgtgtgtgtgtgactgactaagtcgcggcgattaggtaactcgcttagaacgtatttcccgtgtttgagcaaaagaaagtatccctgttatctctgttccataagttatacatgacgtaatcgtactaagtttatttttacttatatcacttgaatggaaaagtatgcttcccatttaaaaaacacagacctaatcctgtactaggaccatggtaattggatcgagattctacgcgtggataacctggtcataaccggcaagggaaaccttgac

SEQ ID NO: 65655 - DNA, 439 bp, Zea mays
  Clone ID: LIB3075-048-Q1-K1-C2
ggaagtcaagtatgccgcggcagctatttgaatttttctggtgaaggagcctttgagaaggtattaatggaatttcatggtgtgctcgataggcatagcctactgctacaggcttgtgaaacagactctgtctcccagcaagacttgattgacttgggtagagctggtcttggtacctgtttgcttgctggtttgcctgtatggcttgttgcttacacagctcacctggtacggtttatataccttgagaggcagaagctccctgatgagatcttaaggcacaatgtggatgagaagcgacagttccttatagaaataaacatggattctgagaagaatgatgctgaggttcaggcagagggagtactaaattcaagattacagcaaatagtgcatacacttgacaaggtgagatatgttatgagatgcatatttggag

SEQ ID NO: 65656 - DNA, 444 bp, Zea mays
  Clone ID: LIB3075-048-Q1-K1-C3
gagctctactgctcaccatggatcaagtgccgaagaagatggccatattgggttggccacactatcatcgatatgacctgccaaagttttgggcgtgtaaaaaaggttgcatatcattattggcggatgccggattcttgcagcatcattatgtgaggatgaatgcatgcgtagttatacggctatacccttcctgcctgccttcatgagcaactgaccgattctttggtttaggcggtctgtttttctagaatggatgtatgtaccttccgtgtgcgtgtgggttctggtaaatggtgaaagttgggtgtgattacttgtagctcacagttacatattgagggggtactcagggcccgtttggatacatctagctaaattttttaggccccatgtttgaatactagttagaaacattaaatatagtctaaaactaattacaca

SEQ ID NO: 65657 - DNA, 397 bp, Zea mays
  Clone ID: LIB3075-048-Q1-K1-C4
catatacatcctcgctctccttctcgccgtcgccactctctttgcgcgcgccacgccgaaaggtgagctgccgggcgtcgtctatagacgtcgagcggggcagggccgtgagctttgggagaggaggagataattaatggcggctaaggagagtagtaggacgatggcggcggcgcgctctgcgggaaggatcggggtcgtggcctctgtggcgatgaacctcgcgtggcttgcgatgtacatccgccagcgctacggggagatcaccacggtggaggcgtcccgaggcaagccgccggtcactcaggactccgtcgtcatcctcgatcacggcgacccggtcatgtacgaggagttctggcgccgcgagggagacagcgcctcgatcctgatcccc

SEQ ID NO: 65658 - DNA, 382 bp, Zea mays
  Clone ID: LIB3075-048-Q1-K1-C6
aggagaggagcttaaaagcaaataggcgcgccatactacatcgagtgcagctcaaagacggaactaaacgtgaagggtgtcttccatgcggcgataaaggttgtgctgcagccgcctaaagcgaagaataagaaaaaggcgcagaggggggcgtgctccattttgtgatctaataatgatcagtagacaaaagaaacaagggccaaagtgccatgggtctattatatccgcgtcttgcgttaacggaacaaccatggatgataccaccccctctcccctatatattactgtggggtgtgaagagatctaggggttttagagagatatatgtgtgttatattcctcccttccgccccgtgagaatatcgcgtgtgtgtgtgac

SEQ ID NO: 65659 - DNA, 275 bp, Zea mays
  Clone ID: LIB3075-048-Q1-K1-C7
cttaccctaaatcttaagttctatataaactatttctatattcatatctttcaccatgtatcctccatatacatatttaaagttatatatttataaaaaacagaacaacttatattttccattcttctattaattacatccatcacattttttttttcaataaattcccatattatttaacatttttaccacttttttaaattgggcattcaatgattttcataacttcatgattaacacacctattctaaatatattacatattcttttactat

SEQ ID NO: 65660 - DNA, 409 bp, Zea mays
  Clone ID: LIB3075-048-Q1-K1-C8
cggtacgcgtgggggaaccacagaccacaaaggaggggacacacacggacacacacaccgtggccgcccgcccgccgcgacgcgccatggctatggctcgctccgtcgcgcacctcttctttcccatcctccttatctccaccgcgcccgccgtgcgggccatcaccgacgccgccggcggccccggatacctccaggaggcgtgcaacaagacgctgttccccaaggtgtgcatgcacgcgctcaaggacaacccatagtgccaggcggagacggcggtcaccccgcgccggctggccgagctgctcgtgtacgtgtcggccgaagtgggcatgaccgtggccgcgttcgcgcaccacgagctcaacgccatcaaggacgacgacgtcctgtacaagtgcatcgacac

SEQ ID NO: 65661 - DNA, 426 bp, Zea mays
  unsure at all n locations
  Clone ID: LIB3075-048-Q1-K1-D1
tgcaagcaagccatgggcatgagcaccaccactgacctgtccgcgccaccccactccgccacgctgccctgccgcatggcctcctcctcgtcatcttcctccgtcgccccgtggccgcgtccagacaagcaccgcggcgcgggcgccctggtccgccgcgcgcagctcgtcctgtcgcgcgaggtcgggtggtgcgggcagcgcgcgtggcggaagctgctcaggcggctggcgcaggagaccaggtgcgtgtgcagctccccgacggcggcggccacgggtcggcccatcacgttcggctacgacgccgccagctacgccaagaacttcgacgacgggcgcagncccgcgccgcgccgcgtcgtcgtcggcgccaatgcgggcgataaaccgagcggcaacaactgaccaccccatcgacgttct

SEQ ID NO: 65662 - DNA, 308 bp, Zea mays
  Clone ID: LIB3075-048-Q1-K1-D2
cgtgcgcgagacgacgacactcgatcgttgtccctgtatttccaccaccaccgtttccgacatcgctagggtggattgtcaacagtgctgcctccctccatatccgcatcgccatccttgccttcgtctagagactctatccttcacgccacgcctactacagcccccaccgacttctactatgcctccatgcagtacaccaagtaccctgagcttttcgtcaagtactcatcctcctcggcgccgaaagcaaatgcgaatgctgatcggagaaaacaaactgcactggtcggactagcactatccca

SEQ ID NO: 65663 - DNA, 442 bp, Zea mays
  Clone ID: LIB3075-048-Q1-K1-D3
caagatccaggacaaggagggcatcccaccggaccagcagcgtttgatcttcgctggcaagcagctggaggatggccgcacccttgcggattacaacatccagaaggagagcaccctccacctggtgctccgtctcaggggtggcatgcagatctttgtgaagacactcactggcaagacaatcacccttgaggtggagtcttcggataccattgacaatgtcaaggccaagatccaggacaaggagggcatcccaccggaccagcagcgcctcatcttcgccggcaagcagctggaggatggccgcaccctggcggactacaacatccagaaggagagcaccctccacctggtgctccgcctcaggggtggcatgcagatttttgtgaagacattgactggcaagaccatcaccttggaggtggagagctctgacaccatt

SEQ ID NO: 65664 - DNA, 257 bp, Zea mays
  Clone ID: LIB3075-048-Q1-K1-D4
gcagctgccacctctcggttgcaggagttcccgcctggaggtggtaatggtggagggtatcggccaccaggtggcccggcagatggagatgttgaaaaccaagcagattggaaaggatacttcaatgttgcatcttatgctccatacttcaatgttgatactgatgttgtagttgacaggctcattagttcagtttatccaatggatgtttttacaggaaaatgatgctatcctgacatgtatgggcctttgtggat

SEQ ID NO: 65665 - DNA, 426 bp, Zea mays
  Clone ID: LIB3075-048-Q1-K1-D5
gtttgtaccacatatctgtgggtacagcacctagaaggttcacactgtcctgacaaaggagggcaagaaccacttgatcaagaaggatgtgccttgtgagactgatcagttgactcatgtttacactttgatcatccgtcccgatgcaacatacagcattctcatcgataatgaagagaagcaaactggcagcatctatgagcactgggatattcttccccctaagcaaatcaaggacccagaggctaagaagcctgaggactgggatgacaaggaatacattcctgaccctgaggacaagaagccagagggctatgatgatattcccaaggaaattcctgaccctgatgctaagaagcctgaggactgggatgacgaggaagatggtgaatggactgcccctaccattcccaacccagaatacaa

SEQ ID NO: 65666 - DNA, 411 bp, Zea mays
  unsure at all n locations
  Clone ID: LIB3075-048-Q1-K1-D6
ggtttatcaaggtgtacgacaaggagctgattgcggcgctgtacgtgcaagtgagcatcaggagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggtggcgccatctgggcgttcagcgtcgtcacctacttcccgctggacgtgctcaagttcgccatccgctacgcgctctccggcatggcctggaacaacatcaacaacaagacggccttcaccaaccgcaccgactacngcaagggcgagcgagaagcgcaatgggccacggcacatatgacgc

SEQ ID NO: 65667 - DNA, 427 bp, Zea mays
  Clone ID: LIB3075-048-Q1-K1-D7
gccgtcacttcctttctctcgcgcacccgacgtcgcatcctctctcgtgcagttggggccagctgttgggccgaggtcgacgacggggtcgacctctccgtggagacagccaaggcggccgtgagccacgccgccacgagccaccacgagcacggcggcgagctcagcgatctggagtcggatctggtggggcggcagaagactggctgctcgtcgtcgccggcggcaacaacgccggctgcagagctgatcgtgccgccagcacagcagatctagcaattccaggtggtacaaaagggtttttcatcaacaagtggtcaccaaaagaagaactgaaacatcaagatggtgtttgcttctacattttaccattgaggatatgatgctaaactgaaataatgtattatgctatgcattcagaagatga

SEQ ID NO: 65668 - DNA, 414 bp, Zea mays
  Clone ID: LIB3075-048-Q1-K1-D8
cggctcgtcctcctcgccgtcgtggcgctgttgtccgccggcctgctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaggcgctcacgttctgcgacaccatgtacatgaacacgcaggacaccatcggcgcggcgcagcgggccatcacgttcaaggacaccggcaccgccaagatcatgctgcagctc

SEQ ID NO: 65669 - DNA, 443 bp, Zea mays
  Clone ID: LIB3075-048-Q1-K1-E1
cgacgctagccgccgctaggaccttgagcgcggctgccggctgcgctcgcgcgggcatgcgcggtgcggacggtacctgagcgcaacgacggatgggcagcgacggcggatgcagactgctagccgcgtccgccgtcgaacgccgccgctcgtccgctccttcgctcggccagaagggaggaagacagaagggatactaggggttctactccggcggtaggtggggcagctgccccaccgtgccgcatggggagctccgcctctgctggcggatgaaatgatcctgcggccttctcttctggccgtcgcccgccctctcagcaccgtagccgtcgcggcggccgtccgccgcggtgacctcgccggcgcggaggaagccttcgcgtcgacgcagctcaagaccacgaccacctacaactgccttctcgcgggatacgcgaagg

SEQ ID NO: 65670 - DNA, 411 bp, Zea mays
  Clone ID: LIB3075-048-Q1-K1-E2
gttgctaaggaggagaccaagaagctcggcaccgtgatcggtatcgatctcggaaccacctactcctgtgtgggtgtgtacaagaacggtcatgtcgagatcatcgccaatgaccagggtaaccgtatcacaccctcatgggttgccttcaccgatagcgagaggctcatcggtgaggctgccaagaaccaggcagctgtcaaccctgagaggaccatctttgacgtcaagcgtctcatcggaagaaagtttcaggataaggaagtccagagggacatgaaacttgtcccctacaagattattaacaaggatggcaagccatacattcaggtcaagatcaaggatggggagaacaaggtcttcagccctgaggagatcagtgccatgattcttggcaagatgaaagatact

SEQ ID NO: 65671 - DNA, 421 bp, Zea mays
  unsure at all n locations
  Clone ID: LIB3075-048-Q1-K1-E3
cgtagagagaaggaaaaatattcccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccncggtgtgctctccatggccaacgccgggcccaacaccaacggctcccagttcttcatctgcaccgtcgcg

SEQ ID NO: 65672 - DNA, 302 bp, Zea mays
  unsure at all n locations
  Clone ID: LIB3075-048-Q1-K1-E4
gcgtccggcttggacactcgtccttgttcattgcgattgatctactaaatattccttacccctttgagttcttagctctatggctagaaacatgctctttcagacccaatcntcatgtacctgtactccaactatgtcccctatacctctactactaccttgcgctttgcacattctagaacagcgttatcaattcccgttagccaatccactacatgttctccaccttttaccccgtcttctccaagttattgtccatgtcgatgacttcacccgtgacatctatcccttctcctattcca

SEQ ID NO: 65673 - DNA, 409 bp, Zea mays
  Clone ID: LIB3075-048-Q1-K1-E5
cgtgctttcgttattcttctcgatcttaattacaggtcatagctgagcaggtctgacagggggtcgtggcagacatacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaaca

SEQ ID NO: 65674 - DNA, 277 bp, Zea mays
  Clone ID: LIB3075-048-Q1-K1-E6
catatatctagaagtaatactacttaaataatccttatttctttaatttcttagctctatagctagaaacatgttttttggcaactacaaacaattttcgagctatacagctaacacccctcttgtttggcttaaccgatagcgataggctcattggtgagggtggcaccaactagccacatgtcaacactgagagggccacctacagtcttaagcgcctcatcttgcgagagtttcatgattaggaagtccacatggacatgcaaccttgcccctt

SEQ ID NO: 65675 - DNA, 370 bp, Zea mays
  Clone ID: LIB3075-048-Q1-K1-E7
cattctcttgggcttactcgtgcgcagactctgtggactccccagagatagcatagcagcagcgactcacaatagcaaaaaccaccatccgtcgtcgccaaccgtatcaagaacatcaccaccgcccagcaataatggcgcatagcatgaggattgtggcgctggccctggtggccctgctggtggtggcggcggctgcgcccgtggccaccgcgtacggctgctacgacgactgctacgagcgctgcgccaacggcaagaaagaccccgcctgcaccaagatgttcataccaggcgtgcggctccacggatcagggcgccggtgacgacaacgcctcgccggtttgatcctttagcacattcatcgctt

SEQ ID NO: 65676 - DNA, 419 bp, Zea mays
  Clone ID: LIB3075-048-Q1-K1-E8
aaacaacaggatcactatcgagaagctggtctagcacccctggttcaagaaggggtacaggcgcgccgtcatgctggcacagccgcacggctccagcagcctcaaggatgtccaggtcgccttcagcaacgccgaccacaaggacagcagcaccaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccataaaccggcgtcggcgatagtgtcaaagctggagcagatcgctgagacagagcgcttcatggtgaagaaacaggacgggctggtgaagctgcatgggtccaagcaagggaagaaggggc

SEQ ID NO: 65677 - DNA, 432 bp, Zea mays
  Clone ID: LIB3075-048-Q1-K1-F2
cggacgcgtgggtatctccagagtgcaggcatctaatttcgaggatttttgttggcgatcctgctacgcgaataacagtccctgaaatccggaatcatagttggttcctgaagaaccttcctgctgatctgatggatgatgatagcatgagcaaccaatatgaggagcctgaccagccaatgcagaccatggatcagatcatgcagattttaacagaggccaccataccacctgcctgttctcgcagtataaatgtcctagctgatggactggacatggacgacgacatggatgatcttgattccgactcagatcttgatgttgacagcagcggtgagattgtgtacgcaatgtgagtaacatctcagcagccatctcagcagtcaaccaaggaaccaatcatgcatgggatgccctgttgtatactctggc

SEQ ID NO: 65678 - DNA, 420 bp, Zea mays
  unsure at all n locations
  Clone ID: LIB3075-048-Q1-K1-F3
caaggaggcgaacaacttcctttggccttttaagctgaaggccccgctgggaggtctgaagaagaagaggaaccactatgtggagggtggtgatgccggtaaccgtgagaattacatcaacgagctcatcaaaaggatgaattaggttcacgaccaagctcattgtgttctaagaaactttctgtgctctcccaattttacattattaggaagtggatgaatatgcatgcagttttgttgtttggaactagatgtgtatggaagaaatatgatcttttttcccggaggtttagaattatatatttagggctagtttggaaacttcattttccaagggatttctattttgcctaggaaaaatgaactgngcttcccaaactagcccatgatgcatttcccatcctgtgtatcgggcctttt

SEQ ID NO: 65679 - DNA, 444 bp, Zea mays
  Clone ID: LIB3075-048-Q1-K1-F4
gggacagtatcaagaaggctgctaatatgcttgagagggtgcaggggctatgcctcaaggatcgctataatttttgctgggctccggtaaatataagggatccaaaagccatgtaccatcttttaagatttgccaccaactattctcatagccgtcgtgttggcatcgcattgggaataccaaggggttctgcaaaaaatgacgctgagcttctggaccttgagacaaaacatcaggtcctatcaatgtatctatggttgtcacatcattttgaggaagataactttcctcatgtgcagcatgctgaaaacatggcaataaatattgctgatttacttggcaagtcgcttgcgaaagcatgctggaagcctgaatcaagacagcaagttagggggcgacgagaaggaaaggatgagtacaatgaggaacaagcatcaaatgaaa

SEQ ID NO: 65680 - DNA, 391 bp, Zea mays
  Clone ID: LIB3075-048-Q1-K1-F5
gttgttgcggtggttagcacagcgtaaagactcaagcgacacctgggcaaagccagccagtgggcatgcgtgcaacacaagaggcttatcacatcccaaacacgcgacacgccacaccggccgcacacgaagatacaagactgttcatccacgaaatcgtctggccacgtacaatcaaggagatagatcgtgggaggagagacgatgcaccgttcgtcgagctactacctgcagcagtcgtcgtcatcgtcgtcgtgcgtgtcatcgtcggtagcggcgaccggcggggcggcatcgccgggtccgagctcgacggcgggcgtgatggatgtggaccatctgccgacttatgacccgcggtcggacttggccaaaaaggatgccctggatg

SEQ ID NO: 65681 - DNA, 423 bp, Zea mays
  Clone ID: LIB3075-048-Q1-K1-F6
gaataacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcg

SEQ ID NO: 65682 - DNA, 421 bp, Zea mays
  Clone ID: LIB3075-048-Q1-K1-F7
cggtcgcgtgggagaaacaacaagactgacagcgacgatgatgcgacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgaccacgggccccggcggctggtacaggatggagatcagcggcgaccaccaggacgagatctgcgacgtgcgcctgctcaagagccccgaggcggactgcgccgagatcgaccactcccgcgaccgctgccgcgttccgctcacccgcaacgacggcatcaagcagagc

SEQ ID NO: 65683 - DNA, 291 bp, Zea mays
  Clone ID: LIB3075-048-Q1-K1-F8
gtcctgctcttgtgatcggcaatcttggcaccaccacggcctttcgctcaaggagccagccgtgtgcctgccgaccagcccagaggcgtcaaggccgcggctattgacagttaggtcggggtcggagccagccgtcgaggcccgatgggcagcaggacgacgctgcccctattaataaagccgccatgcgtgtgcccggcactgcacaacatccatcgtccatcgacccacccaaccttctcctccgccccgcgcttcgcctgggtaccggcgtccgccgcgccccgtacc

SEQ ID NO: 65684 - DNA, 438 bp, Zea mays
  Clone ID: LIB3075-048-Q1-K1-G1
cggctctgggagtggctctattccattatacagctgatatccggaatgagcccgctcggccaaatggaccggacctgagcgctctcgttctctctcacgcgagcagtgcatccttgagccaccgccgccgtgaggagctccgcccgtccgccgtcatccgtcaaatcaggtggccatttggtacaggcgtcggactcccaggaggatgaccggtggcaagaggttcggcggcgggcgggtgccgacggggaccccgtccctcgcgtggtcgtccgtcgtcatcgtcgcctccctcctcgctggcgcctccatcgtccacaacatctacaagcctgacatgaccattccacctgtggagggtgccgccggcggcgagcgaggacaacaaagatgagctacgaatggctggacactgcatgcaagagaggaagctgggca

SEQ ID NO: 65685 - DNA, 442 bp, Zea mays
  Clone ID: LIB3075-048-Q1-K1-G2
cactaatccaagacaaaacatggctgtgaatgtgagaaccatgtggtcgtcgatgcgggcacatgttgcgatggctgtggcgttggtgttcttggtgagcggcgcatggtgcggtcctcccaaagtccccccaggcaagaacatcacggccacctatggcaaggactggttggacgctaaagcgacatggtatggcaagccgacgggtgccggtcccgacgacaacggtggcggctgctggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtaccacttcgatttagcaggc

SEQ ID NO: 65686 - DNA, 177 bp, Zea mays
  unsure at all n locations
  Clone ID: LIB3075-048-Q1-K1-G4
gcgtncggtaactggcagcacctcgaacttctttggtgtgtttaacacggtttgagaccgtcaaataattttgtcacatttcgtgcggttcagaaattctttcaacattggaatggagccaagaattgtctgtaataatcaacatcagcattataacagtatgtaggggtttatctc

SEQ ID NO: 65687 - DNA, 423 bp, Zea mays
  Clone ID: LIB3075-048-Q1-K1-G5
caatggcgcgcaacctgtctgtcacattgtttattctgacggcctatgtcgccgcgacggcggcaccgaccgtctgtgcggtcaaatctccggcgagcacaacgaccacaaggaaacacgaagcagccaaagaagagacggatgcgcctgccaaggcaccagctgctgcagccaccgaggggcctgctgcgggagcgcccatgacatggccggatggcgggcctgagttcgtcaagatggtcatcaagaaccccttctttaaaagcgcacctccatctggtagcgaagacggcctacccattgaccccactccagaaggcagcatgaactaaattaaataccaattacgagaccgaccagatatgcatggagcatgcaagaatgttgtcgaacgaatatatgctatgaatggttacatgtact

SEQ ID NO: 65688 - DNA, 147 bp, Zea mays
  unsure at all n locations
  Clone ID: LIB3075-048-Q1-K1-G7
ttattaaacaagattttacattctgcgggggccttcaaccattgatggactcaccaangttcatgagtattttatctatagatgatttttcagtatgccccacagtattaccggtttaataaatgatacattaccttttttatagtt

SEQ ID NO: 65689 - DNA, 326 bp, Zea mays
  Clone ID: LIB3075-048-Q1-K1-H2
tcgaccacgcgtccgaacgtatatcttagatagtttaattttgataatgggtccaagatatatcaccctatgcatgttcctagtacttgtgttacatggagatacaactttggcagaaacttgcaggcagtttgttaaatgggatccattctgctttagtgcaatgtgcaaggcaagttgttttatagagggaaaatccttcgatggttcctatgtaaaggggcacagatgtgaatcaaatggatatcacgctgtgtgtgtttggtttctgtgtaaaaatttggtatctaatgacatgcggatctatcttcttttggtcctctctg

SEQ ID NO: 65690 - DNA, 372 bp, Zea mays
  Clone ID: LIB3075-048-Q1-K1-H3
atttgaaaacatatctgatgacagttacagtgctgtggttcatttccataattggaagctgcttcagtttcttgactgtgtcttacactattttcctgatggcatacactctgcccatgttgtatgagaaatacgaagatcaagttgatgtcgtaggcgagaaggccctcattgagataaaaaagcagtacaaagtgattgatgcaaagtttatctctaagatcccaatgttgtctgagaagaaacaacactgagagagggtgctccaaaggtctaattcagcacattaccaatatatgaaagtagttcctttggctttgctatatcatcatttagcaacctttaagatgataccatagatattatatggat

SEQ ID NO: 65691 - DNA, 226 bp, Zea mays
  Clone ID: LIB3075-048-Q1-K1-H4
agatacatgagcttatcactgaagggggctgacgaatgaaggattctttaagactttgacatgttcatttatttctgggcacatacttgaaaccacatgttgccattcttgatggcattactatgagtggtggtgtacggtttttcattcctcgaacattgcggggttgaactgataggacaggctttgtaacttcataacttcatattgtacttcattctgatgc

SEQ ID NO: 65692 - DNA, 339 bp, Zea mays
  unsure at all n locations
  Clone ID: LIB3075-048-Q1-K1-H5
gtccgtttttttgcataatcaaatgtatttgaagattggcaggctctgaaagctgcgggtgataacaggctgtaggaaacattaactttcacatgacattgtatacccaaatgacccattatcaaagatcaatgttgatgatgancctgaagcttttttttacgtgaaataaagctgccacgtgacatggccgacataaataacgaactatttatatacggtttcaagcccatgacaaattctgccaaacgacgagcatctgcccacatcaatggcttaaaacccaaggctatatccaataataatcttcgagagatcacaaaaaggaccaagcttact

SEQ ID NO: 65693 - DNA, 232 bp, Zea mays
  Clone ID: LIB3075-048-Q1-K1-H6
tccaagatatatcaccctatgcatgttcctagtacttgtggtacatggagatacaactttggcagaaacttgcaggccgcttgttaaatgggatccattctgctttagtgcaatgtgcaaggcaaggtgttttatagagggaaaatactccgatggttcctatgtgaaggcgcacagatgtcaatcaaatggacatcacgctctgcgtgttcggtttctgcgtgaaaaatta

SEQ ID NO: 65694 - DNA, 400 bp, Zea mays
  Clone ID: LIB3075-049-Q1-K1-B1
tatggctcttgggccgtttgtttcacatacggcacttggtttggtgtgaagggactaattgctgctggtagaacatttgagaacagtcctgcaattagaaaggcatgcgactttctgttgtcaaaagaacttccttccggtggttggggagaaagctatttgtcatctcaagaccaggtttacaccaatctcaaaggcaaccggcctcatgcagtgaacactagttgggccatgctggcgctgattgatgcaggccaggccgagagagatccaacgcctctacaccgagcagcaaaggttttgatcaacttgcaatcacatgatggagaatttcctcagcaagagatcataggagtgttcaacaagaactgcatgataagctactcccagtacaggaaca

SEQ ID NO: 65695 - DNA, 433 bp, Zea mays
  Clone ID: LIB3075-049-Q1-K1-B10
tatgacccctaccgcaagcgttggatctcggtgcccaagatgccacctgacgagtgcttcatgtgctcggacaaggagtctttggctgtgggcaccgaactacttgtgtttgggatggcacatattgtcttcagatacagtatactgacaaactcttggtcacgaggtgaggtgatgaactctcctcggtgtttattcgggtcggcaagcgttggtgagaaggcatatgttgctggtggcactgattctcttggcaggatccttagctcagcagagctatacaactctgagacacatacttggacacctcttcctagcatgaataaggcacggaaaaattgctctgggttgttcatggatggcaagttttatgtaattggcggtgtgacaaacaacaacatggtattgacctgcggtgaagtgtacgatgtgc

SEQ ID NO: 65696 - DNA, 389 bp, Zea mays
  Clone ID: LIB3075-049-Q1-K1-E3
cccttcatcttctcaccagcctcctccgacacggaaattgcaccgatcgagacagagggaacaaaggcaacagccatggcgggaacccgtgccctgtacctcctcgtcgcggctgtcgcggcgctcttagccacgcctgcggccgtggacgcggccacgctggcggagatctgcaggggaaccgcgttccccgacatctgcaccagcacggtggggagcgaggcgcatagcgccggggtgttggacgccatggcggtgttgcggatgcaggtggacgcgttcaacaagcgcaccgaggcggcgagggcgcacgtcaaggaggccgccgtgacggcgtcccccaaggcgcggacggtgcttgacctgtgcaacaacctgtacctggacgt

SEQ ID NO: 65697 - DNA, 426 bp, Zea mays
  unsure at all n locations
  Clone ID: LIB3075-049-Q1-K1-F4
caacatgcgaagaacaaggtgcagtacataaaaataaaggttctaaatccaaactgaaaggactgcgccattttggcaagtgggataaggacaaggataaggaagatgataagaatggggctgaggacggtgaagatggtccggttccgatttcagtcttcatggttgcaagtgtcctcaaggagaagagagaaaagctgttacaagaagccagaggactggatgatcttatcaggatattgaacgatgtaaatgggaacttagatgctaagaaagcttgcgctggagcattgaaacttcacaaaaaatacctgaaaaaggtacaagcaaagaaaccttaaacgtgccatggaacacacgtccccaatggggctatctgtaccatttcaacatacacgaccattntctacacacaactttgagtga

SEQ ID NO: 65698 - DNA, 351 bp, Zea mays
  unsure at all n locations
  Clone ID: LIB3075-050-Q1-K1-D2
aagcgagacaggctcangaggaggctctctctctctcctgtcctacctgttcgctcccgggtcccctccatctctttcgccacgcgcgcgagaggggggagaggaaacagctagcagcgagcgaggaacgaagagggtgcttcgcacgtgcatgtgagatcgggcgatcccgatcgtcggccggcgcgaattgaactaacgacgacgtacgtgcgaccggggcgggcgttggattattccggcctgagcaatgggcaagatcgagtacggcgtggtggcgcgcggcgcggtggtgctggcggancactacngcgcggcggcggcgggcggcaacgcgggcgccgtggcgcg

SEQ ID NO: 65699 - DNA, 305 bp, Zea mays
  Clone ID: LIB3075-050-Q1-K1-E10
ggtgcttgttcgtatggaggctggtggcgaggattttgcgttcggattagaactcctaatgcttaccttttaaatagaggtggcatgggtacaataccaagcacttgtacagcaaccacatgtaacttgaaaaagaaggattcttggaatattgctggtgcaaaatatcgattgcttctgggacctaagggacatcacgaacaagaaatggctattcccgcttgggctcatgaccctcatcttctaagccgaaagcactggtgacaccagcatttctgtgcttggcaatgttgaccatccctact

SEQ ID NO: 65700 - DNA, 455 bp, Zea mays
  Clone ID: LIB3075-050-Q1-K1-E6
aagcaaaccgagaggtgaaccagcagcctccaataaaagccagcacatccaaataaaaccgagagacctcagccctcaggcaagcgcgaccgccgacgtaccaccgcgccaacccgagagaaagatggagatgatcaagaggatcctcatcgccgcgctcctcgtagtcgccgtctcggccaccgcagtgctggcctccaccgaggccgccgccgccggcgccccagccgccttcgagtcgtcggcgtccgccgaagcccccgctggcgccgccggcgccggcgccggcaccggcaccgtcgcggggccctccgccagcggcgccgtgcccgccctcgccgccgcgcccgccgggctcctcttttccttctcgcctactacctgcactaagcggacggacggactgacgcgcgcatgggattggcatgcatggactgttgaacatctattcatgc

SEQ ID NO: 65701 - DNA, 324 bp, Zea mays
  unsure at all n locations
  Clone ID: LIB3075-050-Q1-K1-G4
tagatccaagtccatagactaacatagatcccgttatcaagatgaatacaatcaattcctgacctcgcgcgagtgctagaaaaatcactcgacttctaccgagatcctgattagcaaagcagctactcgacctagcatactagtattcatctcaacaaggaatcctaagttcatgcaactagaggtttcaagcaactcctacacttaagtgcacattacaatcctacaagcattaagtgtagtaaagtagcatataataatacggtgatgcatataaaccagggcttgcctttaatagctggggctgcggngagatcctcgata

SEQ ID NO: 65702 - DNA, 387 bp, Zea mays
  unsure at all n locations
  Clone ID: LIB3075-050-Q1-K1-H3
aagccgtcgccgacgcccgactcgtggaagctcaaggagatcttcgccacgggcatcgtgctagggacctacatggcgctcgccacggcgctcttcttctacctggcgcacgacaccgacttcttcaccaacgccttcggcgtgcggtccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcanggcatcggctggggctggggtggcgccatctgg

SEQ ID NO: 65703 - DNA, 446 bp, Zea mays
  unsure at all n locations
  Clone ID: LIB3075-050-Q1-K1-H4
aagcaagcaaccgtgtgccttttggagacgcgatgtcgtccggcaacaagatcagcgtggccttgctgagcgtggccctagtgggcctgctcctctgccacctcgccaccaccggctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcanagtgtggccaagcctacccacatgcatgctattgcatgcctccgaatatata

SEQ ID NO: 65704 - DNA, 461 bp, Zea mays
  unsure at all n locations
  Clone ID: LIB3075-052-Q1-K1-E8
taatttacccgaagccgcatgaagagagaggagagcatcgccgccgcgtcgagcatgtggcaaccggtgtctgggtcgcagggcagaggggcgttggtgtccgctggtgccaagggtcatccgcgtgcaagcagctggtcgcacgcgtcctcgaatttccggaggttcttcgccgaagcaccctgcgcgcctgcttcgcggtccgacgtggtcggcctatttgggcacccaattgaccggagaagaacaggtagcccaggaggagccgcacaacgaggagttcgacttgatctaggtggcgtctcctagtcgactttgtggcgccaaggatggactttagttcgctttatatttatcttttattttgcaagacttaagctatgtaataaatacttttatgatattatgacatttatctctatacactctgntatttatgtgttgtcttctttggcgcatat

SEQ ID NO: 65705 - DNA, 314 bp, Zea mays
  Clone ID: LIB3075-053-Q1-K1-H7
gacgggcacaagatgcccgaggcgcgcgacgaggacaggcagggcctggtcctcaactggctagaggcgccgcttgacgtcgacatcaagaacggagggcgcgtcgtggtcctcaacacccagaacctgccgctcgtcaaggaggtcgggctcggtgctgaccttgtcaggatcgacgcccactccatgtgctcgcccggcttcttctgcgacttcgcctaccaggtcacctacatcgtgcgcggcaatggccgcctccaggttgttgggatcgacggcacgcgagtgctcgagacccgcgccgagggaggctg

SEQ ID NO: 65706 - DNA, 415 bp, Zea mays
  Clone ID: LIB3075-054-Q1-K1-A10
tatcaagaatatgtgaagggcatatcgtcaacagggatgcaatccaattgtggttttgaagggcaagttaatgcatgctggactcacaagatgactactaaggaactagatacaatacggtttgccggttttctagtttcagttattcatggaaggtacgatatcattgcacaattgtgccatgcaaaacgtctagcagaaaggcttcttcctgttgcaagaatggtagtacctcatggtgcacatctagtaagccatgaaagaccagacgaggtgaacaatgcacttatggatttgataaaggccaccaaatctgcgataaaacctgaagagtggtcagcccagcccgagaacacgttggaaaccggggcgctcatttctgcgagacccatcaacgtcacggtgcgaacagatg

SEQ ID NO: 65707 - DNA, 143 bp, Zea mays
  Clone ID: LIB3075-054-Q1-K1-B8
taccagaccataacgtcgcatgcgacgcatacgtacgctcggaattcgactcgagtcaatatacacatgtcgatccttaaccgaacatcggcaacatctatctgtgttcctggacgccaaaaatagcaagtggcaccataaac

SEQ ID NO: 65708 - DNA, 350 bp, Zea mays
  Clone ID: LIB3075-054-Q1-K1-E11
tacctgcacctactcccgcgagctcgccgcctgcagaagtgaagtcctattcttcaccaaccccaggtggctcaccaccaccagcgccgaagtcgacacctgcacctactccagtgagctcgccacctccagaactgaagtcctctccaccaccaggcccagttagctcaccaccatcagcgccaaagtcgtcacctacacctgctcctgtaagcttgccacctactgaagtaaagtcttacccaccaccagcaccgattagctgtacaccacctgcggtcaagtcaccacctacaccgggccctatgagctcaccttctacccctgtgaagtctgcaccttcagcagcg

SEQ ID NO: 65709 - DNA, 319 bp, Zea mays
  Clone ID: LIB3075-055-Q1-K1-A10
tgacggccgccgcgccgctcgcgccggacctcctggcggcgttcgagcgcaagttcccgggcgtgcaggtggaggaggcgtacgggctcacggagcacagctgcatcacgctgacgcacgctagcggcggcggcgaggacgtggggtcggcggtgcaggtcgccaagaagaagtcggtcgggttcatcctgcccaacctggaggtgaagttcgtggaccccgacacggggcggtcgctgcccaagaacacgccggtggagatctgcgtgcggagccaggccgtgatgcagggctactacaggaggaaggaggagacgga

SEQ ID NO: 65710 - DNA, 429 bp, Zea mays
  Clone ID: LIB3075-055-Q1-K1-A11
taccatctgaacgaccaaaccatatgatgatggaggtgtggaatccccttggagttgtgggtgttataacggcatttaatgtcccttgtgctgtgcttggttggaatgcttgcattgctttggtctgtggaaattgggtcgtctggaaaggtgctccaacaacttcactgatcactattgcaatgaccaaaataggggctagtggattggagaaggaccacttgccaggggcaatttttacatctttttgtgggggcactgtaattggtcaagcgcattgccctttgcacttggatacctttgggttcattcactgggagtgcacgggctggtctaatgggtcagcaacaagttagtgcaagatttgggaaatgccttcttgaacttagcggaaacaatgccatcattgttatggatgatgtagatatt

SEQ ID NO: 65711 - DNA, 230 bp, Zea mays
  Clone ID: LIB3075-055-Q1-K1-D2
tacacgcgtcggttgtaagactgatgtattgttcatacagagagggatgttgcaaattgcgtggcagcgtaagcatactggcatcgtgaggacttggacaggatcaagaagcgagcattgggcaatggagcgtctgatagcactttcgatgatcacgaatggttggtgataccattcgagcgctctgggaagcagacaattcttatacataagggtgacttgcttgtagg

SEQ ID NO: 65712 - DNA, 346 bp, Zea mays
  Clone ID: LIB3075-055-Q1-K1-F3
taaaaatcaaggctacacaccaacttactttctaggtctcaaattaaatggcctcctcgtcctcctccttgctgctggcgtcgatggcggtggcggcactctttgtcgtcggctcgtgtggcggcgcgctcaccttcacgatcggcaaggactccagctccaccaaactatccctcgtcactaacgttgccatctccgaggtgtccgtcaaggaaaaaggcgccctggactggtcggatgatctcaaagagtcgccagccaaaaccttcaccctcgatagcaaggagccgattaagggccccatctccggccgcttcgctgtgaaaggtggtggctaccgcgtcgt

SEQ ID NO: 65713 - DNA, 398 bp, Zea mays
  Clone ID: LIB3075-056-Q1-K1-A5
cccacgcgtccgtgaacaatggcgtcagcagccaccttccttctgatcatcgctgcagccgcatggacatcgctaaccgacgccgctccctcaccgcctccattcgtcccaccgccgccgtgcgcaccgccgcaatcggcggtggcgtttctccgcgcgcgctgtgcaaccacgctgtacgccgtggcctgctacgagtccctcctcccgtacgcgtgcatattccagaccagccacgtcaagctcgcccgcgccgtcggcgacgtcaacgcggcctggctccgctcgatctccaagcgcgtcaaggagctcgtcgcccgcggcgctgctggtggtggcggcacggccggcggtgccaagtcggctgcgctccgcgactgtgccagcacggtctcgtc

SEQ ID NO: 65714 - DNA, 450 bp, Zea mays
  Clone ID: LIB3075-056-Q1-K1-H5
tgacgtccgcatgcgtcgcatacgtaagctcggtacacgtctcgagctgccagatccaattcgcgagttcttgctactactgcgccaggtcgctgtgtgagaggaagacctccactggacaggagttccaagtcaaggatctcgtgcacgcggactatggtcatcctcgacattgagctggccgaggactaaatgccctgactgatcgcatgccgctactagatcggaccgtccaagcatttaacctactctaggatctactaggatgctgacatgaccattcataccgtcgtcctaatcgagactctcaccgatctcggcgccaatgtacgatggtgctcatgcaacatcttctccactcaagaccacgccggcgacgtcatcgtacacgacttgatcggcgggttcgcctggaatgtggagacccctgatgattactggatgtgcacc

SEQ ID NO: 65715 - DNA, 472 bp, Zea mays
  Clone ID: LIB3075-013-F1-R1A
acgggatccaaaatccaccacgatgagcagcggtggcgggcggaaggcggcgagccccggcggcgaggaggcggaggtggaggcgcttatccgggcggcgcaggacgcggtgctcctgaagctcaaggcgaactcccacctcgtctcctcggcctccagccctccttcgctcgacgcggcggaactcgatcccctggacagcgacctcgcccggcgcttcgacgcgctcaagtcccgcgcggcgcgccgaatccgaagccggccggagccggagccgcccttggagggatggatgagctggaggcgcggttcgctgcgctgaagggggcggcggggcccgagaaggacacgagggtgaggctggaggatctgggaggggactcgtcggaggacgaggcggacgaggtggacaaggtgatgcgctgggccatgggatgccgcgcggctcgacgtcgctgcggcaggctccggc

SEQ ID NO: 65716 - DNA, 356 bp, Zea mays
  Clone ID: LIB3075-022-A3-F1A
caaaactctacgtgctcatcgttcggcagcatatttccacattactcatcgtctcgtagatactatcaaaaacggcgaggggaaaggcgtaatagcaaacggtccgcgaaatcacgacaccgacacagacacggacacggagcactctcgtcgtccaaaataacgtcccgcactacgaacaagcggcgctgttcacggctccagcgatcaccgtccacctgatcacgacatcgcgggatcccggtacaccgggcctggactaagcatgacctatcagtaatcgttcacctgcatcggcgccgcagctcctttacgttcaacgtcgcgaaaagcgggctcaaaaacggcacacatcg

SEQ ID NO: 65717 - DNA, 479 bp, Zea mays
  Clone ID: LIB3075-022-A3-R1A
gggagctggcaccagcaccagcaccggcaccagcggctcttcccgtgccggatcagtgcaacgccggggacggcgaccgcgggaggaaggccggcgtcgctggtcccggcgtgtgcagcggggcgcggagacgggtggccaagggcgccggtggcccggcgagcaccaagttccgcggcgtgcggaggaggccgtggggcaagttcgcggcggagatccgcgacccgtggcgcggcgtgcgcgtctagctcggcaccttcgacaccgcggaggaggccgcgcgcgtctacgacaccgccgccgtccagctccgcggggccaacgccaccaccaacttcgccgcgtccgccgccactaacagcggctccggggccggggccgggcaggacctggcgacgacaccggcagcaggctacgagtccggcgcggagtcgtcgccgacgtccgtgctccgcaaggtcccctccctgtcctccctc

SEQ ID NO: 65718 - DNA, 471 bp, Zea mays
  Clone ID: LIB3075-043-D3-F1A
aagcgaaaaagaggtgatatatatctgtatgtcgcccatccaatggaatttctcctacctaaagtacaagattgggtccgacgcagcaaagatcgacgacgtcggcatcccatcggcgaaccacgagacatcgccaccgaacgcgctggcggcgcctcctaggtcgtccccttgttgctcctgttggtgaggcggcgccggcggcagggcgaacatctggacccatgatcatcctccacgttgaatcgttaattacgtactctactaattacggttacgtactcgctgaaccgaatcaacggaagtaattatgtgttccaaccataattattaaagacaccagacacctacgtacgtctacgtgttgttgcatgttggaggccgacggatcgaacggggccacgtggttgcacagcaaatatttctttcgctcctccacgcaagtgagggtgtccatgaagaatttctcac

SEQ ID NO: 65719 - DNA, 479 bp, Zea mays
  Clone ID: LIB3075-043-D3-R1A
atcttcggggtgatcgattacacagcattatgggtcgcgtgaagctacagatcaagaggatagagaacaacaccaatcggcaggtgaccttctccaagcgtcggaatggcctcatcaagaaggcctatgagctctccgttctatgcgacatcgacatcgcgctcatcatgttctcgccctccaatcgcctcagccacttctccggcaggcgcaggatcgaggacgtgatcacgaggtacatcaatctcccggagcacgacagaggaggagttgttcggaatagagagtatctgatgaagatgcttggtaaactcaaatgtgagggtaacatagccgaacaactcacacctaatacagagccaataaattccaacgtagaggagcttcagcaggagattaagacgtaccaacaccagatggaagtcttaaaggagcaacttagatctgacaacattgatgtcgatgaacgatttcgagac

SEQ ID NO: 65720 - DNA, 116 bp, Zea mays
  Clone ID: LIB3075-044-D2-F1A
ccgcctacgtcagcctggctcctctagcgccgcgcccttctccccccccccctcttccctacagtgccatccccccccccaccgcgcaacagccctcgcccatgccaggccactcc

SEQ ID NO: 65721 - DNA, 479 bp, Zea mays
  Clone ID: LIB3075-044-D2-R1A
accacgaacgctgttgtgtcatggagtgccgccaacaatagctttgttttgggatcctcatatctttggcacggtgctgctgccaaggtacttcaagcacaacaacttctccagctttgttcggcagctcaatacttatggcttcagaaaggtggatcctgacagatgggaatttgctaatgaggagtttctgagaggtcagaggcacctcctcaaaaacattaggcgtcggaaacctccacactcatctccaaatcaacaatctcttggctcttacctcgaggtaggacactttggatatgaagaagagattgatcagctgaagagggataaacagctcttgatggctgaggtagtgaagctgaggcaggagcaccaaaatactagatcagatctacaggccatggaagagaaattacaagacaccgagcagaagcagcagcagatgatggcattcatggcacgagtcatgcagaacc

SEQ ID NO: 65722 - DNA, 477 bp, Zea mays
  Clone ID: LIB3075-048-D11-R1A
cctcctaatcgcgaacgagcgtctttctcctccgtccgcgcccgtttgctcatcggttttgcctgccggtgggggaccgcctgcacgagcagcggctagccagacgtacggccttcgtttgaggctggagtcctgattggcaggtgcaagcacagagctcgatcgccatgtctttcaccggcacgcaggacaagtgcaaagcctgcgacaagacggtccacatcatcgacctcctcaccgccgacggcgtctcgtaccacaagacatgcttcaagtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgacccggcaaaggctccaagcaagctatcatctgcattctctggaactcaagata

SEQ ID NO: 65723 - DNA, 587 bp, Zea mays
  Clone ID: LIB3075-019-E9-F1B
gcctgtaacacattactgaattcaagattgaaattgttctgcatttacatgaaacagaagagggagcgttcctatggggaaaattcactacatcaaatcaatgacgaatctatcagttattaaccagatacatctctacaaggaaagtagggagagaggaatgtacagatgggggtggtgagactaccctgctatctaaaagctaaactccccatgatcaggtagccaaggtgtgagtcggaaaaagaatcatgtagactaaaatctccaaaaaggagaaagaaccaaataccaccttatctgcctacaaaccttttttactagcctaggaaaacatttggtctagtcttgagccagtgcaccatctccttgtcaagcggggaattattcaacacggtgtccatcattggactaccaaagaatctcggatcactcttgaacacccatatcctatcctttggccatggtctttgtgcctgtttttccatgcgcgataacatgaatctcacagttctgtttccataagctcgctcttgtgatggctttgcagacttcacataggaggatgagacatctggcaacgacat

SEQ ID NO: 65724 - DNA, 592 bp, Zea mays
  unsure at all n locations
  Clone ID: LIB3075-019-E9-R1B
caacagtgaagatcaagctcctgagttttacaacattatgttagaaaggccaaagggagacggagatggatatgacttggtttttgttgatgcgatgcacaaggccaactacgctagtagaatctgccactcctgcaacccaaactgcgaacanaaagtgacagcagtgaatggtaaataccagattggagtttacacacttcgaccaattgcagaaggcgaggaaatcacttttgattacaattctgtaactgagagcaaagaagagcatgaagcatcagtctgcctctgtggaagtcaagtatgccgtggcagctatttgaatttttctggtgaaggagcctttgagaaggtattaatggaattccatggtgtgctcgataggcatagcctgctgctacaagcttgtgaaatagactctgtctctcaacaagacttaattgacttgggtagagctggtcttggtacctgtttgcttgctggtttgcctggatggcttgttgcttacacagctcacctggtgcggtttatataccttgagagacagaaactccctgatgagatcttaacgcacaatgtggatgagagcgcc

SEQ ID NO: 65725 - DNA, 607 bp, Zea mays
  Clone ID: LIB3075-043-D3-R1B
atcttcggggtgatcgattacacagcattatgggtcgcgtgaagctacagatcaagaggatagagaacaacaccaatcggcaggtgaccttctccaagcgtcggaatggcctcatcaagaaggcctatgagctctccgttctatgcgacatcgacatcgcgctcatcatgttctcgccctccaatcgcctcagccacttctccggcaggcgcaggatcgaggacgtgatcacgaggtacatcaatctcccggagcacgacagaggaggagttgttcggaatagagagtatctgatgaagatgcttggtaaactcaaatgtgagggtaacatagccgaacaactcacacctaataaagagccaataaattccaacgtagaggagcttcagcaggagattaagacgtaccaacaccagatggaagtcttaaaggagcaacttagatctgacaacattgatgtcgatgaacgatttcgagacgtgtgagaaattcctcatggacaccctcacttgcgtggaggagcgaaagaaatatttgctgtgcaccacgtggccccgttcgatccgtcggcctccaacatgcaacaacacgtagacgtacgtaggtg

SEQ ID NO: 65726 - DNA, 542 bp, Zea mays
  Clone ID: LIB3075-003-G10-F1A
attattgtgctttagaaagccaaataaattgaaagtttgctgacacaattatcatgagaggacatggacgaactgaaccgagaacgaagcgagatctaatctacggccgaactcccggatccggtgatgagtggtggcgatggcatatgcatgatgtgatcatcactcatcagttgatgtcgtcgtcggtgggcatccagtacctgttagtgagccagacgccgtcgggacgaccttggcgccgtcctggttgcggtgccaggcgtagtatgcgtgtgtccggttcctgatctccaaggtggcgtggccgaagctggcctccctgaaggccgagtagctcggctgcggctgcgtgaagttgtccgcgatgccctcgatgttgccgccatcgcctaccgtgacgtagacgggcgcgtcccttgtccggacgggcgtgcaccgggcgttgatgatatcgtaggcgacgttggacacgcggtggctgcgctcgtacgcgtggacgtggccggcgacgacgaggtcggccttggcggcgacgatcc

SEQ ID NO: 65727 - DNA, 363 bp, Zea mays
  Clone ID: LIB3075-003-H3-F1A
gggaatcccccccgaaaaaaaaaaatttcgggggcaaaagccaaatatatctagccccaggggaaaaagttaaggggaccctttacaacccaatacaatcctcagaaagcaattcggccaaaggaaccttttttcaaaaaagggaccttttattaagggttcccaagcctatttaccccctggaggaacccccctgggcaaaggacccttaaagatcaaagatccccccttgccatgtccccccaaattccgggggcaattcttcaaaaccggcttatgatgccccgctaaaaggggcccccagttttgaccattggaaacgtatcgggaaaagtggggcccccccaaagggcatttttcccc

SEQ ID NO: 65728 - DNA, 554 bp, Zea mays
  Clone ID: LIB3075-003-H3-R1A
caaaatttgagtttgagtttgaaagaaggaagctggccagagatgatgttcgagaattaatttacagagagacattggaataccatcctcagatgttgcaggagtttcttggtggtggtgtcaaggcgaactttgtgtacccgagtggggtggatcgtttcaagaggcaattcgttcatctcgaagaaattgctgctaagggtgagaagactagcccacaattgcgacaacatacttccttaccaagagaaagagtaaatgacagcggcgacgaccttgagaaaccaagtgcagattactgcataagattgcatgtatgtgatcaactctcaagctctcgtaactttctgaagagcgaaagcatcagtgcttcccagtgtgtggtcatcaaccgaagcgagagaaagatgaggagcccatatctgagtatgcgagcagtccagtttgatggtgtggcaccgaggattgctcaaactcaaacctgagagccttaaggtacatccaagcaagaaggatctgtgcacatcgaactgtttcttgaacataagggaaaa

SEQ ID NO: 65729 - DNA, 514 bp, Zea mays
  unsure at all n locations
  Clone ID: LIB3075-004-E3-R1A
gcgacgggntnncggcactcggcagcaaactgaatggcgcttcgccgtgtggagctccggagattccttctccggcgcatcggcggcggcgaggcggccctgcctcctctcgcgtggcgcggccggccagcgagcacatccgccccggcggacgacgagctcgcggggaagagcgcctacgaggtcctcggggttggggagaccagttccagcgccgagatcaaggcttccttccatcgcctagccaaagagacccacccagacgtcgccgcggctgctggttcccgaacgttccttcagatcctcgccgcctacgagatcctatcagattcacagagaagggctcactatgatagctacctgcgatcgcagaggcgagttgtggggaaacatcccagggcatctcagttcgtgtaccaagtggttcaggctcaggcattgtggtaactcgagagagcaatgttgttgaatggctgaaatggtacaggcttacattgacgacatagttaccaag

SEQ ID NO: 65730 - DNA, 539 bp, Zea mays
  Clone ID: LIB3075-006-G3-F1A
gacaaacaatacaggccccttagatttcagtggatatagtaggctacaaacagaagagaagaaacaaagtgcttgacaaacaatacaggcccctcaggtttcaggagcgatagatacagactgtgacaactcgactcagggtaacggtcgcggaggtcccctatccaccgggatacagactcaacttcagccattgccgcctctaccgacaagctagcgaagaactgttgaagctcaaatcgatgttgcgaaatccgaaacgtgcacatacgggcttcacccaatgtcaggacctgtgtatcttcgtaggatcggaccgcttctggtttatttcagaaaacaatcgatcagagtaacaaaaaaaaaacattaggacgatactcgctggctgaagagtttcttcctgatctcggggagcttttgcctgaaggagacgctgagcctggcgtccagcgtgttgtcgcaacgatcttgccgtcctgggacgcgagcaccacgccgccggagcaggacggcccgtgcgcgtcgcgctgggtctc

SEQ ID NO: 65731 - DNA, 530 bp, Zea mays
  Clone ID: LIB3075-007-D1-F1A
gcgacaacaatcagaatcgctttgccaatgtccacaataagttacagctcagatacaatacatagaacgcgcgaatgccgccacacaacgacaatatgtcactccaatatcccatcagctgcccacccgcttggttctcacaggactgactcggttacccccttacaaaaccttcaacaaatttacaggacgggaacagcgcaggtctctggtagccaggttcttacaaggacaatgcaaaaataacacgaggccatctttttggtgatgtgaggtataaattaaaatgaaaaatggcatatgggagtgaatgcctgatgagttaggtttgtacagcgaagttcgcggcgcttggcagtcccactttcttcacggaagccttcaggtcttccctggatttggtgaccctggatctagtagctgatccagcctttgaggcgctctttggagaacattgtgccttgctgctaacatctctggcgttcccaatgctgtggcgatgcaccggcagcatactgcactgccatttc

SEQ ID NO: 65732 - DNA, 556 bp, Zea mays
  unsure at all n locations
  Clone ID: LIB3075-007-G1-F1A
gaggaacctaacgcaaagtttattttcaagaagagcacaggaatgctcatttccgaacaattcaatgtctcgttacaagcaagcatgctcacacataggcactcaactttcgtcatagaagacacatcactgaacaagcaaacaacccagaacagacttggcttattccattcaccgattgacagggcaaccgtttcaagcagatggcttcatcagggcagcgaccttctggacagacggcctctccatcagaccagaccaccaggccttcacatgcgggtaggcgtcgagcacagatgcgtagggcgtacganacaggcagagagtgacagacacatggttcaggtcggcgaggctgaggaagtctccagcaaggtacttgcacttggtcaggcgtgcctcgtacacctctagcaccttcttcagcttctcaaggttctcatccacaactttctggtcggtggtttccccaagcataggactgatgaggacctggaagaggatgggattcagtgcagcggtgtactggttagcctccacctcgatccaaacatca

SEQ ID NO: 65733 - DNA, 630 bp, Zea mays
  Clone ID: LIB3075-026-Q1-K1-H4-M1
gataaaaccatcgcttacgtgggcgattctctagggaggcagtgtttcagtcgatgatgtgtatggtcactggtggaaaggagaggctggatgtagaagatattggcgcagagtatggctttgtgttagcgccgggtgcaaaaaggccagacggctgggcctaccggttcccgagcaccaacacaacaattctataccactggtcatcaacgctctgtgatttggagcccctgaacccatcagaccgagcgaccagttatgccatgcacctggaccgcccgcctgcttttctgaagagcaacctccacaggctccatgtcctggtcctcaacaccggccaccactggaaccgggggaagctgagggcgaacaggtgggagatgtatctcggcggagcgccgaacaacgacaggaacaccgccgtcatttggaaggctaagaacttcaccgtccacaacgtcgtcaggtgggtggacgcgcagctcccccgccaccccaagctgaaggcgttctacaggtcgatatcgccccggcacttcttcaacggtgactgggacaccggaggcagctgcgacaacaccagccctctggccaagggagggagcgggtccaccttcaccgttcggagga

SEQ ID NO: 65734 - DNA, 364 bp, Zea mays
  Clone ID: LIB3075-026-Q1-K1-H4-N1
gggccgcgcctgacgtcacacttttgaaagtttctttaaatcctgttttggatattacgcctggtgtgattgtaggcgggcggcaccgccgcggttgttcttctctagaaaagggccttgttttttttagcgcgctcggcgcccttaaagaaagagcgtggtcctgggttatatttcccaccgatcttggttcctcgcaacatacgagccccccgcgtggagtgtttggtttgaggtgcttcacccatgaactatctcagattccctgtggtgttctcactgcccgttttgggtatggggggcccgaggggttttttccttagtgaatcgccccccgggcgggcacaggcggggggctttttgg

SEQ ID NO: 65735 - DNA, 590 bp, Zea mays
  Clone ID: LIB3075-031-Q1-K1-B5-M1
ctcagatgttcttattttcaactcagggcattggtggactgccagcaaattatttgacatgggttgctattttgaggctggaggtgtgcttaaactgggaacatccattaacgctgctttcaaaatggcattggaaacttgggcttcatgggtgaaagagagaattgatttaaggcgaacacatgtattcttccgtacatatgaaccgtctcattggagtggcttaaatcaaaaggtgtgtgaagtaacacaacaacctaccgctgaggccaatggaaatgacaggagagaatttggggatatacttgctggtgttgtggcaaatatgagtgtccctgtcacagtactaaatgtgactttgatgggggcctttagaagtgatgctcatattggactttggagtcatcctaataccatactagattgcagccactggtgccttccaggagttcctgatgcttggaatgagcttgtattttcccaccttttgactaatggttggcgagtgccggctagctgactattgacatggtgtgcacggttgtgcaatttcgcagtgtcctgcggtgccgtcgaggttggcttgagct

SEQ ID NO: 65736 - DNA, 639 bp, Zea mays
  Clone ID: LIB3075-031-Q1-K1-B5-N1
cagaggaacatggcttattacttcttaacttaagttgaatttggaataatttaaagaggttttggcccctgctatcatacacggaggagctaaagtcgataaagctaaaaatattgagctggtcgacttataatttacttataaaagtatatttatataactaaaacacggtacacgctgtaaccggaaacgggggagccttaacaggcggcggccacagctcatgccaacctagacggctaccgcaggacactgtgaaattgcaaatccgtgcacaccatgtcaatagtcaggtagctcgcactcgccaaccattattcaaagggtgggaaaatacaagctcattccatgcatcaggaactcctggacggcaccagtggctgcaatctagactggtattaggatgactccaaagtccaatatgagcatcacttctaaaggcccccatcaaaggcacatttagtactgtgacagggactctcatatttgccacaacaccagcaggtatatccccaaattctctcctgccattcccatgggcctcagcggtaggttgttgtgttacttcacacacctttcgatttaagccactccaatgagaacgttcatatgcacggaagaatacatgtgttcgcctta

SEQ ID NO: 65737 - DNA, 505 bp, Zea mays
  Clone ID: LIB3075-043-Q1-K1-A5-M1
atttgaaggacgcccacacgtccctgtacaccatccggcaagggaagctgctgacgcctaagcagaaggcagaccccgagaagttcgcggattgcatccactggtgccttcctggcgtgccggacgtgtggaaccaaatactctacacgaggattctttcgaaatcatcatggcattctaattttagcccccctccatcccagtctctgcctcttcctccccaatgagaatcagaagtgggggcttggtttttgtcggagaatgtatgatttttcattctttttccttcctttttgggtagattgagtaaaatgatagcacgaaaaggaaaatgaatgttctgattactgatggtatagcatgtaagaagattcagctgaagtgtaaattagttgtgagttagccaattgagaaaacaacagcgacctagtataaagtgcatatacatatactgctggttcacaggcaaaattacctatatataagccttttttcctgatgggtg

SEQ ID NO: 65738 - DNA, 598 bp, Zea mays
  Clone ID: LIB3075-054-Q1-K1-F11-M1
cgttatgcgtgggcgcagcaagtacaaggttcgtcaggccggcaagatcggcatcctgctggacttcgtgtggtacgagccgctgaccaagtccgtggaggacgagtacgcggcgcaccgggctcggatgttcacccttggctggttcctgcaccccatcacctacggccactacccggagacgatgcagaagatcgtcatggggaggctgcccaacttcaccttcgagcagtctgccatggtcaaaggctcagcggactacgtcgccatcaaccactacaccacgtactacgccagcaacttcgtcaacgccacagagaccaactaccgcaacgattggaatgcaaagatttcgtatgagcgagatggtgtgcccattggcaaaagggcgtactcggactggctttacgtcgttccatgggggctctacaaggctctgatttggaccaaggagaagttcaacagccctgtgatgctcatcggagagaacggaattgaccagcctggaaatgagaccttgccgttcgctctgtacgacaagttcaggatagactacttcgagaagtacctgtacgagctccagtgcgccatacgcgac

SEQ ID NO: 65739 - DNA, 502 bp, Zea mays
  Clone ID: LIB3075-011-Q1-K1-H3-8Aa
gatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggttgtctacatcttggatcaagtgcgcgctatggagaacgaaatgctgctgaggatcaagcagtgtggtcttgacatcacgccgaagatccttattgtcaccaggttgctccctgatgcaactggcaccacctgtggccagcgccttgagaaggtccttggcaccgagcac

SEQ ID NO: 65740 - DNA, 280 bp, Zea mays
  Clone ID: LIB3075-014-Q1-K1-B1-10Aa
cctgctgaaaccaataaaggagagtcatggggcaatgtggctaagacttcaagttaaagagacaaatcttaatggagagaagagaatctctctctatggttcttaaattataatcgctctgatgcgcactatataactgatattcataggatgaaacgtacatgaactcaggaacataaaaaggatattgtttgggtggagagacaacaacagaaagcaaagcagagagatagacgaaaggagtgctctctactcttctatgtcatgtatgtcctattag

SEQ ID NO: 65741 - DNA, 656 bp, Zea mays
  Clone ID: LIB3075-014-Q1-K1-B1-9Aa
caccgctaccaccgcgtactcgtagccctcggcgctcttggccaggtcgtccttgtccgggcgctccacgtagtccaccgacgtcttcttgtccaccgccttcttgatggcctccaggatcgtggtgccgacgccggtgaggttgttgcccctctccccctgccacttgatggtccagccgccgcactggctgcccaggtcgtgggcgtggctgccggcgacgaggatcttcttggccgtcttgggcagcggcagcatcggcttcgcctgccccttcttgctgttcttgagcagcacgagcgacttgcggacggcctcccgcgccagcgcccggtgctcctgcgcgccgagctccttggtgaggcgcgggtccgggagcgggtcctcgaagaggcccatggcgaacttgacccggaggatccggctgacggcgtcgtcgatgcgctccagcttgatctgcccctgcttcacctgcttggccaggtcggcgacgaaactccggtagtcgtaggggacatcaccatgtcgatccggcgtggatcgtctcttgatggatggagtaggctggtcggcggttcggatcggtcacggctgcagtcggatcacaaccctgagttaactgtctgaggttcgtgcggccgcggcgcccggattcg

SEQ ID NO: 65742 - DNA, 526 bp, Zea mays
  Clone ID: LIB3075-014-Q1-K1-B1-Fa
cggtcaggcaggagtaatatatactaataaggagatacaaaatacgcatttgcctttctctagacagagaaaactactagctagccatatacgtatatctatttgtcctagcccatagtacaaaatttcttgaagtagccggcgggcgtagacgcggtgaacatcactacaggtaaacgcgcgtgcgtatctcattatcattagaaacagtaaaaaagatattaaaaggaaacgaagaaaaagctctgtcgtgcatggagagaggtttgacctctatactaagtggaagaggccagcaacaggctactctacttacaaccacagagagagagagggttctctattgcggtagctagcggcgccgcctccccccaactacctgctgctgctgctgctgctggccacggcggcccgggccgcgccgatccgctctcctctcacatgacgctgcaggagttggggttctcgtcgtcgaagatgcggtacgacgagtcgtgcataggcgacgcgtgcatcccgggcgggc

SEQ ID NO: 65743 - DNA, 304 bp, Zea mays
  unsure at all n locations
  Clone ID: LIB3075-017-Q1-K1-A2-146a
aggagattcattcaccaagcggagaaactcagcttgannnncctgaatcaaccgcagaatttgtgggttttgtttacctagctcttgaagcattggctgcaagatttgaggattagcctggactaactgaaggagtgcttgaaactgtggaagctgtcgcaaggcatcaagggcaccagatccagcacctggaataacgcctgggttggacccaccacttggaacaccctgaggaaaaaggttcaaaggatttgcattaggccctgcagaggcaggtgatggctgcactgccaatgcaactgtt

SEQ ID NO: 65744 - DNA, 366 bp, Zea mays
  Clone ID: LIB3075-003-Q1-K1-F11-TCB
ttccacccacgcgttctcctgcttgtgctcagctccagctcactggctggccacccagacttctggacaggaaactgcaccatcctctgctgccagcaagggggctccagagactgcccacccagcaagtctggtggcctggggatttggacagcgccttggtaatgaccagggctccagaaggagatgtccttgcggctgggggcccctgtgcctgacattcctgctgactctgcggcggagctggggaaggcccgtcgcacaggatgcaagcggccaggcccatggaggcagcagctgcatcctcagagaggaagccaggatgccccactctgctgggggtcctgcaggggtggggctgggggc

SEQ ID NO: 65745 - DNA, 387 bp, Zea mays
  unsure at all n locations
  Clone ID: LIB3075-003-Q1-K1-F11-TGB
atacccgtaacanacagtaggcacgacagccagtccacgtggcatggcagggtaactgctgagacgcacacgctccacatactagatagttcatcgacaccacagacacgacagatataaggaagaaacctaacacgaagagttcaccataagcaagctctgagacgcaccagggcttgcaccgcagtggcacagtcgtcttattattttacgaatatatgctgggatctagatagcacacgatctttacttgtacttcttctccctggcaatgagctccatcacaggtggttggatgcttccctaattctgcgaagcagctcctttgtcatctctgtgtcatcaaatcccatcttttccagctctggaaggagaggatcccatttt

SEQ ID NO: 65746 - DNA, 435 bp, Zea mays
  Clone ID: LIB3075-018-Q1-K1-B9-R3A
tatttaatttttgtttacgaatgtttcttcaggaaatcgattgccactgcagcatgaaatgcagctccgacaggaagcgcgtcctcatcgatcacaaagtagggggagtggggttgctgcacagtcaccatggtgctttcattgccaactccaatggtgaagaaggcgccggccattctccgcgcgtagaacccaaagtcctccgcgcccatcacttggggagcaaccttgacatggttttcgcctagcaagctctcgcccactgcccttgcatgggcatacatccgttcgtcgttggccacagcaggatatggcctcatctcctcctccatgaagtccaatgaagcagtacagtgatgtaccgaagaatgtccttccacaatctctttaaccctcttcatgagatacgacaaaccttcatctgtcatgctcctc

SEQ ID NO: 65747 - DNA, 448 bp, Zea mays
  Clone ID: LIB3075-019-Q1-K1-C10-R5A
cctcagttcgacttgagggcctccacgtcggttgccgggactttgtggatcttgccattgttgtacacaaagctcccgtcaacagtcttgaagttgagatacttggtcacgctggtgcggatcaggacgcggaccatcgcgccgtttgccatcatgaacttgggcaccatgtcgacgttgtactctttgctgacgcccaggtgctcgggagggctgtcgctgaccttgaacctgttccagagcttggtttgatttagggacgaagatttttctccgtagtagtcattcctgttcatgtgaaggaccttggggccgtctacggagaggaggccgctgatgatgcactccttgagccccgtccccaacacgatcacgtcggactccttatgcatggttctctctctttctctttctctgcctgcttgccttcttctactagatcttacgc

SEQ ID NO: 65748 - DNA, 587 bp, Zea mays; identical to SEQ ID NO: 38654
  unsure at all n locations
  Clone ID: LIB3075-003-Q1-K1-F11-F2B

SEQ ID NO: 65749 - DNA, 488 bp, Zea mays; identical to SEQ ID NO: 38653
  Clone ID: LIB3075-003-Q1-K1-F11-R2B

SEQ ID NO: 65750 - DNA, 432 bp, Zea mays
  Clone ID: LIB3075-003-Q1-K1-F11-SP6B
aaaacaaatgcttacgtatgtataaacagtgcccaccattggcacctaccatacagcactggatgagtgttcctgttatctgccatcagatattgccacaacgagcctcctccaacctatatttgtactaaacgcagcctaccagccaacagaacaaaaagcttagcatcagtctgccatgcgacaaggcgtgcgattcagtcagacgtcggttcggcgtccatgcagagatgaaccagcttctgctggtactgcccgaagacctcactgactgcgatcaggtcctaggcgcaccaagtattggaaggggaccgggaggatttacttatgtctggggctactagcgtgtaacgattatagccggtaagacaaaacccaggcttgttaacttaaaaagcgtgataacgtatatccacagaaaaatattagggc

SEQ ID NO: 65751 - DNA, 709 bp, Zea mays
  Clone ID: LIB3075-018-Q1-K1-C2-F3C
gcatatgtggaagcagtcctcaacaatcttgcaggaaatgtccccaaggctgtggttctctgccaagtagagaaagccaaagaagatatgctcagccagttatatacttctataagcacgcaaagcttagccaaaatcgaagagctaatccaggaggaccacaacgtgaagcggaagcgtgaaaagttccagctgcagtcgtcgcttctttccaaggtcactcggctgctcagcatccatgacagccggtcgggcagtgctggtctgtcgacagattctgctggatcagagagtagcccgaggaacggcggacactctggtgacgactggagatctgcattcggagctggatcggccagttggtctactggagcagccattgccggccgccgcgtaccgagtcgaggtccgccgccgcctccaccaaatgttggctgattgtgagcttttttagcagaacatgtattactcaaaacaaggtgaacgtatataggcttatgaatcgcagatcgtggattaatagaagaggtagattttttttcaactattcacattaattagtcctgtactaggatcgattcagcgtctgtccgatcgaggcattccgccaccggatacttttttttcatcttctcaaatatcaactgttgtctcccgttccgtcgtcataagttcatatactactaatattattttacgcacttctttc

SEQ ID NO: 65752 - DNA, 621 bp, Zea mays
  unsure at all n locations
  Clone ID: LIB3075-018-Q1-K1-C2-F3D
tatgtggaagcagtcctcaacaatcttgcaggaaatgtccccaaggctgtggttctctgccaagtagagaaagccaaagaagatatgctcagccagttatatacttctataagcacgcaaagcttagccaaaatcgaagagctaatccaggaggaccacaacgtgaagcggaagcgtgaaaagttccagctgcagtcgtcgcttctttccaaggtcactcggctgctcagcatccatgacagccggtcgggcagtgctggtctgtcgacagattctgctggatcagagagtagcccgaggaacggcggacactctggtgacgactggagatctgcattcggagctggatcggccagttggtctactggagcagccattgccggccgccgcgtaccgagtcgaggtccgccgccgcctccaccaaatgttggctgattgtgagcttttttagcagaacatgtattactcaaaacaaggtgaacgtatataggcttatgaatcgcagatcgtggattaatagaagaggtagattttttttcaactattcacattaattagtcctgtactaggatcgattcagcgtctgtccgatcgaggcattccgncaccggatactttttt

SEQ ID NO: 65753 - DNA, 281 bp, Zea mays
  Clone ID: LIB3075-019-Q1-K1-A5-R4D
acattgaaaccgatggtggggatggtggtgacgatctcgccgagcttgagcttgtagaggatggtggttttaccggcggcgtcgaggccgaccatgaggatccgcatctccttcttggcgaagagccggctgaagagcttcccgaacgcgagccccatcttcctccgcgtcccccttccttcacacctgcgctgcgctgaatgcgagatccgaaggaggaattggggatcggaggcaaggagcggggcggagaccagaagagggaagggaggggagatatt

SEQ ID NO: 65754 - DNA, 281 bp, Zea mays; identical to SEQ ID NO: 5508
  Clone ID: LIB3075-019-Q1-K1-A5-R4E

SEQ ID NO: 65755 - DNA, 453 bp, Zea mays; identical to SEQ ID NO: 5515
  Clone ID: LIB3075-019-Q1-K1-C10-R5B

SEQ ID NO: 65756 - DNA, 446 bp, Zea mays; identical to SEQ ID NO: 16782
  unsure at all n locations
  Clone ID: LIB3075-019-Q1-K1-C10-R5C

SEQ ID NO: 65757 - DNA, 491 bp, Zea mays
  unsure at all n locations
  Clone ID: LIB3075-003-G10-R1A
cggacgtngnntntngnagcggagaagaagcaggggaggggaagcgatgagcaacatgctgcgggctcgccgccgcctggacctcctgcaggtggtgctcttcgccgctgtgctcctcgtcgtcgtcgccgacgccggcgtgacgagccagtaccggcggaagctggaggcgacggtggagatgccactggacgccgacgtcttccgcgtcccgccggggtacaatgccccgcagcaggtgcacatcacgctgggtgaccaggagggcacggcgatgatcgtgtcgtgggtgacggccaatgagctgggcagcagcaccgtcatgtacagcgangcgtcgccggacccggagaagatggagctccgggcggagggcacccacacgcgctacgactacttcaactacacctccggcttcatccaccactggcacctcacaaacctcaagcatagcaccaagtactactaacccatggggttcggccacacgg

SEQ ID NO: 65758 - DNA, 230 bp, Zea mays
  Clone ID: LIB3075-003-Q1-K1-D1
cggacgcgtgggcggacgcgtgggtttatgaaagagtgcacctcggttgatgttcaaaaagagcatagtgtgaaatgtaacgtttaagcattcctcggtacaggaggtgaacaaagttacatttcacattatggtctttatgaaagagtgcacctcggttgatgttcaaaaaaaaaaaaataaaacataacataaaaataaaatggtgatcgtaactatgaatccaaaaa

SEQ ID NO: 65759 - DNA, 519 bp, Zea mays
  Clone ID: LIB3075-004-E3-F1A
actatcatgttgtatatcaaacgggcagggtagtcaacagcctcagaaagatgtccttatcagctatcatatcaagaaagcacattagtttctaactatacagtagcatactaaaaagcagctgaacagaaccagcaaagggtgtgacaccacaggttcagtctaattgttaaagcgagaccccaaacaactattttcatggtgttctcgtgtcaatcccctttctctccattagcaactttttttgaacagctgacgaagatgagataaggaccattgcagcaagctagtcacattccatcgtcttcttccagcatcttcaagatccaaagatctgtaagccagagcagcaagatacattgcaggatgcaatctcttttcagaatgttcattggaaccatcccactgtctttgagacggaatcgtcctccctttcttgtctctcccataagtttcgatataccatccaccagtgtcatgcatgtaacaacgaggctcaaaaagccaataccatcaatg

SEQ ID NO: 65760 - DNA, 74 bp, Zea mays
  Clone ID: LIB3075-004-Q1-K1-D8
ttgagagctcttatttattagctttgattgcaattaaccaatatgaccatagccctgttaaggtttgctgtact

SEQ ID NO: 65761 - DNA, 311 bp, Zea mays
  Clone ID: LIB3075-004-Q1-K1-G8
tcatcccaaaaaaaaaaaacaaaaaaacaaaaaacaaaaaaaaaaaaaaaaaaaaaaaaaaaaacgcactttataaaaaatccaaccttacctacccttacctcctactccaaatctcttctataacataacctaaatccaattcactccccaacctaatacaacatcttcactatcaaaaccctactaatacccaactaaatcaccttgacccacatcacccctttttccaatttacctattaacaaaaataccctcacaaatcaaccttatcatcaaattctcatactcatcacttaattatactcacc

SEQ ID NO: 65762 - DNA, 126 bp, Zea mays
  Clone ID: LIB3075-005-Q1-K1-F3
ctgaaatttatctcattataatacgcatatgccagtctacagcaactgagacatcatagcctgggttggtgtaaactgacatatgcgtattataatgagctgaaatttatctcagaagaaaaacta

SEQ ID NO: 65763 - DNA, 93 bp, Zea mays
  Clone ID: LIB3075-006-E12-R1A
aatcggtaagacaggcgatggccaaggagtagccggccgtgcgggcgagccttcgccagttcgacccaatatccagtaaattctcgccgaacg

SEQ ID NO: 65764 - DNA, 521 bp, Zea mays
  Clone ID: LIB3075-007-D1-R1A
gcaagagctgggaaaactaagaagacaactgttgctgttagcacctacattcgtctgtgctaatcgtgctgagaagagaggagagttttacacaaaattagaagaaaaacgcaaggctttggaagaggagaaactccaagcagaggccagaaagagggaagaggaagaagaagctctaagacaactgaggaagaacttggtcgtccgagcaaaacccatgccaagcttctaccaagagggacccccaccaaaggttgaacttaagaaggtgcctccaactcgtgccaagtcaccaaaattgacacggagaaagagctgcagtgaaacccctcatacaccagagggaggaaatggcagtgcagtatgctgccggttgcatcgccacagcattgggaacgccagagatgttagcagcaaggcacaatgttctccaaagagcgcctcaaaggctggatcagctactagatccagggtcaccaaatccagggaagaccttgaagcttccgtgaagaaagtgggac

SEQ ID NO: 65765 - DNA, 602 bp, Zea mays
  Clone ID: LIB3075-007-G1-R1A
caagccagagctgttgagggaaggaaacctcgaggaggcagcaatggtggatgtttggatcgaggtggaggctaaccagtacaccgctgcactgaatcccatcctcttccaggtcctcatcagtcctatgcttgggggaacaccgaccagaaagttgtggatgagaaccttgagaagctgaagaaggtgctagaggtgtacgaggcacgcctgaccaagtgcaagtaccttgctggagacttcctcagcctcgccgacctgaaccatgtgtctgtcactctctgcctgttcgctacgccctacgcatctgtgctcgacgcctacccgcatgtgaaggcctggtggtctggtctgatggagaggccgtctgtccagaaggtcgctgccctgatgaagccatctgcttgaaacggttgccctgtcaatcggtgaatggaataagccaagtctgttctgggttgtttgcttgttcagtgatgtgtcttctatgacgaaagttgagtgcctatgtgtgagcatgcttgcttgtaacgagacattgaattgttcggaaatgagcattcctgtgctcttcttgaaaataaactttgccgttaggtctc

SEQ ID NO: 65766 - DNA, 89 bp, Zea mays
  Clone ID: LIB3075-007-Q1-K1-E7
aaaaaaaaaaaaaataaaaaaaattaaaaaaataaaaaaaaaaaaaaaaaaaaaaagaaaaaaaaaaaaaaaaaaaaaaaaaaaaaagg

SEQ ID NO: 65767 - DNA, 133 bp, Zea mays
  Clone ID: LIB3075-009-Q1-K1-A3
tcgctaaaaaaaaaaaaaaaaataaaaaaaaaaaattattaaaaaaaaaaaaaaaaaaaaaaaaaaagaagaaaaaaaaaaaaacacaaggggctgcctatcttggggattcctagcttgacttccgcatcct

SEQ ID NO: 65768 - DNA, 293 bp, Zea mays
  Clone ID: LIB3075-009-Q1-K1-D5
catgtatgtggaatggaacaaaaagaccctgctatctttttgctagaaagttttacccagaatctttgaacaacctgctgaagctattctccagttacacatcggcttgagttctacatgattcttttggcattttgcctaggagattcctctaggatttatctttttgtgcttcatgtaaattgtggaattgatacttagaggcttaacagagttacagatccagggccttgatgtaattctgagtcccttggtagggctgaggtgatgtttgtttattaaaaaaaaataat

SEQ ID NO: 65769 - DNA, 216 bp, Zea mays
  Clone ID: LIB3075-009-Q1-K1-F8
atccacgcttacgtccacttacatgctatcgtataaggtcacctataatgaatctaatgtccgttgattgacaacgtgctttactgcgaaaacactggcaaaaccctgcttaatcgcattgcaatacatttgcatttcatcagctgttttactagcgaagaagctccggaccaatcgcgcttccgatcgaccttcgcaacctgtatggagaatgga

SEQ ID NO: 65770 - DNA, 252 bp, Zea mays
  Clone ID: LIB3075-011-Q1-K1-B5
tcttcccctttcttgcaacttcttatctcttctttggtgccacttaatttcatttctctgtccttctttttacaacgttgtgcctggtaatcccctggtgttccccaactttttcgccttgcatcacttccctttttctcctgttgtcgtatttccttatgtgcctccccctttcgcccttcctaacttttgcccagcctgattggcttttgtgcccctccttgttccgcctctttttccccttcgtttttg

SEQ ID NO: 65771 - DNA, 342 bp, Zea mays
  Clone ID: LIB3075-011-Q1-K1-H3-F1A
acttaaagggagcatgcattataaatcaccggctggatacacagttacactacacacacgccacgttccaacgcttgactcaaagaacagggcaggcagggatgctaccaagtaccatcagtacgaccaactctcgcaactgcgcttctagatactaagaagatcctgctgcggcggcgagtcgtgtggcccttcctgctgctgctgctgcttcttctccgggcccccgtcctcttctcgttcaccttcagcgtgtaggcgtactcaggagcaatgtagccgtacgagccggcgatagcggacatgcactccgaaccgccagcgttgccccggaggaacttg

SEQ ID NO: 65772 - DNA, 340 bp, Zea mays
  unsure at all n locations
  Clone ID: LIB3075-011-Q1-K1-H3-F67
cgacctgggcagccagtgcggcggctggaccatcaagtttttttttgagaggggcaacaacctcacgggcgttgggacctcgatcctggaggccatcaataaggcggcggacaagaagacgncggnggactatgtggatttccggncaaggacgaccnggccaagagcgccgagggctaccaggacgcggcgggagcggggggcgaacccccgnacgccgagacggccggcgacaacaagaacctgaccatcccgtcgccggggcccgaggggatcaaggacgtgtgcgggctcgtcaggtgcgtcttgctcgtcgtgtccggtcgtccccttgtgctgc

SEQ ID NO: 65773 - DNA, 604 bp, Zea mays
  unsure at all n locations
  Clone ID: LIB3075-011-Q1-K1-H3F2B
gatgatcaaacaatcaaggggttgaaagggattatgagggtttcaatttcctaccagtctaaatcactatctcaagataaaacggacaaggcctaaatcaattattttatcaatcttttttaactacacctacaaaaaaaaagctttgtgtatcttctacaaaaaaaagtgcttatttgccgttcccgctaactatttcatcaacaccgaaaaagcaaaagcagagtctaactctaattgctaatcgtgactcgcggcagccttggtggtgagcccgaagccgaacgggaacagcgggtcgtaccgcttgtcgccgtagttcatgggcagctggtccacggacttgaaccacgtgcgcggcagcttccccgtgaacccatagtccccgaacagcacgtcggtgatgccctgcgcctccgtgccgggcagccaggncgcgaagagcgcgtccatgtagtccacgtacggctgcagcacgagggggcggccggacacgacgagcacgacgcacctgacgagcccgcacacgtccttgatcacctcgggccccggcgacgggatggtcaggttcttgtttgtcgcggccgtctncgcgtacgggggt

SEQ ID NO: 65774 - DNA, 466 bp, Zea mays
  Clone ID: LIB3075-013-F1-F1A
ggaataagtggttgtttgccgagggaagagcatacgataaatcatatacttggattgaaaatagatatgaaatttacatatgatcagtaggatatggatatcacaagaagaaccacttgttcttggatttggttttggttttggccatatccttcttcctcgccatctccacctgcaacctctcatcctcgtcctcgtcctcgctactcacgctgctcttctcatccttctcttcctcctcctcgtcgccgtcagcgcgcttcgtcgcctggccgccggagcctgccgcagcgacgtcgagccgcgcggcatccatggcccagcgcatcaccttgtccacctcgtccgcctcgtcctccgacgactcccctcccagatcctccagcctcaccctcgtgtccttctcgggccccgccgcccccttcagcgcagggaccgcgcctccagctcatccatccctccaagg

SEQ ID NO: 65775 - DNA, 438 bp, Zea mays
  Clone ID: LIB3075-013-F1-F2A
ggaataagtggttgtttgccgagggaagagcatacgataaatcatatacttggattgaaaatagatatgaaatttacatatgatcagtaggatatggatatcacaagaagaaccacttgttcttggatttggttttggttttggccatatccttcttcctcgccatctccacctgcaacctctcatcctcgtcctcgtcctcgctactcacgctgctcttctcatccttctcttcctcctcctcgtcgccgtcagcgcgcttcgtcgcctggccgccggagcctgccgcagcgacgtcgagccgcgcggcatccatggcccagcgcatcaccttgtccacctcgtccgcctcgtcctccgacgactcccctcccagatcctccagcctcaccctcgtgtccttctcgggccccgccgcccccttcagcgcagcgaacc

SEQ ID NO: 65776 - DNA, 436 bp, Zea mays
  Clone ID: LIB3075-013-F1-R2A
acgggatccaaaatccaccacgatgagcagcggtggcgggcggaaggcggcgggccccggcggcgaggaggcggaggtggaggcgcttatccgggcggcgcaggacgcggtgctcctgaagctcaaggcgaactcccacctcgtctcctcggcctccagccctccttcgctcgacgcggcggaactcgatcccctggacagcgacctcgcccggcgcttcgacgcgctcaagtcccgcgcggcggcgccgaatccgaagccggccggagccggagccgcccttggagggatggatgagctggaggcgcggttcgctgcgctgaagggggcggcggggcccgagaaggacacgagggtgaggctggaggatctgggaggggagtcgtcggaggacgaggcggacgaggtggacaaggtgatgcgctgggccatggat

SEQ ID NO: 65777 - DNA, 501 bp, Zea mays
  unsure at all n locations
  Clone ID: LIB3075-013-Q1-K1-D12-F1A
ntnntttttntttttttnttggggtttttacggctgcaatttgtgaagggttcactccagatgcataatgtggctccgagtggtcattccttgccctgttatccgagagaggtgcatactgcgggcggctcaccgtggtttccgagctccgctcggaaggtgtgctgcttctcggcctctccttgggcctggagtaaccaggcggctgcggcggggagttgggcacggccgcgacggggcgctcgtactgcgtaaccttggtctcagggttccagaagtagaggtaccccgtgttgccgtcgatgagccccctccacggcttgggcagcgtttgatccggcggcgcgtatcgcggtccattggacgccggcgcggacgccgacaacgttattccccgccctgctcgtgtaccccattggcgcggcggaatgcgcgtggcgacttctgcagctgcgcccggattttgggaaggggctctagaccaattgttttttttttttt

SEQ ID NO: 65778 - DNA, 305 bp, Zea mays
  unsure at all n locations
  Clone ID: LIB3075-013-Q1-K1-H9-F1A
tcgcgatctagaaccccaattctaagcgagacggtgcacaggaagaggagagcctaaaaccctaaccccccgaatcggatccggccgccggagcgcggaaccccaccccggccgccatggagatgggagggatgagcgacgctgagcggctgttcttcttcgagatggcctgcaagaactccgaggtcgcgtacgagcagaaccccaacgacgccgacaacctgacgcggtggggcggcgcgctgctggagctgtcgcaagtgcnaaaccggcccgacagagtcaaaatttttgtagatgcggga

SEQ ID NO: 65779 - DNA, 304 bp, Zea mays
  Clone ID: LIB3075-014-Q1-K1-B1-F1A
ggggaaaccaaattagccaaattcgggcgggtttgttttttacccattagggcaactggtgttttggacttttgactggtttatgggttttacaggggccagcattgggatttgggtgctgtttacaaaacttcaggggttttcacagggaacgtgttttaaacacctgtttttcagggggggggttctttttgatgggggaagaatagttttttttggtgggggtccccaagggttttttttcccttcccttgttgcggctttctttttaaatggggggggggggaattgccacctgggcctt

SEQ ID NO: 65780 - DNA, 391 bp, Zea mays
  Clone ID: LIB3075-014-Q1-K1-B1F2B
gcacgacagtggatataaaattgacataggctctaacaattacataataccgacaataaaatgctacgagttcagcaaccaacgtcgaatctaaaaacggaacatcatcgtatctgaaccaaaacaacaaacggttcattttgactacgccagaatgaatacaagttcaaagaaatctcattgcctgttagaattactacagtacacgaacaaggagctcgattgcctcttcaattcagaagatgcaccaaggcagcaagcatccttatcaacaagaattcacactagactacgttagcagacccagttttaaacagcccaaaatggtttctgctctgaaccaggagttggattgcccttaggtatgttgtctgtcacatcaatatcgtcg

SEQ ID NO: 65781 - DNA, 522 bp, Zea mays
  Clone ID: LIB3075-014-Q1-K1-E2-F1A
acataagaaaaggaaaatatattttccttcccaacaaattcaatctaaaggaacagcaacatgaaaaaaaaacacaacatttcacacaagggcgatacgttaatccatgcattgatcgataatgcaaacccaacgacatggaattcgtccattacacactgtagtctgtagggaggagagaggttgttccaacggatgtccagagtgcaatagctacgtcaacagcaagaggtgtttgcttcgaagagtggaagcaaacaagagtacaaccacatcatcagtatatcataagtggcttcctcaaattcttcctataaaagccaagcaggaaataaatagtgtcaaataaccaatgattatggctatcgtgcgtctgcttatgaaccgcagcatgcaaatcgctgggcagctggtgcctcggaaccctggtctggcttgttaattttgattgccttgtcctctggctttgaatcaatctctgcaagcctctgcttgatgtcacgtgcgatggagaaaaacact

SEQ ID NO: 65782 - DNA, 433 bp, Zea mays
  unsure at all n locations
  Clone ID: LIB3075-015-Q1-K1-C12
tccgtccgtcttcnntgaaatcagtagcagaaaagtatccatctcaaactttcttcaccnnntcgcaatgggagaaagggatgganntgactttcattannacgctgnnttcaagaatgggtganntgaggagaaacacatgtcccatggtaataccaatacgtatcatgtgttgcatcctctagtgtctgcatcctccccatatnctgtatgatgctcgttgaagaaagcaccnngttgcagaagaatgccagaataccaaagttattagtcattctgtactttactgcaatggttaccaagaactctgttgctgagggtactctcccagctttaaaactgaatattaagagagattcattccagaaaagacacnaatctgcaaagaaactaaggtctcagatgaaattcaggaaagtcaaaagggtctcat

SEQ ID NO: 65783 - DNA, 415 bp, Zea mays
  Clone ID: LIB3075-015-Q1-K1-F4-F1A
atatcaggaagttcctttatttaaaacgcgctgctaatgcaggctacgtgttacaaatttattattattcaaaaccacggccatgtggataccacgtcgatgcagttttttggccccatcaaacaagtaggagcagatgagatcgagttgaggcacgcctcctcactccgccccaaggagggcaagcataatatcctcataatctctagttgtatctttggccacagcacgctccagcggcacactgtttctcttctgataagcctcctttatcagcttcaggtcgacctcggcgcgagtagttacgaccctggtgaggtcatcctcatcagtgcccatgcctccaagagccagtcgaatgactttctcgaagtatctgtcaaggcaggtgaagcaccggatgatcgcccgcagt

SEQ ID NO: 65784 - DNA, 266 bp, Zea mays
  Clone ID: LIB3075-015-Q1-K1-H3
acggctgcacactcagagaataatggttttggtcgaattctggagccctcgttcgtgtgattccgcctcatgagcttgcttctcgtcatcttccttttcctgctgcaagttggttcctctcttgtgaagtataattcatcagcctgaggggttgattagtgaccagtcagatgacatccctgattctgcacctgtgcttgcaattgcaataacagttgatatcgatcgtgcaactaaatgtttactgctaaaaactaaactgctat

SEQ ID NO: 65785 - DNA, 432 bp, Zea mays
  unsure at all n locations
  Clone ID: LIB3075-016-Q1-K1-H12
cgtnnccgctacnncttgnacaactnnntaaaggcgaaagggatcttgtttcatncagagcaagggcgatgcttatttgtttggtgaatgcagaagtgtgacgaaacgtttactctttgcttgcaccctccaaacattgcgtatcattcgatcatgnagaagaaanagaacacttttgtcgtgacaaanagaagnggcttcctgatgctgttgtttggaacccttgggacaagaaggcaaaagcaatgcaagattttggggatgcagaatacaagagcatgctgtgtgtggagcctgcatctgttgagaggcctattactctgaaacctggtgaagagtggaaaggaaggcttgtgctctcagctgttccctcgagttactgtagtggacagttagatccattgaaggtccttcanggctgaaaatccttac

SEQ ID NO: 65786 - DNA, 104 bp, Zea mays
  Clone ID: LIB3075-017-B5-F1A
acacattcggacagcttatattaattatacgtctatcactgtcatgcaagtatgtatgtactcttgatgttatattattatcattaccaaatatttctaacggg

SEQ ID NO: 65787 - DNA, 92 bp, Zea mays
  Clone ID: LIB3075-017-B5-R1A
cggacgtgtctgtgacgcgtgggaattaggttccgagaagcaaccctttttactggattgtctatcctctgcagtatatcgtcaagccttgt

SEQ ID NO: 65788 - DNA, 333 bp, Zea mays
  Clone ID: LIB3075-017-Q1-K1-A2-F105
tcgttgagggcggcctcgcagtcatcgacgaacttgtggcgcgcgagcgacttgtctggggtactggggcacgagggcgagctcccccttgatctcctcgaagggctggaacacgaccccgctgagcacctccttccccttgcccgcggccctgcacgatcatccagcggacggcgaggcgactccgcgcggcgccgccaccctgacgacgggagcaggggtcgcgggcgcaccggagagctgggttggcaccgcggcggccggggacggggaaaccctaagcatcatctggatgtgtcgtgtgggtgcgtgtgcgttcgctctagatcgcga

SEQ ID NO: 65789 - DNA, 504 bp, Zea mays
  Clone ID: LIB3075-017-Q1-K1-A2-F1A
gtggggtgttttttttttgtttgtggggtgtcttttttttttttgggcgaactcaaaacattttttaccatgtaacggccacagatttgcattatacgggggctcccggattttgaagccagttgtgataaattgttcaaacagatacaacagtttattggccatgagttttgccaatccaacaagggctttttcgcataagctgggccgggggagtttttcctcctcaactgcaattttggggcaggttgcttaaggtaaattttggggggatcatttggggcaacatacccctgacgcatttttttattttcaggggttttcgcggttttcaaaggatccacacccggggccatgtttacaacaaactgggctttaaacttattgtagcgccccccaaattccctcaggtttaggaagagagggaccaaagttccccagccccctttcttgtaaaaaatttttaaggggggtgttggtacagggcccttttttttttttttt

SEQ ID NO: 65790 - DNA, 579 bp, Zea mays
  Clone ID: LIB3075-017-Q1-K1-A2-Fa
tttttttttttttttttttttttttttttttttttgcacgacagtggatataaaattgacataggctctaacaattacataataccgacaataaaatgctacgagttcagcaaccaacgtcgaatctaaaaacgaaacatcatcgtatctgaaccaaaacaacaaacggttcattttgactacgccagaatgaatacaagttcaaagaaatctcattgcctgttagaattactacagtacacgaacaaggagctcgattgcctcttcaattcagaagatgcaccaaggcagcaagcatccttatcaacaagaattcacactagactacgttagcagacccagttttaaacagcccaaaatggtttctgctctgaaccaggagttggattgcccttaggtatgttgtctgtcacatcaatatcgtcgtcatcgtcgtcatctccataatcaataagtttcagcaaagtatcagacacaggtgtgccttttgttttttcctccttaggctcccttggtcgtcgttcagatggcaagactgatattgcatcaaaggaccttggaggtgctgttggctccttt

SEQ ID NO: 65791 - DNA, 366 bp, Zea mays
  Clone ID: LIB3075-017-Q1-K1-F5
gaagaggtggtgaagaaagatttggatgcttaaagatttggataacttaggtggttcgtcacctaagttatgaaaaagtctgagacctctgtctctctgttcttttggtttcagttaagcagttagctgggctaccggcaatttgtttgcttaatatttttcctgttcaataagtactctggatggcatattattgtttagtcatattgagctgcatattattgtttagtcatattgtttctgctgccgatgcccttgtggggagaatgatcttgtaacagacttgcctattcccgcaatatattggaaattttggttaaaaaaaaattctttaaaacctttattatatacttcttaaatataaaa

SEQ ID NO: 65792 - DNA, 303 bp, Zea mays
  unsure at all n locations
  Clone ID: LIB3075-018-Q1-K1-B9-F4A
catgaagcacatggtgactgtgcagcaaccccactccccctactttgtgatcgatgaggacgcgcttcctgtcggagctgcatttcatgctgcagtggcaatcgatttcctgaagaaacattcgtaaacaaaaacttaaataattaatggagagaagtaggcttttgattntctttgggtgttagatatgcatggtttatatcgcttcttctatattatgttttaagtgtctgattttttctgttgtttagatgacatgaaatctttttattctttgactattgaaaaaaaatcgttaattgc

SEQ ID NO: 65793 - DNA, 506 bp, Zea mays
  Clone ID: LIB3075-018-Q1-K1-B9-R5A
tcatccgttcgtcgttggccacagcaggatatggcctcatctcctcctccatgaagtccaatgaagcagtacagtgatgtaccgaagaatgtccttccacaatctctttaaccctcttcatgagatacgacaaaccttcatctgtcatgctcctcattgtgccgccaaaggtgacagactccgggataacattgaaagcttctcctcctttcacgaaagtgatagataccactgcaccatggaggggatccacttcacgagcaacgatttgctgaaggctgaggattgcagtggctgcaaccacaacagggtcgacggattcatggggtactgcggcatgaccacctttcccacgaatagttgcagagaaccgacccgctgtcgctgtgaatggtcctggccttgatgcgacgacacctactggaagtgctgggtccacatgcaagccaaatatggctgacacgccgtcaagagcaccttcttgcaagacgtaataggctccgcca

SEQ ID NO: 65794 - DNA, 71 bp, Zea mays
  Clone ID: LIB3075-018-Q1-K1-E7
aaaaaacaacacaaaaaaaaataaaaaataaaaaaaaaaaaacacaaaaaaaaaacaaaagaaaaaaaaaa

SEQ ID NO: 65795 - DNA, 344 bp, Zea mays
  Clone ID: LIB3075-018-Q1-K1-F12
agctgctcaggatcgaggaagagctcgttgattccgcggtctacgccggagcaaagttgggggcaccagtggagccctactaagaaaggaagaggatggggatgtcttcttgtggagctatactagctcgctgctgccttttgatacaatgttcgtacggtcgcaatacatgtatggtcgtgtttgctcgagagctactcaggtgattttgtcgtgggagcaaccaaaagcagaaaagaactgcttttttttcaatctctctagattctgactagtgagtggtctgcactcgtggaaatgtcgttggcctaaactgattctgatggaacaggtaaaaaaaaata

SEQ ID NO: 65796 - DNA, 223 bp, Zea mays
  Clone ID: LIB3075-019-E9-F1A
atctatattcttacctgtggcccgttactggattcaacactgagattgatctgcatttccatgcgacaattccggagccgtacctataggcgtaattcatttcctcagatcgatgacgattatatcatttattaatcatgtacatctctacatggtgtgtaagatgattatcctgtccagatggcagtgatgatactaccctgctgtataaaatctaaactcc

SEQ ID NO: 65797 - DNA, 390 bp, Zea mays
  Clone ID: LIB3075-019-E9-F2A
gcctgtaacacattactgaattcaagattgaaattgttctgcatttacatgaaacacaagagggagcgttcctatggggaaaattcactacatcaaatcaatgacgaatctatcagggattaaccagatacatctcttcaaggaaagtacggagagaggaatgtccagatgggggtggtgagactaccctgctatctaaaagctaaactccccatgatcaggtagccaaggtgtgtgtcggtaaaagaataatgtttacttaattctccaaaatggtgtaagaaccaatttccgccttatctgccttcaaaccttttttactggcctaggaaaacatttggtctagctttgagccagagcaccatcttcttggataagcggggaattatt

SEQ ID NO: 65798 - DNA, 278 bp, Zea mays
  unsure at all n locations
  Clone ID: LIB3075-019-E9-R2A
ccgaccgtgaagatagaagctcctgaagccagcagtcttttctttagaaaggccaaagcgagacggagacggacacgactaggattctgttgatgctacgcacaaggccgactacgctgagagaatctgccnctacagcaaccaaaacagctaaccaaaagtgacagcattgaatngtcaatgccagagtggcgtccacacacttcgaccaattgcagaaggcgtggacatcactaacgattacaatcctatacctgagagcaaagaaagacatgacc

SEQ ID NO: 65799 - DNA, 455 bp, Zea mays
  unsure at all n locations
  Clone ID: LIB3075-019-Q1-K1-C10-R2B
gcgtgagatcgaggagaagaaggcaagcaggcagagaaagagagagagagagagagatggatgaggagtacgacgtgatcgtgttggggacggngctcaaggagtgcatcatcagcggcctcctctccgtcgatggcctcaaggtccttcacatggacaggaatgactactacggaggagaatcttcgtccctgaatctaaccaagctctggaacaggttcaagggcaacgacagccctcccgagcacctgggcgtcagcaaagagtacaacgtcgacatggtgcccaagttcatgatggcaaacggcgcgctggtccgcgtcctgatccgcaccagcgtgaccaagtatctcaacttcaaggctgttgacgggagctttgtgtacaacaatggcaagatccacaaagtcccggcaaccgacgtggaggccctcaagtcgaacctgatggccctg

SEQ ID NO: 65800 - DNA, 53 bp, Zea mays
  Clone ID: LIB3075-019-Q1-K1-D12
tgctcgacccacgcattcgtccagttgtagatcgccagctggcgatctatatt

SEQ ID NO: 65801 - DNA, 79 bp, Zea mays
  Clone ID: LIB3075-019-Q1-K1-F4
aaaaaaaaaaaaaaaaaaaaaaaaaaaattaaaaaaaaaaaaaaaaaaaaaaaaaaaaagagaaaaaaggaaaaaaaaa

SEQ ID NO: 65802 - DNA, 298 bp, Zea mays
  Clone ID: LIB3075-019-Q1-K1-F7
gcgctgacgcgtgggatctgatccttttattttaccagcagctacaccaccggcgacgttcagccccatcatcttaatcacgaaggatatttcaaaagcagcagtagcttagacaaattagatatgccttttaagattctagttgatatgcatgcattatttagttcacatcgaatgcagcagtgtgttaactatgtagttgcatacctatcatatctaagtatattagacgtctttctaataattatttaggatctgtcatcaataaaaatgttgcaacaattaataataaaattat

SEQ ID NO: 65803 - DNA, 280 bp, Zea mays
  Clone ID: LIB3075-019-Q1-K1-H3
gaaggtcatcggcaaagacgtgattgcggcgaactggagacccgatgccgcttacactggcaacggccaacattactagacttgggattgccttggattcatgcggcacagcgggctatggaccttgagcagctagctaattaaggaggcagcatgcaccgctgaccttatatactactgagacttacagatagtgtatatgtgatgcttacgttcgggttcatgatcgaattccagagagtggtaaacaagcgaaacgttacatcgcaaccttaaatag

SEQ ID NO: 65804 - DNA, 197 bp, Zea mays
  Clone ID: LIB3075-020-D8-R1A
ggatcggcgacggcgaaggtgaagatctggacaatggcggcggcggcggcggcggccattacaagcacgttggctacaagaacattgatgtcgaggggaacctgaatgcctctcagtgcggcggggagtgccgtcggcggtgctccatgacgcaccactattatccgtgcctcttcttctttatcaagtgctgctcc

SEQ ID NO: 65805 - DNA, 413 bp, Zea mays
  Clone ID: LIB3075-020-F6-F1A
aaaaaccctgggtaaagtatatgctgattcaaggtgtactgtttcttactatatattccatcagatgagtctggaagattgcaacatcaaatttcagctaaaaaaattgttctatgcgagctaatatagcctggtaggcgacctaaactctgcattctcatttctcccgcttggcccgtttctgtccatatacctcattgacttccacgcctatatgttatggatgtaactgtcagagctatgcttcctggtggcatcttctttaggttcacgctggaatattctaaagtttttaaaagttcatcatgcccgggctgcttcaaagacatggcgtccagtttgttttgcagctccttcagcttgtcctctacgcaaattgcagggggcgacaatacagccacatactcgcatct

SEQ ID NO: 65806 - DNA, 135 bp, Zea mays
  Clone ID: LIB3075-021-A10-F1A
ggtgaatattacataaataattttagtagaaggaattttattaaaatggaaaacatttagaaaaaatgtggggaaaaccagaagcaagaagaaatgaaacaggtaacaaatacaactttttaactaaaataaaga

SEQ ID NO: 65807 - DNA, 347 bp, Zea mays
  Clone ID: LIB3075-021-A10-R1A
ggcagttgatgatctagacttggtttcaaaaccttgaggaaacggatttaaagatcagtaatatattcattgtgatggtgacctttttgaggtgatgataccgtatgtatagaaggacctcaagtgacatttaacaagcctattgggcgtgtcagcgtctctgggcacaagtttgtcggatgccccatgccatgtaaacaccaaataaataggttggagcgtataaatgccctttctagcaatgtggagtatctggcgtcaagggatgcaccatcatgggaagcaggaatggacatgcccctatcttcctctggtacaccctcagcaggaagggctacagaggcttt

SEQ ID NO: 65808 - DNA, 369 bp, Zea mays
  unsure at all n locations
  Clone ID: LIB3075-021-E1-F1A
gacgtgtacgtaagnttgcatgatctaccgcccttgatttttttttttttcttcgcgntactgaaagtttgtataaattagacaaggaatccggttaggaatcgttgagacncacgaatccggcacaaacgacgaacggcttagtacggcacgatcaagctatggagaagtgtcgtggaggacggttttagantcgtnatgcataactactgcaccacccgtgcagtggaatacgagngcatggtttctttatcggcncaaacaggcaaattaacactatcaaatccctttagaaagtgacngacgacgatttagngataggacaaattaaaccaagttccaaacacactcacacacacgatatatata

SEQ ID NO: 65809 - DNA, 318 bp, Zea mays
  Clone ID: LIB3075-021-E1-R1A
tatatatatggtgtgtgtgagtgtgtttggacattggcttaatttgtgctatcgctaagtcgtcctcgttcactttctacagggatttgatcgtgtcaattcgcatctttgggccgatcccacaaaccatgcgctcgtattgcacggcacggctggtacagtagttatacatgacgagtctaaaaccgtgctgcactgcacgcgtcgatacgcgctatcgtggccgtgtaaggacttgttcgtttgtaccggattggtgggtctgaacgattcctaaccggattgcttctctaatttatacaaactttgattagctgg

SEQ ID NO: 65810 - DNA, 185 bp, Zea mays
  Clone ID: LIB3075-021-Q1-K1-C4
agcggctcttgtccgcgccacaagataccaattgttgcgctgggaatattcagttacgaggacccgctctagctcatagggtttttcgggggggttggatccatcatttggctgtagcgcgaatcgcatggacaacagactccaatttctaagcaaatatctttcttctgcatctaaaaaacaat

SEQ ID NO: 65811 - DNA, 290 bp, Zea mays
  Clone ID: LIB3075-022-A3-F2A
caaaactctacgtgctcatcgttcggcagcatatttccacatttctcatcgactcgaagatagtaacaaaaacggcgtggggaaaggcgtacaagttcacggtgcgcgtaggcacgacacagacacagacacagacacagcgcactctcgacgtccaaaataacatcccggtagacgaaccagcggcgccgttcccggttccggcgttccccgtccaccggttcagaaaatcgcgggaagccggttgagcgggtagaggtcgcgcaagccctggaagtcgtcgttctcct

SEQ ID NO: 65812 - DNA, 273 bp, Zea mays
  Clone ID: LIB3075-022-Q1-K1-H10
gggcctaagaataaagcggttttcattaaagaacattaatcacctgttgtgcttgtcgcatatgggaacttaacatccatcgcctcaaattttggaatagaattcaccagattacatgttcgttctcaagggtttacatgagttttaaagaccaattttcttgtttatgtcgttggcaccaacaatttggttttttttcaccagagcgttcccaatttttttttttttttacacccaaacgcttcaatttttattttgtgatgggaacatttt

SEQ ID NO: 65813 - DNA, 363 bp, Zea mays
  Clone ID: LIB3075-023-Q1-K1-B9
aagacgaggtagaggagggggcgagcgacataggcagtggaggggcacggtgaggaagccggcggcgcgcgcgcgcttgcggggccggcggcctggcgaagggggaggtggacgagctgcgccagctcagaggccaaggccaggagctctgggaccacaacggaggcaacggaaacccacgacaaaggcggagatgacctgaccgcgaacatggaacaaacaaggctgattatagggagggaaggctaagatacaactcggaaatacaggaagaacaagggaaacgaaccaatcacccccgtggaagctgacccctgagagaacgaaaaccgggaaaagggacccaactgaaacaaaattgaa

SEQ ID NO: 65814 - DNA, 299 bp, Zea mays
  Clone ID: LIB3075-025-Q1-K1-E4
aaacgggaatttcagttctgatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggag

SEQ ID NO: 65815 - DNA, 601 bp, Zea mays
  Clone ID: LIB3075-026-Q1-K1-G6.F2
caaaaaaaaaatgtaaatctggaaaataatttagcgagagagagagagagcccttgcaagctcactcagatggagagaaggaacgatacaagagtttcaaatttgaaccatgaaaattctgcctactctacataaataagagcagaaaacaacagcgcttaattgattcagaaaattaggcttctcttttcttggaccataccatgacaagagcaaatcccattaaggacatcaacacaaccgatatggctggaggcacacccactagtggatctgggaagaacttatttgctaaagcaagagcaagaaggctgctttgcattcctgtctcgaaagatattgtcctttgtagtgcctttacgtcgtctgacttgctaaaccaagtaccagcaagatgataaccagctacaaaagatgaggtgtggaatgcaaaaaggagcagcactatggttaatccaaatggcgacaaaacagccttgatatttattgccaatggtgagccaacacacagggcagtgacaaacaccgacatcgaagggagaaatggctgaatagctgcacagagccttggaaggaatctattcagaagcaatccggcagc

SEQ ID NO: 65816 - DNA, 53 bp, Zea mays
  Clone ID: LIB3075-026-Q1-K1-G6.R1
atctctacagtataggtcgcctgacgaactcacaaatcagaaggatacgccga

SEQ ID NO: 65817 - DNA, 665 bp, Zea mays
  Clone ID: LIB3075-026-Q1-K1-G6.R2
atctctgtggagtaggtcgcctgacgagctgagggatcacaaggatacgccgagacgcgcgtctcgtttctcccttcctcagctgctggccccctgcctgcagccattgccccgctcctcgaggtcaaatggcccctgcccccgctctcaccgccacatccgtcctgaagcgatcccacctacccggcgtccactcgttggccggtcgccggcagccggggcgggaccgcgtctcggtgctttctccagcgatcccgccgccccgcgtttcatggcagcaaggatctggagtggttgctaagaggctcctctgggcgagtgcgagtggttccttcgagaaagataacatcggggaggacgtggtgttgccttctcagatagcggtggagaataaagtagatttgttgaagattttgaagagtgccaactcaattattccccatatagtgctggggagtacaattctcgcgctggtgtacccgccttcgttcacatggttcactaccaggtactatgcaccagctttggggttcttgatgtttgctgttggtgtaaactcaagcgccaatgatttcattgaagcaataaaaaggccagatgctattgctgcgggctatatcggacagttgtcattaagcccttgtttggattcctttttggcactc

SEQ ID NO: 65818 - DNA, 273 bp, Zea mays
  Clone ID: LIB3075-027-Q1-K1-A8
tcgcccacgcgtccggtcgctccggactagtttgttttgtacaataatgtctgaaagaacgagcttgtgcggccgaaattcggagagctgtctttatctggtgcgcacagtctgtctctttgtttcttcatgctcagcctcatgagataacgatatatttatgacagctccaacaataatttgtaagctaaattcaagcattttattttatatttcaataaagaaagggagaaaagctacctcctgatcaaaaaaaaatgttagataccaaaa

SEQ ID NO: 65819 - DNA, 237 bp, Zea mays
  Clone ID: LIB3075-027-Q1-K1-B6.F2
ggttggttttttaaaatttttttttttttttttttttttttttttttttttttttttttttttttttttttttttttttttcttttctctttttttttttcaaacccccacgaaaatctgggaccaactcaggttctctaaattaaaggggggggggggttccctaaagaaaagaattttcaaaaccaaactccgtcagggggcaatattttaaggagggaaacacatggggtcgtt

SEQ ID NO: 65820 - DNA, 588 bp, Zea mays
  unsure at all n locations
  Clone ID: LIB3075-027-Q1-K1-D8.F1
gatagcacttcgccctcctaataaatcagcaaaaatgcatttacatcatatgggattcgtgtgttgggaacgtcagtttancagcagctacaaaattggcggcatgcataaaaaaacagattctcagctatatatttagggttcaacagaaacatccttgctgagtagtccgctcgaggcaaccttcaccttcttctccttgccctttttacctgatttgccagattttctcttcttgcttgacttctgtggtacaggtgaagcaggccgaggctctgcaagttcaccgttctccgcagacgaaccgttcatttcatctttgattgttcccgcatctacatctggatctaccacggacattcgcatcagcgtatagtccaacagaaacgtgcttcggactagtctatcgactcggctgaaatgcctctgcgaatacggaataaggccctcaaggagctcactgatgcccttgatctccaggatatcagtgggagagaaactcctcaataaccgaataagcacaaactgtgcaacatgacagaacttgggcttcgtattccattcacggacgtattcaagaagcacgcg

SEQ ID NO: 65821 - DNA, 526 bp, Zea mays
  unsure at all n locations
  Clone ID: LIB3075-027-Q1-K1-D8.F2
gatagcacttcgccctcctaataaatcagcaaaaatgcatttacatcatatgggattcgtgtgttgggcaacgtcagttgcaacagcagctacaaaattggcggcatgcataaaaaaacagattctcagctatatatttaggggtcaacagaaacatccttgctgagtagtccgctcgaggcaaccttcaccttcttctccttgccctttttacctgatttgccagattttctcttcttgcttgacttctgtggtacaggtgaagcaggccgaggctctgcaagttcaccgttctccgcagacgaaccgntcatttcatctttgattgttcccgcatctacatctggatctaccacggacattcgcatcagcgtatagtccaacagaaacgtgcttcggactagtctatcgactcggctgaaatgcctctgcgaatacggaataaggccctcaaggagctcactgatgcccttgatctccaggatatcagtgggagagaaactcctcaataaccgaaaaagcacaa

SEQ ID NO: 65822 - DNA, 539 bp, Zea mays
  Clone ID: LIB3075-027-Q1-K1-D8.R1
agaagaccacacagacttctagatttattctcaaagcttgcaagaagagctgatgcagaggatccaatagaaaaggctcttcttggtcttccaacggatggccttcgcgtgcttcttgaatacgtccgtgaatggaatacgaagcccaagttctgtcatgttgcacagtttgtgctttttcggttattgaggagtttctctcccactgatatcctggagatcaagggcatcagtgagctccttgagggccttattccgtattcgcagaggcatttcagccgagtcgatagactagtccgaagcacgtttctgttggactatacgctgatgcgaatgtccgtggtagatccagatgtagatgcgggaacaatcaaagatgaaatgaacggttcgtctgcggagaacggtgaacttgcagagcctcggcctgcttcacctgtaccacagaagtcaagcaagaagagaaaatctggcaaatcaggtaaaaagggcaaggagaagaaggtgaaggtttgccctagcgggatactcagcaagga

SEQ ID NO: 65823 - DNA, 652 bp, Zea mays
  Clone ID: LIB3075-027-Q1-K1-D8.R2
agaagccacacagacttctagatttattctcaaagcttgcaagaagagctgatgcagaggatccaatagaaaaggctcttcttggtcttccaacggatggccttcgcgtgcttcttgaatacgtccgtgaatggaatacgaagcccaagttctgtcatgttgcacagtttgtgctttttcggttattgaggagtttctctcccactgatatcctggagatcaagggcatcagtgagctccttgagggccttattccgtattcgcagaggcatttcagccgagtcgatagactagtccgaagcacgtttctgttggactatacgctgatgcgaatgtccgtggtagatccagatgtagatgcgggaacaatcaaagatgaaatgaacggttcgtctgcggagaacggtgaacttgcagagcctcggcctgcttcacctgtaccacagaagtcaagcaagaagagaaaatctggcaaatcaggtaaaaagggcaaggagaagaaggtgaaggttgcctcgagcggactactcagcaaggatgtttctgttgaaccctaaatatatagctgagaatctgtttttttatgcatgccgccaattttgtagctgctgttgcaactgacgttgcccaacacacgaatcccatatgatgt

SEQ ID NO: 65824 - DNA, 131 bp, Zea mays
  Clone ID: LIB3075-027-Q1-K1-F12
ccagttttagttaatgtgctccatgcttgacgtttaaaaaaaaaaaaaaaaaaaaaacaaggagaaaaaaaaaaaacaaaatggggaacacaaaaataaaaaaaaaaaaaatataatataaaaaaaactaa

SEQ ID NO: 65825 - DNA, 285 bp, Zea mays
  Clone ID: LIB3075-027-Q1-K1-G12
cacaaccactgtgggtactgccaactggttagggctcgttcggttagctctcaatccatgtggattgagtgagattggatgagtttgaatcccaaacaaattaaacttaattttttccaatcccatctaatccatgtgtattgggaataaccgaacaaggctttactgttttaaaaaaaatagataaaatcaataaataaaataaataatactgatattataagtaacaatttaatatactattggtcatcagttttaacatggtcacttactctgtatgtattt

SEQ ID NO: 65826 - DNA, 144 bp, Zea mays
  Clone ID: LIB3075-027-Q1-K1-G3.F1
actagaaattacaacactatatatatctcaagacacaggaaccctttggtagaataacaaatgaataaaacctgttgctgttcttaaaaaaaatcagtacatctgtaataaacgtttcaagccaacagttagtactgtccaaat

SEQ ID NO: 65827 - DNA, 614 bp, Zea mays
  Clone ID: LIB3075-027-Q1-K1-G3.F2
actagaaattacaacactatatatatctcaagacacaggaaccctttgtagaataacaaatgaataaaacctgttctgttcttaaaaaaaatcagtacatctgtaataaacatttcaagccaacagttactacttccaaatgaagaacgtctgggaacaaaaaaaaaactgaaactgaaactttcaaagctacaagattctacccaacacttttcagaatcgagccgatcgccatggcggctcgacctccagagaagtctagatcataagcgaggaagatgtctgtatgacgagggcaagcaacaacggccaaaactgcctggctgcctccactgaaggccggcctactccaccggcaccatcttcaccgccacggcgataggcatgcctacgaacccgatggcgacgcaggcgacccactgcgcgaggctgagaggggtcgtgttggcgaagctaccgaggcactgcacgatcacgaactggaacacgacggtgctgccgaggaccatgacgaacacgttgttgtccaggatgcctcggaacacgttcaccctctccatctccctcgagttcacctcgttgaaaacctggcagaacacgaagcagttgaagat

SEQ ID NO: 65828 - DNA, 589 bp, Zea mays
  unsure at all n locations
  Clone ID: LIB3075-027-Q1-K1-G3.R1
ggagcatnngngnacgttggccacggagccccccaacgacgagntcatgaagaggactcccgtcggaaggaaaggcaacttcatcagcaacaccatgtggaggaacatcatggggcaggccctctaccagttcctcgtcatctggtacctgcagtctagggggaaacggctcttctggatcgacgagggcgccgccgacgccgacctggtcctgaacacggtcatcttcaactgcttcgtgttctgccaggttttcaacgaggtgaactcgagggagatggagagggtgaacgtgttccgaggcatcctggacaacaacgtgttcgtcatggtcctcggcagcaccgtcgtgttccagttcgtgatcgtgcagtgcctcggtagcttcgccaacacgacccctctcagcctcgcgcagtgggtcgcctgcgtcgccatcgggttcgtaggcatgcctatcgccgtggcggtgaagatggtgccggtggagtaggccggccttcagtggaggcagccaggcagttttggccgttgttgcttgccctcgtcatacagacatcttcctcgcttatgatctagacttctctgg

SEQ ID NO: 65829 - DNA, 647 bp, Zea mays
  Clone ID: LIB3075-027-Q1-K1-G3.R2
cggacgcttgggctggcgttgagccacggagccccccaacgacgagctcatgaagaggactcccgtcggaaggaaaggcaacttcatcagcaacaccatgtggaggaacatcatggggcaggccctctaccagttcctcgtcatctggtacctgcagtctagggggaaacggctcttctggatcgacgagggcgccgccgacgccgacctggtcctgaacacggtcatcttcaactgcttcgtgttctgccaggttttcaacgaggtgaactcgagggagatggagagggtgaacgtgttccgaggcatcctggacaacaacgtgttcgtcatggtcctcggcagcaccgtcgtgttccagttcgtgatcgtgcagtgcctcggtagcttcgccaacacgacccctctcagcctcgcgcagtgggtcgcctgcgtcgccatcgggttcgtaggcatgcctatcgccgtggcggtgaagatggtgccggtggagtaggccggccttcagtggaggcagccaggcagttttggccgttgttgcttgccctcgtcatacagacatcttcctcgcttatgatctagacttctctggaggtcgagccgccatggcgatcggctcgattctgaaaagtgttgggtagaatctt

SEQ ID NO: 65830 - DNA, 575 bp, Zea mays
  unsure at all n locations
  Clone ID: LIB3075-027-Q1-K1-H1.F1
acagggagagatctctgcgctataaaattatatatagctcacagatatttagaaaatttcaggggattgcatacatacataattctcctaggaacctgacccctacactacacatgctaccaggctgattctgtaaattacacgaagggnccctcaagcaacacgatgctattgctcttcctctgccgcctcctccccctcctcttcatcagctgcccaccaaacaagaagaccaaggccatcccctttaatacttccaacaatctgcattggagcaaatggtgggtcatcctcattttgatcaattggtataggcgggtattttgtgctagaaaccaagaaccttatctcgtcatctagatctagataaagctcatcgcctaattcagtcttcagcatccacctaccatctggtccccttactgtgccaaactgcatcaagtgtccaggtatgcaaatgtcactgaagaattcaagtgaaacctgcaatcccttaatcggcatatccagtaatcctcccaacaagaatctccccattaaaaggcttgaacatcagcaaacgtaatggaacttta

SEQ ID NO: 65831 - DNA, 599 bp, Zea mays
  Clone ID: LIB3075-027-Q1-K1-H1.F2
acagggagagatctctgcgctataaaattatatatagctcacagatatttagaaaatttcaggggattgcatacatacataattctcctaggaacctgacccctacactacacatgctaccaggctgattctgtaaattacacgaagtgagccctcaagcaacacgatgctattgctcttcctctgccgcctcctccccctcctcttcatcagctgcccaccaaacaagaagaccaaggccatcccctttaatacttccaacaatctgcattggagcaaatggtgggtcatcctcattttgatcaattggtataggcgggtattttgtgctagaaaccaagaaccttatctcgtcatctagatctagataaagctcatcgcctaattcagtcttcagcatccacctaccatctggtccccttactgtgccaaactgcatcaagtgtccaggtatgcaaatgtcactgaagaattcaagtgaaacctgcaatcccttatcgtcatatccagtaatcctcccaacaagaatctccccattaaaaggcttgaacatcagcaaacgaaatgaaactttataagtcgagcagccctcccctgga

SEQ ID NO: 65832 - DNA, 499 bp, Zea mays
  Clone ID: LIB3075-027-Q1-K1-H1.R1
gaacaaagtacaggtccatttctagcctatcgagctcctcaggtagtaaaaccctacctacacctcgtgccgcctccgtcgccggctcgcctccccatcgacgcgcaggcagccctgcgtgttgctccccgtcggtcgggaaaggggcgcgccggcgctgcctccagcagtcggctcgccgcatccaatcacggcgcctccctcctcgattggctcctcggtggttggttgttataggcaggcgggaaggatgttctcgctgagccagatcgagcacgacctcccgatgccgccgcacctgctgagccgcccccttcccgacgccatcaaggccgagctcgagaggctcttcttggacaaggtaatcacaaaacttggggctgtgcgtgtctgtctatgatatccgatccattgaatgcggttccatccatccagggggagggctgctcgacttataaagtttcatttcgtttgcggattttcaaggcttttaatgggg

SEQ ID NO: 65833 - DNA, 661 bp, Zea mays
  Clone ID: LIB3075-027-Q1-K1-H1.R2
cgaacaaagtacaggtccatttctagcctatcgagctcctcaggtagtaaaaccctacctacacctcgtgccgcctccgtcgccggctcgcctccccatcgacgcgcaggcagccctgcgtttgctccccgtcggtcgggaaaggggcgcgccggcgctgcctccagcaatcaactcgccgcatccaatcacggcgcctccctcctcgattggctcctcggtggttggttgttataggcaggcgggaaggatgttctcgctgagccagatcgagcacgacctcccgatgccgccgcacctgctgagccgcccccttcccgacgccatcaaggccgagctcgagaggctcttcttggacaaggtaatcacaaaacttgggctgtgcgtgtctgtctatgatatccgatccattgaaggcggttccatccatccaggggagggctgctcgacttataaagtttcatttcgtttgctgatgttcaagccttttaatggggagattcttgttgggaggattactggatatgacgataagggattgcaggtttcacttgaattcttcagtgacatttgcatacctggacacttgatgcagtttggcacagtaaggggaccagatggtaggtggatgctgaagactgaattaggcgatgagctttat

SEQ ID NO: 65834 - DNA, 344 bp, Zea mays
  Clone ID: LIB3075-028-Q1-K1-E12
ggtgtggaaggcaatatctccggcggtcttgcagtcgtcgttcaacaccacgccggagatggagaagctgttccgtagcaagaggcttgactcggagatcttctttgcgccttcaaactgattcattcgccggtggaaaatggtccatccatctcgagtaaacttggtgtcctgggtgtgttctttagcagcttcagtttagaataatcaggttatgtcttcatcatcagttttttagatcggttcatgtaataataaacttgagatggtacacatgtttcttaattagttctcttggtattctttaaaaaacaaacacagtcctaaatgtgaacatgaaacaa

SEQ ID NO: 65835 - DNA, 548 bp, Zea mays
  Clone ID: LIB3075-028-Q1-K1-F8.F2
aaaaactagaaattacaacactatatatatctcaagacacaggaaccctttgtagaataacaaatgaataaaacctgttctgttcttaaaaaaaatcagtacatctgtaataaacatttcaagccaacagttactacttgcaaatgaagaacgtctgggaacaaaaaaaaaactgaaactgaaactttcaaagctacaagattctacccaacacttttcagaatcgagccgatcgccatggcggctcgacctccagagaagtctagatcataagcgaggaagatgtctgtatgacgagggcaagcaacaacggccaaaactgcctggctgcctccactgaaggccggcctactccaccggcaccatctttaccgccacggttataggcatgcctactaacccgatggcgacgcatgcgacccactgcgcgaggctgagaggggtcgtgttggcgaagctaccgaggcactgcacgatcacgaactggaacacgacggtgctgccgaggaccatgacgaacactttgttgtccatgatgcctcggaaca

SEQ ID NO: 65836 - DNA, 162 bp, Zea mays
  Clone ID: LIB3075-028-Q1-K1-G5
acggagctactttgttatgcatttatcgtgtcattttttggttttaccttaccaaacttatctattataataaattcaaacattctggggaaacaattagtagaaaatttatggaaattttctgatgtgtggtgggcatgtccaaccaataaaaaaataaaa

SEQ ID NO: 65837 - DNA, 400 bp, Zea mays
  Clone ID: LIB3075-028-Q1-K1-H8.F2
gggaacaaaatttaatttattccaaggggcaaaacaaaaacggggtccccggaaggggtccctggggacaaaaggggataagaaaaatagcaaaaaggtggggggctcccaaaggggggccatgggccccaatgggcccatagcaaagggcctcattttccttccaccggggggggggggggggaccccctgttttgggaagcccgccccacccaagggccaccactttagggggggggaggcaaagggtttcaccaagggttccgaaacccactacccaacttggaaggggggggccacagttgggggccctagacccaggcccatgccccacaatgggcatccaccctcccttattgcccccggtggggttacaagcaatcgctaccggacccgtggg

SEQ ID NO: 65838 - DNA, 415 bp, Zea mays
  unsure at all n locations
  Clone ID: LIB3075-028-Q1-K1-H8.R1
cccacgcgtccggtagcgattgcttgtaacccgagcgggggcaataaggtagtgtggatgtcaattgtggtgcatgtgcctgggtctagtgnctacaaactgtggaccacccattccaagttgtgtagtgggtttcggatgccttnggtgaaagcctttgcatcccaacacctaaagtggtggacattgcgtgaggctggcttcacagagcagcgagtaccgcccgccaccagcggtgggaaggataatgagtcgctatgctataggccaattgaggcacatgtgccctctctggtagaccactatctttttgctatttttcttatctacttttgttcctatgtaaccattacgagtatcacgtttttgttctgcatcttgggataaattaaattttgatctaaagaaaagggaa

SEQ ID NO: 65839 - DNA, 399 bp, Zea mays
  Clone ID: LIB3075-028-Q1-K1-H8.R2
cccatgcgtccggtagcgattgcttgtaacccgagcgggggcaataaggtagtgtggatgtcaattgtggtgcatgtgcctgggtctagtgctacaaactgtggaccacccattccaagttgtgtagtgggtttcggatgccttggtgaaagcctttgcatcccaacacctaaagtggtggacattgcgtgaggctggcttcacagagcagcgagtaccgcccgccaccagcggtggaaggataatgagtcgctatgctataggccaattgaggcacatgtgccctctctggtagaccactatctttttgctatttttcttatctacttttgttcctatgtaaccattacgagtatcacgtttttgttctgcatcttggaataaattaaattttgatct

SEQ ID NO: 65840 - DNA, 274 bp, Zea mays
  Clone ID: LIB3075-029-Q1-K1-A10
ccgaattcggctcgagcattattctttcacttttcgatcaacttgtggctatagagtcgtcggtgataattgtgggcacgaggggtgtcagaaaccgctgccttcatgagggggctgaaatacccttcccatactccacgccttgcctggacacaatctctagacctactaccgtagctaatacgtagataccggtgccatacctgtgtagatacttgactcttactccacaagtgatggctgttcccgacatatatataccgaccctttcacg

SEQ ID NO: 65841 - DNA, 332 bp, Zea mays
  Clone ID: LIB3075-029-Q1-K1-B12
attcggctcgagatatattctcaacttattagaacactctcacccttagatctctcatgttgttatcctccgaatctatggcctctattattttctttaaccctttacttttcatctcaccacttattatttattacgcgtccttccttctctctccctttcccatctatataaaacccaccattttccactttcatctacttgtgttctgttgtgtactctctattctcataagataactaactcactctgtgtgataaagttctcatactcatagctattaccgccgatattttccggcagaacatatcgcaaatgcttgcggagtcccc

SEQ ID NO: 65842 - DNA, 182 bp, Zea mays
  Clone ID: LIB3075-029-Q1-K1-B9
ccgaatcttgctcgagagaaacaaactcctattatcactgatccgaaaactactttttctcttagaagttcactagatgatatatattaatattacacacatatttagaaatcgatataaatcctttcgtgatattgttccttgcacggagcgttatcataatatatgcttcacgtgctcac

SEQ ID NO: 65843 - DNA, 233 bp, Zea mays
  Clone ID: LIB3075-029-Q1-K1-C10
attcggctcgagatacattctgaacgtaatgagaacactctcacccttggtacacaacgggagtttatgcaggactatacgaacaaggttattgaccggcatatgtttagtcaaagcatgaaaaacgtgctcccactcaacattcttatggaggacatgcaaatactcaatcgacctaccctcaagctggtgctcaaccaaaataccctgcaccgtatcaatatgtttagcca

SEQ ID NO: 65844 - DNA, 441 bp, Zea mays
  Clone ID: LIB3075-029-Q1-K1-C11
attcggctcgagattgatatgagcgagcttgatgaggattctgatggtttccttcagcgacattaaatggaggcctatatacgaggtctgatacccaacttggcacagttacgtgacatgccagatgcctttgttcaaatgtattgtcgtattgctgcacacaaattcttcttcttttgcgagccttatagacgaggaaaagcttgcatcaagaaagtattgcttagtaattgactcctggaactcatggagcttgaccaggaaagtgaagaagaagtcacggacacagagcaagccgaaaactggttctctttgacttctgctgaacgcatatgtgacatgtttcttgctcttgataaagatacaaatgggacattaagcaagcatgagctttgagaatatgcagatgcaactctggctgatattttattgagagagtat

SEQ ID NO: 65845 - DNA, 392 bp, Zea mays
  Clone ID: LIB3075-029-Q1-K1-C9
ccgaattcggctcgagattgatatgagtgagcttgatgaggattctgatgggttccttcagggacattaaatggaggcctatatacgaggtctgatacccaacttggcacagttacgtgacatgccaactgcctttgttcaaatgtattgtcgtattgctgcacacaaattcttcttcttttgcgatcctcatagacgaggaaaagcttgcattaagaaagttttgcttaataattgtctccaggaactcatggagctttaccaggaaaggtaataaaaagtcacggacacaaagcaagccgaaaacttgttctctttgacttctgctcaacgcatatgtgacatgtttcttgctcttgataaagatactaatgggacattaagcaagcatt

SEQ ID NO: 65846 - DNA, 205 bp, Zea mays
  Clone ID: LIB3075-029-Q1-K1-D11
ccgaattcggctcgaggtttgattgatatgtttcataactacttcatatgtgactacttgttgggctcgtatttaggatgatatgaaactgaattatatcttgtgccttatcattaaggaatatcattgagttccaatttaattgaatgtcaaatcaatgtaatgagggagaaaaacattggcttctgaaaaaaaaaagactaca

SEQ ID NO: 65847 - DNA, 218 bp, Zea mays
  Clone ID: LIB3075-029-Q1-K1-D3
aaaaaacaagaagcaagttgtttggtcctgattgcagggtcgattggtgagctgatgtatatcggagtaatgtaacgacagaaaaaagaagtaactactacagaaactatttatagaagcggtagattcacttcataggctatagcaactgtctttaccaagggtatgtagaaaatgatttattaaaaataatagtatttattaaataaaaaaaataa

SEQ ID NO: 65848 - DNA, 232 bp, Zea mays
  Clone ID: LIB3075-029-Q1-K1-D9
ccgaattcggctcgaggcttgattgatatggctcatagatacttcatatgtgactacttgttggactcgtatttaggatgatatgaatctgaattttatctcgtgccttatcattacggaatatcatcatggtccaattaaattgaatgtcaaatcaatgaactgaggctgaaaaacattgacttatgtaaaaaagcttgctttgatagggcggtcgtcgactagtgagctc

SEQ ID NO: 65849 - DNA, 148 bp, Zea mays
  unsure at all n locations
  Clone ID: LIB3075-029-Q1-K1-G11
ncgaattcggctcgaggtcacacgttcgaactttatggcctgttacagctactacgcttcaggcatgtccacaagtgcccataggagactgcctctcataatcacacgctctgcatttatgattgcatttccgtattgcacctcacaa

SEQ ID NO: 65850 - DNA, 413 bp, Zea mays
  Clone ID: LIB3075-029-Q1-K1-G12
attcggctcgaggaagaaagaatacgcgcagagtggactttgacctcagcgccgtttgggtccgaaccaagacgcacacaggacggtgcgttcaccaaacctaccttggtgggccccacttttcccccgaaccgtagcttcagagtgatccctttcgcaccctctatataatagcgccctcgccactcgcctcgacgcgtgactctcgcgggtggacaacgaaatttctcagccaaagaacaaggatcagaatcgtttaatcaagttgaggaagatggcactagtctccggaggaagatcaacactgaaccctaacgcccctctttacattcccgccgcgttccgccaagtggaggatttttctccagaatggtggcagctggtgacgacactgacatggtaccatgactact

SEQ ID NO: 65851 - DNA, 179 bp, Zea mays
  Clone ID: LIB3075-029-Q1-K1-G9
attcggctcgagcatcaactcacgacctttcttgcctccttagcaatcttcgcttaatgcttctgttcaatgtccacattcattattcctctctcactcacaaacttttaatttctgctttcaaatccttattccacccatttggcattattgttacatatactttattaaggaagatc

SEQ ID NO: 65852 - DNA, 353 bp, Zea mays
  Clone ID: LIB3075-029-Q1-K1-H10
attcggctcgagcgcaagccggaggaatgaatcccaggccaggtgatagctggaggggaaggaacacgatgtgtcggttggatcgaccatgatttccgggagacagacggctgggaccgcggcacacagccgatactacagcctggactaccaggagccggcgccggctccactggatgagccgacagagtttacatcatggtcagttatacagaacaggtgtcgcaaagtttgaggccactgatttacttctgtacaagtacggtcttatccgttatggtaggtgccggtgctgtatatatctgtaataccgtttggacacatggagtatcttgtaccttcagtgccatgat

SEQ ID NO: 65853 - DNA, 354 bp, Zea mays
  Clone ID: LIB3075-029-Q1-K1-H11
gttcggctcgagaaaggaaccaaccactttttgctttcaccgatcatacatacaatgtgcgcttacatagacgaccatgcgcgtcttcatgacatccctactaaaagtggtgtagaacctaatttcaccaaacctggaattgcagctcagagtttcattgtaggatctcccattgctatggcaataagagcagcgctagtaccattgacgaagccattaaacattgcctgtcaaagttactctctaagagtatattctggaatatcgaagacactgacttgacatgcatgttggagccagtgaacctggtgagcgtgctttaaaggttgatgatttgattgccactgctggaac

SEQ ID NO: 65854 - DNA, 457 bp, Zea mays
  Clone ID: LIB3075-029-Q1-K1-H12
attcggctcgagcgcaagcaaaaagaaagaatcccaggcgaggagaaagatggaggggaaggagcaggatgtgtcgttgggagcgaacaagttccccgagagacagccgattgggacggcggcgcagagccaagacgacggcaaggactaccaggagccggcgccggcgccgctggttgacccgacggagtttacgtcatggtcgttttacagagcagggatagcagagtttgtggccacttttctgtttctctacatcaccgtcttaaccgttatgggagtcgccggggctaagtctaagtgtagtaccgttgggattcaaggaatcgcttgggccttcggtggcatgatcttcgccctcgtttactgcaccgcttgcatctcagggggacacataaacccggcggtgacatttgggctgtttttgcgaagaaagtgtcgtttcccaaggcgattt

SEQ ID NO: 65855 - DNA, 395 bp, Zea mays
  Clone ID: LIB3075-029-Q1-K1-H9
attctgctcgagaaatgaaccaaccactcttttctttcaccgatcatacatacaatgtggacttacagagacgaggatccccgtcttcatgacatcaaaactaagattcgcgttgtgcctaattttcccaaacctggaattgaagctcggggtttcatttttgggtctcccattgctctggcaataagagcaaagtttgtaccattgaggaaaccacaaaaaattgcctggcaaagttatttctcaagagtatattctggaatatggaagagactgtcttgagatgcatgttggagccgttgaacctggtgagcgtgctttagtgggtgatgatttgattgccactggtggaactctctgtgcagacatggacttactatagcgagtgggagcac

SEQ ID NO: 65856 - DNA, 325 bp, Zea mays
  Clone ID: LIB3075-031-Q1-K1-E6
tcgtacgacaagatggcgtgcacaaacaatgcgatgagagccttgttccttctggtcctcttgtgcatcgtgcatggtgagaaggaagagtcaaagggcatcgatgcgaaagcgtccaggcctggtgggtccttcgacatcaccaagttgggcgccttcggcaatggcaagacagacagcacgaaggctgtgcaggaggcatgggcatcggcgtgcggcggcactgggaagcagacaatcctcatacccaagggtgacttccttgtcggacaactcaacttcacaggcccttgcaagggcgacgtgaccatccacgtggatggca

SEQ ID NO: 65857 - DNA, 244 bp, Zea mays
  Clone ID: LIB3075-031-Q1-K1-G8
atgataccatagatattatatggattcctaaggttggaaatttgtgtcttccgagtccggtagaatagttgcttcttcctgtctgacagtgaatttgattttgtatggatgtgacatatatatgcctgaccaattgtcattatttgctattcatatatgttactgggtgtatttaatagctctcaatttatgcagttatgtttgcagttgaaaaaaaaaaaaaaaaaaaaaaaaaaatataaaa

SEQ ID NO: 65858 - DNA, 122 bp, Zea mays
  unsure at all n locations
  Clone ID: LIB3075-032-Q1-K1-E11.R2
gcgcggacgcgtgggngggancaaacccggggggggcgcgacacaanaaatacacggaggcgccgacgacgccagctgccgacaggagccaagcccaagccagagcataaaccatagccgac

SEQ ID NO: 65859 - DNA, 592 bp, Zea mays
  Clone ID: LIB3075-033-Q1-K1-B12.F2
caagtgcagtgcagcagctgtattcatccgtaaatgttattaccgtgaatgtatcaatgctgaaagagatgcaacacagatagagaggcagcagcagggaacactttgagcagttacgagggtaatatacacacaagaaccggattggaagtaaaagcagcagcagcaggtggacgccaccacaagcagggaaaatagaaggcaggcagcttcaatgccaccccgcagcgccggcaagctccgaaaacgcctccccaaccaactcgcccaggacctcgccacatatctccctgctcatctcgtccacctccatccgcagcgtctcggcccaccctttgccgtggatctccctaccgacaacccagtccgccgcaaggcccgcgttgtcccccaacccggcgatgtcgttctcgtcatcgaagagccagctcctaaccagcctccacgcctcgtcggtcactagcacatcatcatcgcacgtgccaactcccggagcgttggaatagtgccgtgcggtgcaagggtacgcgcccccccagactttgctctggccgatgtcgagcagggcggcgttgacagagtcgattaggag

SEQ ID NO: 65860 - DNA, 206 bp, Zea mays
  Clone ID: LIB3075-033-Q1-K1-B12.R1
tgcaggaacggtccgaattccgggtcaatcacgcgtccgcccacgcgtccgctcacgcgtccgcccacgcgtccgcccacgcgtccggcgagaaatcccccattttcatcagaaagcgcgattactgctacacaagagcctctatccaggcctatatcaatcggatttatctcgacgaccttatcatagggatgacgctttctaag

SEQ ID NO: 65861 - DNA, 650 bp, Zea mays
  Clone ID: LIB3075-033-Q1-K1-B12.R2
cccacgcgtccgcccacgcgtccgcccatgcgtccgcccacgcgtccggcgagaaatcccccatttcatcagaaagcgcgattactgctaaacaagagcctctatccaggtctataccaatcggatcgatcgcgaggaccttatcatgggacgacgcttcccaagaggctcctccgcagtgttctaccaaaggagacagcaaccacgagcaggagcagcacgagttcgtcgagaagacgctggcatccgctggcttctgcaacgagaagacccaggacatctttgcccggtggcattcgctcgaccggcccttggaccccgccgtggtcgagcagctgctggaacgcaaggtggaggacgccaagtgccgagagaggcggtcgaaccagaggctcctaatcgactctgtcaacgccgccctgctcgacatcggccagagcaaagtctgggggggcgcgtacccttgcaccgcacggcactattccaacgctccgggagttggcacgtgcgatgatgatgtgctagtgaccgacgaggcgtggaggctggtgaggagctggctcttcgatgacgagaacgacatcgccgggttgggggacaacgcgggccttgcggcggactgggttgtcggtagggagatccacggcaaa

SEQ ID NO: 65862 - DNA, 224 bp, Zea mays
  Clone ID: LIB3075-033-Q1-K1-G6
cacagaacgaaccagggtgaagtgaaccaccctactggtcaaatggtgaaaactgaagcgtaggacaggcagcactgatcccactggctttcagtttttctttgtacagaaactgaatgcagttggaacacggaaggaagcccacgagttgcacgttcgggggggaaaaacaatgcataagtacatcaggtatcagcttgctttgtaaaaaaaaaaaaacacaa

SEQ ID NO: 65863 - DNA, 181 bp, Zea mays
  unsure at all n locations
  Clone ID: LIB3075-035-B6-R1A
ctaatctgcagtcatctgctccaccatcaccattaagcccaacaacagccagcctgcgctcacaactatgtgccgcagcacggcatctgtggccgtgcctccggtgtcagttcttgctccagctgtggtcatcgtntcataggtagcggaggtaaagaagaagatagtggcgtagagtggt

SEQ ID NO: 65864 - DNA, 188 bp, Zea mays
  Clone ID: LIB3075-035-Q1-K1-A10.F1
ggccgacgaacgccccggcgaaaagctctccctcgcctgtatgttggcctttatttcctggacaccccgagcacgattacagcagagagtggtggtacatatagccgtggcagagctcccttccaccacccggctccccaccatgtccgggcctttgcgtgtcgtcgtgcccgtagtacgcgttcgtc

SEQ ID NO: 65865 - DNA, 305 bp, Zea mays
  Clone ID: LIB3075-035-Q1-K1-A10.F2
ggccgacgaacgccccggcgagaagctctccctcgcctgtatgttggcctttatttcctggacaccccgagcacgattacagcagagagggggggtacatatagccggggcagagctcccttccaccacccgggtccccaccatgtccgcgcctgtgcgctgcgtcgtgcccgcaggacgcgtttgtccgcacgacccgcacgcgcccaacggtaagggattcctgcgccaccactccaactaactcggatcgcactccctgcatgtgcacgctcaacctaccatgccgactagttttagatcgc

SEQ ID NO: 65866 - DNA, 521 bp, Zea mays
  Clone ID: LIB3075-035-Q1-K1-A10.R1
ggcccgcgtgcagtgcggcccaggccacggcatgagcgtcggcagctatgggtcgctactccggcgagggagacgtcacacgggtgcacgtccgcgacatgaccttcacgggcaccatgaacggcgttcgcatcaagacatgggagaactccccttccaagagcaacgccgcgcacatggtcttcgagaacatggtcatgagggacgtgcagaaccccattatcatcgatcagaagtactgcccctactacaactgcgagcacaagtacgtgtccggggtgactctcaatgacattcacttcaagaacatcaagggcacggcgacgacgcggatggcggtgttgctccggtgcggtgtgccggcaggggtctggtgctgcaagacgtggaccttaggtacaaggggcagggtggtacatcggccaagtgcgagaacgccaaggccaagtaacttggctaccagtttcccaaaccctggccctaggtggcgggtgcttgtccggccgtattttagctcatct

SEQ ID NO: 65867 - DNA, 602 bp, Zea mays
  unsure at all n locations
  Clone ID: LIB3075-035-Q1-K1-A10.R2
ggcccgcgtgcagtgcggcccatgccacggcatgagcgtcggcagcttgggtcgctactccggcgagggagacgtcacacgggtgcacgtccgcgacatgaccttcacgggcaccatgaacggcgttcgcatcaagacatgggagaactccccttccaagagcaacgccgcgcacatggtcttcgagaacatggtcatgagggacgtgcagaaccccattatcatcgatcagaagtactgcccctactacaactgcgagcacaagtacgtgtccggggtgactctcaatgacattcacttcaagaacatcaagggcacggcgacgacgccggtggcggtgttgctccggtgcggtgtgccgtgcaggggtctggtgctgcaggacgtggaccttaggtacaaggggcagggtggtacatcggccaagtgcgagaacgccaaggccaagtaccttggctaccagtttcccaaaccctgcccctaggtgccggtgcttgtccggccgtattttagctcatctctgtccactctctggtgtccggtgaagtgggctntgattcttcggtcgtgttctctagacgttttttcttcttctcttctgg

SEQ ID NO: 65868 - DNA, 444 bp, Zea mays
  Clone ID: LIB3075-041-B12-R1A
caacgctatggccgccgggagggagagggaccgggagatgctcctcccggtggtgggcggggagcatgtcgccggcgatgaggacgactcggatccgaccacccccgtcatcgctgggccgctgccgccaacgacgtccgcgcgcgtgctccacctccaccaccatcccaccggcatcgaggcattctcacgagtgataaggagctgggcgtggaagaagttcatgtctggatggtgcgcaactctcgtacatatgaatactgcgtcatcctgctcccgatcgccatcaccttctacacgacatggtggttcatccgcttcgtcgacggcttcttctcgcccatctacgtccatctcgggatacacctcttcggcctcgggtttgtcactccatcaccttcatcttcctcgtcggcgtgttcatgtcgtcgtggctgggcgcct

SEQ ID NO: 65869 - DNA, 405 bp, Zea mays
  Clone ID: LIB3075-043-B5-R1A
gagagaatgtttgttatctggcgaaggtatctattgatcacaagagattgtactatgatgttgccttattggtgttttatggcgtatgcgactgtgacgagcggggatgtgatatggcgggatatttgtgtaaggaaaaagactgtgaagaatgttgtaatttggcttgcattctcactgtcgtgcgatagcaaagaagcggctatgggaccgttgtgattggtttgtgatatgaagtttggaagaaggaaggtaaagttgggagataggagagtcgtgtttctgatgttggactcgtgagctatagaggttattggactagagtggttgtggaaattgtagagaaacataagggtaacatatgtataaacgacaccagcgccatggaggtaatacaaggggttg

SEQ ID NO: 65870 - DNA, 583 bp, Zea mays
  Clone ID: LIB3075-043-D3-F1B
ttattattttttttttataatagtgtgataatcaatcttaagcgaaaaagaggtgatatatatctgtatgtcgcccatccaatggaatttctcctacctaaagtacaagattgggtccgacgcagcaaagatcgacgacgtcggcatcccatcggcgaaccacgagacatcgccaccgaacgcgctgacggcgcctcctaggtcgtccccttgttgaccacattggtcagggagcccggcggcagggcgaacatctggacccatgatcatcctccacgttgaatcgttaattacgtactctactaattacggttacgtactcgctgaaccgaatcaacggaagtaattatgtgttccaaccataattattaaagacaccagacacctacgtacgtctacgtgttgttgcatgttggaggccgacggatcgaacggggccacgtggttgcacagcaaatatttctttcgctcctccacgcaagtgagggtgtccatgaggaatttctcacacgtctcgaaatcgttcatcgacatcaatgttgtcagatctaagttgctcctttaagacttccatctggtgttg

SEQ ID NO: 65871 - DNA, 401 bp, Zea mays
  Clone ID: LIB3075-043-D3-F2A
gtaagcgaaaaagaggtgatttatttctgtatgtcgcccatccaatggaatttctcctacctaaagtacaagattgggtccgacgcagcaaagatcgacgacgtcggcatcccatcggcgaaccacgagacattgccaccgaacgcgctggcggggcctcctaggtcgtccccttgttgctcctgttggtgaggcggcgccggcggcagggcgaacatttggacccatgatcatcctccacgttgaatcgttaattacgtactctactaattacggttacgtactcgctgaaccgaatcaacggaagtgattttgtgttccaaccataatttttaaagacaccagacacctacgtacgtgtacgtgttgttgcatgttggaggccgacggatcgaacgggg

SEQ ID NO: 65872 - DNA, 503 bp, Zea mays
  Clone ID: LIB3075-043-D3-R2A
atcttcggggtgatcgattacacagcattatgggtcgcgtgatagctacagatcaagaggatagagaacaacaccaatcggcaggtgaccttctccaagcgtcggaatggcctcatcaagaaggcctatgagctctccgttctatgcgacatcgacatcgcgctcatcatgttctcgccctccaatcgcctcagccacttctccggcaggcgcaggatcgaggacgtgatcacgaggtacatcaatctcccggagcacgacagaggaggagttgttcggaatagagagtatctgatgaagatgcttggtaaactcaaatgtgagggtaacatagccgaacaactcacacctaataaagagccaataaattccaacgtagaggagcttcagcaggagattaagacgtaccaacaccagatggaagtcttaaaggagcaacttagatctgacaacattgatgtcgatgaacgatttcgagacgtgtgagaaatttcctatggaca

SEQ ID NO: 65873 - DNA, 244 bp, Zea mays
  Clone ID: LIB3075-043-Q1-K1-D8
agagttcagtttctgagattgggcaacggcagcggctcagctcgtcaagtttgtgctgggatgccagtttatcccttctagtctattacagaaatgttgttcggagctgagtctattataaacatcttggtctgagtttattgttgagtggtgccagtttttttcaatatacatttatcttaaaaacagcggtactgatgtttttttgtctaaagttaatggcgtttgcaatggttctgagtct

SEQ ID NO: 65874 - DNA, 464 bp, Zea mays
  Clone ID: LIB3075-044-D2-F2A
acagtgaaatgccaaatcccaaagggcaatagcgttgcacatgataggctactatggatcagcatacatagaatgatagaatgaccacttttacatacacaagctatctggtctttccctacaatctcatagtggtccccagtctggcaggtcactgcgttgtaccagcgtcgcgatctgttagaacaaatacactgatagcctgcaggcaacatagcatggtctctgcgcaaacagttacgaaaacaaactataatatctctggataccacaggattatatgaacatcttgacccaaatacttaaatcagcgtgctgaacagactgtattaacaactggagactgcagtcgacgtgacatttggtcgaagacgatcgatcgaaacaggtacaccacagggatataacgagcataactgtaaagatactcacagagtcacagccattgtcatagcacaagagcg

SEQ ID NO: 65875 - DNA, 455 bp, Zea mays
  Clone ID: LIB3075-044-D2-R2A
accacgaacgctgttgtgtcatggagtgccgccaacaatagctttgttttgggatcctcatatctttggcacggtgctgctgccaaggtacttcaagcacaacaacttctccagctttgttcggcagctcaatacttatggcttcagaaaggtggatcctgacagatgggaatttgctaatgaggagtttctgagaggtcagaggcacctcctcaaaaacattaggcgtcggaaacctccacactcatctccaaatcaacaatctcttggctcttacctcgaggtaggacactttggatatgaagaagagattgatcagctgaagagggataaacagctcttgatggctgaggtagtgaagctgaggcaggagcaccaaaatactagatcagatctacaggccatggaagagaaattacaagacaccgagcagaagcagcagcagatgatggcat

SEQ ID NO: 65876 - DNA, 304 bp, Zea mays
  Clone ID: LIB3075-044-Q1-K1-A2
ggtgatgaaagctgtatcggacttcaaacatatttctcagccactttcaaggttcgaagatgatttggaatcaaacagagccgtgagagatcaaggctggggttcaccgcagcttgagcaaaatataactcgcttggagaaaattgtcgaaattttatcacaggacaaattctgttatgaagctcacatactacgggatggtgcattccttcaacgagcattatctttctacaggttaatgatactctggtcagttaacctagttggcggatttaagatgcctttgccatcacaatgtcccaag

SEQ ID NO: 65877 - DNA, 422 bp, Zea mays
  Clone ID: LIB3075-045-Q1-K1-C5.F2
ccccaaaaaaagctttttgggctggtttaaaaaaaaggggggggggactttagggggaaaaaaaaaaactgaaaccttttttttaagggggccctttttttttttaaaataaaaaggggaaataaaggggttttttttccttttaaaaaaaaaaaaggggggggggtttttttttttttctttttgggcccattcttttaaaagggaagggaaccccttgggggaaaattttggaaaaattttttttttttacaaaaaaaaatttgggtggaaattttggaaaacctttccccctgaaaaccaccaatttgggggggaacaatttgatttcggccccaaacaaaaaaaaaagaaaccgggggggttttttggggtggggtgggggaaaaggggcccaaaatccccacaggaccttttttttt

SEQ ID NO: 65878 - DNA, 228 bp, Zea mays
  Clone ID: LIB3075-045-Q1-K1-F2
gcagggatctttttgttcctttttttagcagtaatttacgtgaagtgtctgtacatgtagagggagagatagggtagtacgagagagcatgttatagtacctactcttattatttgcttatttatcgttgtgccgaagaacgacccctgcaaaaaaaaaaaaccaactttgaaagaccgattataagattgaggcttgacttcaataagataatgttatgtaaaatta

SEQ ID NO: 65879 - DNA, 595 bp, Zea mays
  Clone ID: LIB3075-045-Q1-K1-G5.F2
gtggtaaatgaaattcagaagttctcgcaattttttctgcatgacatcacaatggtcatcagttggtgtgcaatcagccaatcaccacatacatatactacggatcaaggttcataaaccataatgcagctccaacaacaccgtttacaagttgcaacagctggaactggcaagaattgcaaagatacgcaggctactacagcctaactgtctggattttgtgtatgctgtcgactgagagttcttaaaaattaatgaatgaattaacgaatccccaaggcccagccggatgaactgcatgcattgtcatctgcttgcagctgcctctgcaacggcttggagctccacgtgagctcctgcacggcggccgggaagatgaccgtaggcttcctcctgctctcctccaggtacgggaagtcctcggtgaagtgcaagccgcggctctcgcgcctggccagcgcgctcctgacgacgagcttgccgcatcagaagaggttgcgcatctcgcatacctcgaccgccaccgtggtcggcttccacccccgcccgaacaggaactcctcccactccgactccaggttacccatcctacact

SEQ ID NO: 65880 - DNA, 275 bp, Zea mays
  Clone ID: LIB3075-045-Q1-K1-G5.R2
ggtccagacacccgggtcgacccagcgtagcgggcaggccttgatggagctgcaatcagtgatgtgggagtatgtcagcatcgtgcgctcgacggggcggctgaagcatgccgagtggaggatcggtgacctggagtcggagtgggaggagtttctgttccagcgggggtggtagccgaccacggtgggcgtctaggtctgcgagatgcgcaacctcttttgctgcaccaatgctcgaataaggagcgcacttgccaggctcaagagccgatgtc

SEQ ID NO: 65881 - DNA, 315 bp, Zea mays
  Clone ID: LIB3075-046-Q1-K1-A5.F2
atagaattataatatttattattattttatagattaattaaaacaatatagctcgcgagcctgaacaagccgtggcttaaagtttttttttttcagccctagacctagacaaaatagagggtgacaataataataatgaacaaaacttggcagttcgactaacggacacgacaaccgaccgacgcaacgactgaagctactgaagaagcagtgagccgaggaccaccaccattctctttttattaaggcgagctatgctaattctaatcacgtcgtcttgactagagcactttatctttgggtctttcgcctatt

SEQ ID NO: 65882 - DNA, 338 bp, Zea mays
  unsure at all n locations
  Clone ID: LIB3075-046-Q1-K1-A5.R2
ccaacaccctcgccaccngccatcccgagcaccggcgccaccgcgagcagaccacgacccgagggcaccggaagagcaaacccccaggcagccccggaaggcgaanggcggcgacgccggcgccgacgacgaggggagcccagccgaccagcccaagcccggcgccgccggcagcggggcaggcaagcacaccaccgccgccggggggcacgcgcgccccagccacaccgacacggccaaggacgaggcggcggcggaaggcaccggcaccggcgggagcgacccgccggaggcgaccaaggagaaggcgcgggccacgaaggaggccgacgcccccg

SEQ ID NO: 65883 - DNA, 206 bp, Zea mays
  Clone ID: LIB3075-047-Q1-K1-B12.F1
agtggaaattgggtcgtcgcaaactgtactgtttgcgagggcatctaacatagcattcaatggatacatacagccgaaaattaactaccagattgggcatttagaagcacagcccggaataatgcctttggctactaactgtttggacgaaccaagccaacggcaaacctgctggcacctttacatcaggaaagccatcagttacc

SEQ ID NO: 65884 - DNA, 463 bp, Zea mays
  Clone ID: LIB3075-047-Q1-K1-B12.F2
agtggaaatgggtcgtcgcaaactgtactgtttgcgagggcatttaacagaggatccaagggatacatacaggcgaggacaatataccgtatgggcattgataagcacaccacggaatatgcctttgactactaactgcacgaatgatccaagcctaccaactacctggtggtacacttaaataagggaagacataagttaccaagaataagcactctaggcaataaaaattacctagaactcagagaattggaccaagaaatcattgaaaagaaaaggatataaaccatgcaccactatgttgctgttcaggggacataagttgcactccaataaaaacactcgatcagacattgacgtagtgctgaccagtactggccttacttgcggcaatccaatcttaagccagggctatacagtaacccttgtagtgtatgacaaacaataatctgatatacttaac

SEQ ID NO: 65885 - DNA, 544 bp, Zea mays
  Clone ID: LIB3075-047-Q1-K1-B12.R1
gtgcagtggggcaaatttttagttgacaaaaatactgcaggcttcgggtatctgcagttcgatagtgtaatgcaacagggtcggtcaacaagcacttcatggaatatggttcgccggtaagatgattacaccgaaatttatggccgatcatgaatacagtactaagttcccaaacttgtgagcatatgcgaggaagagtttgtcagacccgcatagttcgttcggagagtttgctagtgctgtatcgttggatggtatactagacgaacaccttagttgattgtatgacaggatagtttcagttgcagcgcaggtcgtgcgtacaatgtttgaggaactttatttacggcatcacacacagtgaccatcccttattttgtccaccgaatgaaatgccctatgatctccacagctattcaggttcagaacattgaagagtttacatggttaaactcaagctacagtccagtgcagaagcagttgcgaacgcggtttatgattgattactacttcagaactggggatgctacgcaccttgaaaatc

SEQ ID NO: 65886 - DNA, 556 bp, Zea mays
  Clone ID: LIB3075-047-Q1-K1-B12.R2
gtgcgtcgaagcatatcatgagtggacaaaaatgctgtaggcttagggtctctgcagttcgatagtgaacctgccacaggcgtaggcccaaccagcactcaatggactatggttcgcaggaaagatgattacagtgtcatctatgtccgaccatgactacaactctaagttacaaaacttgtctgcatatgcaactaagagttggtacacatcccccatagttcgttaagctgagtttacctaatgctgtatcattatatggtagactaaaccaacaccttattgttttgatgacaggataaactcaactgcagcgctggctaagacatccaatgaaacattgttctcaatttacggcagatacacagaactccatcccttatttagtccaccgaacgaaatgatctctgttctccagccgctattcaggttcagaacattgaagagtttacatggttaaactcaagctacagtccagtgctgaggcaggcggatacgcaggttatgattgatcactacttcacatctgagcatgctaggctcgattaaaatccca

SEQ ID NO: 65887 - DNA, 606 bp, Zea mays
  Clone ID: LIB3075-047-Q1-K1-B6.F1
ggaaatatggcccgttccttgatttatataccaaaacaaatgatataatatcctcatacaaaagctgaagatacagaacaatagcggacgactatgcatactgactgacaattggtttgattgtgacagacagggagcaaaatcgtaaagaagataagaataaaacaaaactcatattcttctctgtatgtatgctgcgcgcgggaccatattttcaactaaacaatgtcattatccatcctgtgaagtttgtctgcatgaaagacccagcccttttaacttgattgtccacctttcatcttggcttcgaggtccttgacaatattagtaagaggtcttgcatccagagccttagccagtttaccatctccatcaaacttttccagcttttgagcaaggtccttgaggtcttgttccgaccggcctttcttatggatggccttaaggaccatgagcagatgcggctgaaggaactcggcgcagtgcctctcgaggtcacggtcagggaaggaggaacgcagccgaagggcacttcatgggctcatggggcagacggtgacgcatggcggtccatgtcgcgctgagcagcgttgtcgagcccgtcgc

SEQ ID NO: 65888 - DNA, 604 bp, Zea mays
  Clone ID: LIB3075-047-Q1-K1-B6.F2
ggaaatatggcccgttccttgatttatataccaaaacaaatgatataatatcctcatacaaaagctgaagatacagaacaatagcggacgactatgcatactgactgacaattggtttgattgtgacagacagggagcaaaatcgtaaagaagataagaataaaacaaaactcatattcttctctgtatgtatgctgcgcgcgggaccatattttcaactaaacaatgtcattatccatcctgtgaagtttgtctgcatgaaagacccagcccttttaacttgattgtccacctttcatcttggcttcgaggtccttgacaatattagtaagaggtcttgcatccagagccttagccagtttaccatctccatcaaacttttccagcttttgagcaaggtccttgaggtcttgttccgaccggcctttcttatggatggccttaaggaccatgagcagatgcggctgaaggaactcggcgcagtgcctctcgaggtcacggtcagggaaggaggaatcgcagccgaaggggcacttcatgggcctcatggggcagacggtgacgcagtggcggtccatgtcgcgcctgagcaggcgcttgtcgc

SEQ ID NO: 65889 - DNA, 605 bp, Zea mays
  unsure at all n locations
  Clone ID: LIB3075-047-Q1-K1-B6.R1
gccccgagaagtacgagaacgaggagcgcctcgaggaccacaaggcgcagtgcagcttccgccccgtcgcctgcgccaacgacggctgccgcgccaaggtctccgtccgctgcgtcaaggaccacgacgccgcctgcgtgtacaagctgctccagtgcgagcagggctgcgacaagcgcctgctcaggcganacatggaccgccactgcgtcaccgtctgccccatgaggcccatgaagtgccccttcggctgcgattcctccttccctgaccgtgacctcgagaggcactgcgccgagttccttcagccgcatctgctcatggtccttaaggccatccataagaaaggccggtcggaacaagacctcaaggaccttgctcaaaagctggaaaagtttgatggagatggtaaactggctaaggctctggatgcaagacctcttactaatattgtcaaggacctcgaagccaagatgaaaggtggacaatcaagttaaaagggctgggtctttcatgcagacaaacttcacaggatggataatgacattgtttagttgaaatatggtccgcgcgcaatacatacagagaaaatatgattttgtttt

SEQ ID NO: 65890 - DNA, 653 bp, Zea mays
  unsure at all n locations
  Clone ID: LIB3075-047-Q1-K1-B6.R2
gccccgagaagtacgagaacgaggagcgcctcgaggaccacaaggcgcagtgcagcttccgccccgtcgcctgcgccaacgacggctgccgcgccaaggtctccgtccgctgcgtcaaggaccacgacgccgcctgcgtgtacaagctgctccagtgcgagcagggctgcgacaagcgcctgctcaggcgcgacatggaccgccactgcgtcaccgtctgccccatgaggcccatgaagtgccccttcggctgcgattcctccttccctgaccgtgacctcgagaggcactgcgccgagttccttcagccgcatctgctcatggtccttaaggccatccataagaaaggccggtcggaacaagacctcaaggaccttgctcaaaagctggaaaagtttgatggagatggtaaactggctaaggctctggatgcaagacctcttactaatattgtcaaggacctcgaagccaagatgaaaggtggacaatcaagttaaaagggctgggtctttcatgcagacaaacttcacaggatggataatgacattgtttagttgaaaatatggtcccgcgcgcagcatacatacagagaagaatatgaggtttgttttattcttatcttctttacgattntgctccctgtctgtcacaat

SEQ ID NO: 65891 - DNA, 237 bp, Zea mays
  Clone ID: LIB3075-047-Q1-K1-B8.F1
aaactgtctcgttttagacatcattgtagaatataccctatatcaggtttcgtctctctgatatagcaaggtgagaattacaaaaggcaatacaacatgataattactgttcccacggttatatatcgcaaattgggaataaaaaatttttcttatgtcattcatcaatcctatgcatcgaagtcttgggcttgttactttggagatgtaggataaactatctttgttgtaggtgaa

SEQ ID NO: 65892 - DNA, 568 bp, Zea mays
  Clone ID: LIB3075-047-Q1-K1-B8.F2
aaactgtctcgttttagacatcattgtagaatataccctatatcaggtttcgtctctctgatatagcagggtgagaattacaaaaggcaatacaacatgataattactggtcccacggttatatatcgcaaattgggaataaataatttatcttatgtcattcatctatcctatcatcgaagtctttggcttgttactttgggatgtaggataactatctttgttgtgtgtggatacttcacacgatcatgagtgaaaaaacagcttgaaccagttggtacaaaaagcccaagtctaaaggatgacaatgttcatgaacttcctcttagcaaaagccaaccaccacttgtttggaaagccattagctctgtatgcacagttgagcaatcttccacttgtttcctcccttatctgcttcaaataattcctcaacaattctgcttcctcctgggactggggaagagtgaaaagtccagggaaaggaaaccctggttccccaggtacaggaactttctccaatcccagattaatgattgctttagtcccaacagctagtgtccggcaaccg

SEQ ID NO: 65893 - DNA, 579 bp, Zea mays
  Clone ID: LIB3075-047-Q1-K1-B8.R1
acgatctctgcccctccttccccaaaatcatctctctcccgatcttggcctccccagattcaccacctgctctcctctccggctacgaccttggctcatcctgattcggacacgcaacatggtttaccactctagtttcgctgatgatgatgggatcacaaaagcttgcagctgtcctttgcttccactgaaaactcatatcaagggcccggcaccagcctctgaccctgataaagcggacattgttgatgaagccataactttctttcgagccaatgttttcttcaaaaatttccatgtgaaaagctcagcagacaagttattgatctatctgacgttttatatcaatattgccttaaaaagactagacggttgccggacactagctgttgggactaaagcaatcattaatctgggattggagaaagttcctgtacctggggaacagggtttcctttccctggacttttcactcttccccagtcccaggaggaagcagaattgttgaggaattatttgaagcagataagggaggaaacaagtggaagattgctcaactgtgcatacagagctaatggc

SEQ ID NO: 65894 - DNA, 660 bp, Zea mays
  Clone ID: LIB3075-047-Q1-K1-B8.R2
acgatctctgcccctccttccccaaaatcatctctctcccgatcttggcctccccagattcaccacctgctctcctctccggctacgaccttggctcatcctgattcggacacgcaacatggtttaccactctagtttcgctgatgatgatgggatcacaaaagcttgcagctgtcctttgcttccactgaaaactcatatcaagggcccggcaccagcctctgaccctgataaagcggacattgttgatgaagccataactttctttcgagccaatgttttcttcaaaaatttccatgtgaaaagctcagcagacaagttattgatctatctgacgttttatatcaatattgccttaaaaagactagacggttgccggacactagctgttgggactaaagcaatcattaatctgggattggagaaagttcctgtacctggggaaccagggtttcctttccctggacttttcactcttccccagtcccaggaggaagcagaatttgttgaggaattatttgaagcagataagggaggaaacaagtggaagattgctaactgtgcatacagaagctatggctttccaaacaacgggcggttggtttttgctaagaggagctcatgaacattgtaatgctttatacttgggcttttcgtacc

SEQ ID NO: 65895 - DNA, 491 bp, Zea mays
  Clone ID: LIB3075-048-D11-F1A
catgaatccaaagcctcataatacataacaagcaattcaacatgcacttgttacaatcccagactgaaccaagctgccaaggttacaaaataagaacatatacttgtgacgactacttactaataatgcagggttcgtatatatagaggagatagacacgtacggctctatttctctttgcgttgctgctaatctttgtacgttctacgccgattgcgcgggtgcttccggctcacccgcgcctgcgtccgccggtggctccggtccggcctccgcggcctcgttcttcttggtctgcgccgtctcgatgaggtggttgtagctgcccttctccttgaacagctgcgagaaatggatcttgcagtagaggaccccgttgagcgcggcgtaggaggacgtggtgaggatgcagcccccgtgcgagcatttgaagcagctcttgtggtaggactcgccttccagagtcatcttctccaatggatacactgttt

SEQ ID NO: 65896 - DNA, 431 bp, Zea mays
  Clone ID: LIB3075-048-D11-F2A
catgaatccaaagcctcataatacataacaagcaattcaacatgcacttgttacaatcccagactgaaccaagctgccaaggttacaaaataagaacatatacttgtgacgactacttactaataatgcagggttcgtatatatagaggagatagacacgtacggctctatttctctttgcgttgctgctaatctttgtacgttctacgccgattgcgcgggtgcttccggctcacccgcgcctgcgtccgccggtggctccggtccggcctccgcggcctcgttcttcttggtctgcgccgtctcgatgaggtggttgtagctgcccttctccttgaacagctgcgagaaatggatcttgcagtagaggaccccgttgagcgcggcgtatgaggacttggtgaggatgcaacccccgtgcgagcatttga

SEQ ID NO: 65897 - DNA, 452 bp, Zea mays
  Clone ID: LIB3075-048-D11-R2A
cctcctaatcgcgaacgagcgtctttctcctccgtccgcgcccgtttgctcatcggttttgcctgccggtgggggaccgcctgcacgagcagcggctagccagacgtacggccttcgtttgaggctggagtcctgattggcaggtgcaagcacagagctcgatcgccatgtctttcaccggcacgcaggacaagtgcaaagcctgcgacaagacggtccacatcatcgacctcctcaccgccgacggcgtctcgtaccacaagacatgcttcaagtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgacccggcaaaggctccaagcaagctatca

SEQ ID NO: 65898 - DNA, 202 bp, Zea mays
  Clone ID: LIB3075-048-Q1-K1-A6
acgccctgaccggcgacggctgccaccgcgacggtgatgatgtggctcgcgacgttcgcgatggcgtcgtacaagctgaaggcggcggcgtggacgccggtctggcaccaccggtaggtggccgcgtccctcgcgcaggccgccgacgcctggctcaggctcctgcgcgccaaccacccggaccaattctacttcggggccc

SEQ ID NO: 65899 - DNA, 424 bp, Zea mays
  unsure at all n locations
  Clone ID: LIB3075-048-Q1-K1-C5
ggtttagatggttcagctacctgacgatatgcttgtggaaatggtgagccgcctcccgcgcagcagcctancggcgtcacgctgcgtctccaagcacttgtgctccatcgtggacgcccgacgtctcctgcgcaccggccacctgcttcctctccgcctcgacgccttctactgcatcagcctggcctcggtcgatcgggagacatatcttttcgcacggccatcggtagcgcgtcggatccccggcgcctgccttgacttcagggtagatcttgaggttgtggatcactgcaacggtctactgttgctgtgtgacatggttttcaggttgctgaaccctgccacacggcaatcggcagccctgcctaaagccccggatccatccattgagaacatgcttggggtcgccacagtttgggccggg

SEQ ID NO: 65900 - DNA, 425 bp, Zea mays
  Clone ID: LIB3075-048-Q1-K1-F1
gcgcgcaaatcctctgaacctttttcctcagggtgtcccaagtggtggggccaatccaggtgttgttccagctgcaggatctggtgcccttgatgccttgcgacagcttccacagtttcaagcactgcttcagttggtccaggctaatcctcaaatcttgcagccaatgcttcaagaactaggcaaacaaaacccacaaatcctgcgtttgattcaggaaaatcaagctgagtttgtccgcttggtgaacgaaactccggagggtggtcctggaggaaacatattaggtcaactggcagctgctatgccgcaatcggtgacagttaccccagaggaacgagaggccatccagcggcttgagggaatgggcttcaaccgtgagcttgtgctagaagttttctttgcatgcaacaaggacgaagagc

SEQ ID NO: 65901 - DNA, 437 bp, Zea mays
  Clone ID: LIB3075-048-Q1-K1-G3
gcgcctggtcgtggaatcaggtgtgttacccaccctcacactcacaacgtgccatacatcgtgtggcagcattccgatcaggttttggtgccttggggtggggattcgggtgcctccggtgaggccccactgtgggtcggggcggtgccgttgcctggacggcttgtggaagaagtcaggtcctggtggttggatccgagatacacgatcgggatcgagccatgtcataccgatccagtgtttgcatccggagcattaatcttgtgggcaatggctcagattggccatggccgtacccgtttgcccgggtgcttgaaagccgttagatctagatccgaggggtgagagcgtatatccgacttaataaaactatggtcgttggatcgggatccgagggacccaaaccgtgtaccgattcgtttatatgtgatatgatc

SEQ ID NO: 65902 - DNA, 307 bp, Zea mays
  Clone ID: LIB3075-048-Q1-K1-G6
acgaagtttgttttgtatgatccttcacttccatttgctgatcgtaagaagaaaaaggaaaagggtaaacttggcatgaaagagagtctgaaggttctgctctcctcgaggtatgtgagggatctagctaccctagtggttgcttatggcattagtatcaatcttgtcgaagtcacatggaaatcaaaactcaaggcacagttccctagtccaaatgaatattcatctttcatgggtgatttctcgactgcaactgggattgcaactttcacaatgatgctgttaggccgtattatactacggaaat

SEQ ID NO: 65903 - DNA, 411 bp, Zea mays
  Clone ID: LIB3075-048-Q1-K1-H1
gcgcatcggtcaaagacaaaagatgattgctgtgagcatcatgtggtcattagtgcacgtgcaggtgctggcggcgatggcggtagcatttctggtaggcggtgcctggtgtggtcctcccaaggttcccccgggtaagaacatcacagccaactatggtagtgattggctagatgccaaggcaacatggtatggcaagccaacaggtgccggcccggacgacaatggtggcggatgtgggtacaaggacgtgaacaaggcccctttcaacagcatgggcgcatgtggcaacgtccccatcttcaaggatggtctaggttgtggatcctgcttcgagatcaagtgcgacaagccagcggagtgctctggcaagcccgtggtggtgtacattacagacatgaactacgagcc

SEQ ID NO: 65904 - DNA, 64 bp, Zea mays
  Clone ID: LIB3075-050-Q1-K1-D5
ccgtccgaacaaaaaaaagaaaatttatgaattggaaacaattttttgttctgataattcaaaa

SEQ ID NO: 65905 - DNA, 494 bp, Zea mays
  Clone ID: LIB3075-050-Q1-K1-G5.F2
gttccattcccagccaagcccaccttcaagctaggtcatatcacccgcgtttggaactttccatagcacctacagcggagtggggagctgatacaattccggcatacacacacagatgcccgtaatgctagacgggtctcaggagctcaccgatcggcgactgggcatgagcgattcacatgcgagataatggccagggacataggccactcactaataattctgaccgctgatcgctagagcgggagcatggccggtgagcttcatcagatcaccgaggcggattttcctgttaataagcctatcataagctgcgtagatagagtagaccacctcattaatcgtgcgcgagcactaagagcacaatttcaggtacgacatgaagaggcatgcctatctattccattagaaacacatgctgcagactgggtgaggacgaaaccggtagccttcacacaggaattgacacattgctaggcgacgaattgtccatg

SEQ ID NO: 65906 - DNA, 288 bp, Zea mays
  Clone ID: LIB3075-050-Q1-K1-H8.F2
agtataaaggagggaaagaataaagggggggggggggatttattagggggaggatggaaaaaataaattattgaggggggggggaaaaaaaaaaaaaaaaaaaaatattaaaaatagagaggggtggtttggggggggggggaagagggtgggggggggggtaaaaaaggaagaggtaaatggggggggggtgaaaaaaaaattttttttttgtgggggggggaaaaaaaaggggggggtgggggggagggaaaaagtgtggttaaataggggggggttttttggggg

SEQ ID NO: 65907 - DNA, 105 bp, Zea mays
  Clone ID: LIB3075-050-Q1-K1-H8.R1
cagaaagagaagatcggtatttgattattcggatgatgaggaagatgacaatattggtaagcattgcatctcgtgggcgacctatactgtatttcccataccctt

SEQ ID NO: 65908 - DNA, 659 bp, Zea mays
  Clone ID: LIB3075-050-Q1-K1-H8.R2
cagaaagttgaagagcggtatttgattattcggatgatgaggaagatgacaatattgtaagcattgcatctcctgagctaccaaaacagcataccccagaccctgttgttggaattgctgaagacgctgaagtaaatcaaaagagcttggaaaatgaacacgatgtaccaaacaatgggaaaggttcctcaacggtggtggattctgacttcacatctgaatgtaaaatcaaaacaatcgatcctatgaacgattctgggattactttaaaagaaaagagcagtgatcctccaatcaatgacaagaagcaggattctgctgctgagcctgcctccaaatcaccaaagaggagaaaggttttgaagacacgcatagatgagaggggaagggaagttaccgaggttgtctgggagaatgaagcttctgcagatgacaaggcagagcagaatgtcaacactattgatgcgactgcaagcggggcgactgtcccaagcaaaccgaagcccgcaacaaacgctgacaaaagcaaagctccaagcataacagcagcaggcaacatgaaagctgcgaaggctggagccaagcaagggagcattatgtcattcttcaagaaagcatgagccagcgttgggtgcgcatgcaccataatgagacaggac

SEQ ID NO: 65909 - DNA, 546 bp, Zea mays
  Clone ID: LIB3075-052-Q1-K1-A6.F2
acagtacaatgcatgcagtcaggacgatgaattgtgagccgctgcaagagtagcttagagaatgaattcacccaggccacagcaaaggatagtcgtcttacatgtcatgtgtccctgaacccaaactgaatgagaaaggatgttattctatagcggttggtacagacaatgtctctccagtgatatttcttcattttgttccttcgtatctttacttgaagcccatagcttgtctgaatccactatcacattgaaacctaggggacagatgaccaaaaagcaagccaagaactagggacggagctgctggagggctgttccacctaaaggttcaatgttatcagctctgaagtatttgcagcgccttctactcgtctggctttgaggtcaatatcttgcagacgggcatggcctcgtttttactcagcaacttgagcgatggatggacgggaatgtcatgcatcaataccctatatcacgacatcaagacttgtcaggtccacctaagtttttggagggatgtgctcagctgagcatagatacacc

SEQ ID NO: 65910 - DNA, 267 bp, Zea mays
  Clone ID: LIB3075-052-Q1-K1-A6.R2
ccaaaatttatgaccggagaatgacgcagtgccttcgaggaaaggccgccgacgaggactcccggtcgaaggcgctgcaactcgacaagttacacgatatgggtggagcatgatctgcatcatcctcccaacaaattactcaagatctaccacctataacagacggggcaacagctcttgtgtgtcatcgaagccacagtcgactccgacctgaccttctaaaccgcgatgttaaagtgctatccattgtaccaggctaacaacact

SEQ ID NO: 65911 - DNA, 329 bp, Zea mays
  Clone ID: LIB3075-052-Q1-K1-H3.F1
aggtgaactgccttcttagattcattgcatagtatatgaaaattatataatttggttataccagcataaatgctaacgtaatcatgcggggtggtggcctatccgcattctggttggggcttccccaataatcaaagcccagggcttccattatatattatatatatatcggccaacttaattagcttgctgctgcaggtccatagcccgccgcgccggatgaatcgaaggcaattcaaagtctagtagaattggacgttggtagtgtagacggtcatcgggtctccagttcgccgggtttttgtctttagcgatgaccttctttgtcg

SEQ ID NO: 65912 - DNA, 598 bp, Zea mays
  Clone ID: LIB3075-052-Q1-K1-H3.F2
aggtgaactgccttcttagattcattgcatagtatatgaaaattatataatttggttataccagcataaatgctaacgtaatcatgcggggtggtggcctatccgcattctggttggggcttccccaataatcaaagcccagggcttccattatatattatatatatatcggccaacttaattagcttgctgctgcaggtccatagcccgccgcgccggatgaatcgaaggcaattcaaagtctagtagaattggacgttggaagtgtagacggcatcgggtctccagttcgccgggatgatgtctttagcgatgaccttcttgccggactcgctggtgaggcggatagagaaggggcccttgagcgccttggcagtgtccatcctccagatggcgccccaagagagcttcatgggcttccactcagccgacaacttgtcctggatttccatcagcacgatgtcgccatcgtccgccacaaacttcaccagcacggccaggtagttggggttgcagcccttctcgatgtggaacacgatcttctgcccagcggggtacttgcaccgcacccttctgaactcgacgtccatgatgccga

SEQ ID NO: 65913 - DNA, 584 bp, Zea mays
  Clone ID: LIB3075-052-Q1-K1-H3.R1
cagagcagcatttcgagtaacacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatcctgtcacggtgttcatcacagacatgaactacgagcctatcgctccctaccacttcgacttgagcggcaaggccttcggctccctggcaaagccgggctcaacgacaagcttcgccactgcggcatcatggacgtcgagttcagaagggtgcggtgcaagtaccccgcttggcagaagattctgttcacatcgagaagggctgcaacccaact

SEQ ID NO: 65914 - DNA, 652 bp, Zea mays
  Clone ID: LIB3075-052-Q1-K1-H3.R2
cagagcagcatttcgagtaacacagttgagcacgacgatgggatccctcgctaataacatcatggtcgtgggcgccgtccttgcggcgcttgtcgtcggcgggtcgtgcgggcccccgaaggtgccgcccggccccaacatcaccaccaactacaacggcaagtggctcaccgccagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatcctgtcacggtgttcatcacagacatgaactacgagcctatcgctccctaccacttcgacttgagcggcaaggccttcggctccctggcaaagcccgggctcaacgacaagcttcgccactgcggcatcatggacgtcgagttcagaagggtgcggtgcaagtaccccgctgggcagaagatcgtgttccacatcgagaagggctgcaaccccaactacctggccgtgctggtgaagtttgtggcggacgatggcgacatcgtgctgatggaaatccaggac

SEQ ID NO: 65915 - DNA, 190 bp, Zea mays
  Clone ID: LIB3075-053-Q1-K1-A6
tcgcaaaaacattgatgtctattatctggaatccttattgctttgttctgtttcctagttggtgtctaataaggtgcgtatcggttgtggaaaccaactggacgatgtattgttaatctctgtcggaagtgacatttatccttggtacttaaaaaaattaacgacttggtcaacttgtacggtcaatcca

SEQ ID NO: 65916 - DNA, 444 bp, Zea mays
  Clone ID: LIB3075-054-Q1-K1-A5
attcggctcgaggaaaattagaagagtttgctaattgtgaaaaatagggaaatgcaggcagcaaagaagggcatagagacctttaaggaaaccgcagccaacattggcgcctctgccaagtctggcttggagaaaaccaaggccactatccaagataagaatgagaagatgaatgcagaagatcaaactcaaatggatatggctaccaagaggaaagaagagacgatcaaccaggctgatatggagaagcagcaggcccgtaagtactacgccgctgcaaaacactacgccatggctgagcacatggcaaagggcaaccacgacaccgtcgggcctagaatcgagactgccacacacatcaccagtggacccgagactgacaatgctatgtactctaacactgggcctggaactgagactgccacagtcaccactagagggctt

SEQ ID NO: 65917 - DNA, 300 bp, Zea mays
  Clone ID: LIB3075-054-Q1-K1-B1
attcggctcgagcgacaagcactatggatgggcactaacggatcatagccccaggggtatgggccgacgaggccacggcctcagaggccagaaacaaaggacaaagccgaaaacatgccgatccgagagagcacagcaagacagaaccaagagccaaataggaagacaacctgcccaaagaccagatcaacctatagagccagaaggaggacaccagcaagcccgacgccactacagcggaacacgatcatgggccaagaagcaccaatggcacacaacgcagagccagaatgcacgcca

SEQ ID NO: 65918 - DNA, 251 bp, Zea mays
  Clone ID: LIB3075-054-Q1-K1-B6
attcggctcgagttaatacgcaccgggcgatcattaactgtacgtctgcgtcagctatctgtgttcctagacgctcgaagtagcttgtggcgccaggaacagactacagcgtaggaagacacctgatatactaacgcgtaattacggacaggacgcgctcaagacacatgcgtaatatctagatcttactgcataaacgggcatgaattgaaccacaatagtggccgcaaccaaccgtggcaacatacgga

SEQ ID NO: 65919 - DNA, 290 bp, Zea mays
  Clone ID: LIB3075-054-Q1-K1-C5
attcggctcgagccgccatctatagtgcgcatacggttaccgtggacctgcatcacgctggactaaacaatccattcaacgcagagtccaatcaatgggccattctgcactagcgccctacgctaacggtcgcgcacacaggcaatggctcaacatctgacagcgccaacgttgcggcgaaggcagatgtcgagctgcattactatagtttaggaccactcaccgacaaggccagtaagggctctacgactagcctagtgtgatgcgccgaccagctatctggcgcgtgg

SEQ ID NO: 65920 - DNA, 223 bp, Zea mays
  Clone ID: LIB3075-054-Q1-K1-F1
acgcggacgcgtgggcggacgcgtgggtatttgtgcaaaaaaaaaacaatgcaacttatttaatcaaatgtgacattttgttcatttgcctcaattgtcttacatcaataactagagggggaaaagaacaaaatgtcacatttgattaaataagttgcattgtctatttgtgcaaaaaaaaaacaaacaaaaaaaaaagcaacaaaaaaaccaataacaaaaa

SEQ ID NO: 65921 - DNA, 517 bp, Zea mays
  Clone ID: LIB3075-054-Q1-K1-F11-N1
aaaaaaaaacacccaacacatttttttggaaaggaccaaaggggggggggcccccccaaaccccacaaaaaacccccaaaaaaaaaaaaaacacgggggggccctccttaaaaaagggccccgccgacaaaaaaatgaagatcgggatggaaaaaccccccaaaaccaaaagggaggccccggggggacccgaaaaaaaatgttgcggccaccggaacaaacccaaaattgggggggaaagccccccccccaccaaaaggggcccaaccccccccccccaaaaagaccaaaaactttgcaccccccggggggggcgcaacggaacccgaacaagaccttttaaaaaaactcaatctaaacagggggaaaaaaaaaaaaggggggggtcctaaaaccgggggggaaaataccgttctccccaagaaaaacaaaaggggggggaaaccttccgtgggacaaaaaaaagcccttgagaacccccaaggaaacaaaaaaaaaccccgcacggccccccttt

SEQ ID NO: 65922 - DNA, 326 bp, Zea mays
  Clone ID: LIB3075-054-Q1-K1-G5
atccggctcgagagggacggcgacggttgcctcacaaccaaggacctgggaactgggatgcaatcactgggtcagaacccaaccgaggctgagctccaggacatgatcaacgaggtcgctgcggacggcaacgggaccagcgacataccggaggtcctcaacctcacggcccgcaagatgaaggacaccgactccgaggaggagctcaaggaggcgtccagggcgcacgacaaggaccagaacggcttcatctctgcggcggagctgcgccacgtgatgaccaacctaggcgagaagctgaccagcgaggaggtcgatgagatgat

SEQ ID NO: 65923 - DNA, 399 bp, Zea mays
  Clone ID: LIB3075-054-Q1-K1-H1
ggactacgcgcgcgagtacggcggatacctgcgcacccgcgccaaggacgccgcgcccggcgcgtaggcgcgcgccgcccggcgtgcatgtgctgcaacccccgtccgtggtgccgctagctataggtcatcattgctgtcgtcgtcgtcgtcttagttcctcttgcattgcgtgtgcgtactctgctccaatcatcccccgcccgtgttgtcaagcaatttctggtcctcttgcttgctttctctaggagatgctgttcatttcgatctcttggcgcaatttgatctttcgcttggtgtaattaggtcattagttaaatcataagagactcgagttcatggtctttctcacaaccttaaaacaactaattgatgttgaaaagaatatacaagcaaaaa

SEQ ID NO: 65924 - DNA, 381 bp, Zea mays
  Clone ID: LIB3075-054-Q1-K1-H6
cgtagaatggaacggttgcgcagtactaaaatatggaggcttctattgtacccatcctactaggaaattatgagccagttgatgaggcatgaattatttcacgacttggccgcggttagtgtgaaaaggcgacgctgctatatatggtcatcacccttggtttgtccgttcgccagatatcacgattatcatatttatcggttgtaatataagcttcttgtattagcatatggtttaatattttttttcagatgggatgaggtcctgcgtgatatcctatctgtaaataggaaggcactagcagatctcgacaaatgtacaactggttttttttttgagaaacttgaaataagatttatcgttcaccacaaaagacaaaaa

SEQ ID NO: 65925 - DNA, 249 bp, Zea mays
  Clone ID: LIB3075-055-Q1-K1-B2
gcagcgtcctcggcaaggtgcgccagatcagccaggaccagctgcagctgctcaaggcgccgctggccgggagcgacgcgcgcccgacgcagccgctcaaccgcaggaccgtgcagttctacaacccgcgcaacagcaccatctccttccagatctaacactaaaaagtactttggaatctttaatatagcgtaactctgcttatgatcgatcaatattctatcatttgtattaaacaaaaggttcatc

SEQ ID NO: 65926 - DNA, 342 bp, Zea mays
  Clone ID: LIB3075-055-Q1-K1-E12
cgccgtcggaggcgccctccagcagcagctcatccgactagccgcgcacaacgcagttcttgtcatgatctatctagcaaataaaaagatcatatgtctcgtttgattctctggaataactaatagtatatatgctgcgcccggatgatatataaatatgtgcatcaaatgcgtgcggcaaacgcatggaatgtgcttgcctagctagctaattgttggtttttttttctttacttttcttcatacctgtctctctctctcggaggtttaatttttcttcaggcatgtaatataatgtgatatacccaatttatccaacgcgctttaattcaaaataaataa

SEQ ID NO: 65927 - DNA, 604 bp, Zea mays
  Clone ID: LIB3075-055-Q1-K1-F3.F2
gaaaaaaagttaagaaattaattatatatacagcacaccaacaacatatgtgagaggagaacatgcatacaatacattgttttgcagttgcctaccacaaagtaaacataggaaatgaattagtgccttgctttgtttgtgtgcttaattagtctctgtcaaacatttattttagagatcaatataatctgcacgcagcagaatccattactcagatttgttcgcctgtctggtaaacagagccaggcttgaagtcggcagggatgacgtcatcgacgacgcggtagccaccacctttcacagcgaagcggacggagatggggcccttaatcggctccttgctatcgagggtgaaggttttggctggcgactccttgagatcatccgaccagtccagggcgcccttctccttgaccgacacctcggagatggcaacgttagtgacgagggatagtttggtggagctggagtccttgccgatcgtgaaggtgagcgcgccgccacacgagccgacgacaaagagtgccgccaccgccatcgacgccagcagcaaggaggaggacgaggaggccatttaatttgagacctagaaagtaagttggtg

SEQ ID NO: 65928 - DNA, 139 bp, Zea mays
  Clone ID: LIB3075-055-Q1-K1-F3.R1
taaaaatcaaggctacacaccaacttgactttctaggtctcaaattaaatggcctcctcgtcctcctccttgctgctggcgtcgatggcggtggcggcactcttgtgtcgtcggctcgtgtggcggcgcggtgaccttg

SEQ ID NO: 65929 - DNA, 621 bp, Zea mays
  unsure at all n locations
  Clone ID: LIB3075-055-Q1-K1-F3.R2
taaaaatcaaggctacacaccaacttactttctaggtctcaaattaaatggcctcctcgtcctcctccttgctgctggcgtcgatggcggtggcggcactctttgtcgtcggctcgtgtggcggcgcgctcaccttcacgatcggcaaggactccagctccaccaaactatccctcgtcactaacgttgccatctccgaggtgtcggtcaaggagaagggcgccctggactggtcggatgatctcaaggagtcgccagccaaaaccttcaccctcgatagcaaggagccgattaagggccccatctccgtccgcttcgctgtgaaaggtggtggctaccgcgtcgtcgatgacgtcatccctgccgacttcaagcctggctctgtttaccagacaggcgaacaaatctgagtaatggattctgctgcgtgcagattatattgatctctaaaataaatgtttgacagagactaattaagcacacaaacaaagcaaggcactaattcatttcctatgtttactttgtggtaggcaactgcaaaacaatgtattgtatgcatgttctcctctcacatatgttgttggtgtgctgnatatataattaatttcttaactttttttc

SEQ ID NO: 65930 - DNA, 107 bp, Zea mays
  Clone ID: LIB3075-056-Q1-K1-C8
aaaaaaaaaaaaaaaaaaaaaaaaaaaaataaaaaaaaaaaaaaaaaaaaaaaaaaaaaaaaaaaaaatccaaaaaaaaaaaaaaaaaaaaaaaaaaaaaaaaaaaa

SEQ ID NO: 65931 - DNA, 253 bp, Zea mays
  Clone ID: LIB3075-056-Q1-K1-E9
tcgcatgcacatgactgagaaggcgtaccaagtcatctcccatggggtgctcaacgggccgttcgccgacccgccatttgctaaatggagctgctagctgttagttttggtggtaacggtgaaaggggattggtttgttctcttagctgagagctcacagcatcttcaatagactttttttaaattcatcgctctctaaatcatcatgtaaagaatcatttaaataaaaattactttctataaaaaaaataaa

SEQ ID NO: 65932 - DNA, 618 bp, Zea mays
  Clone ID: LIB3075-056-Q1-K1-F1.F2
agtgtattcccgtttctccagattttccatttcaaaagatcagacagcgtttgcgtaaattttcgcacgtaaacagccacagaaatttctcatcatttatacaagtagaggtctaaaggacctgaaccacatgtacagctcaaattgagcaaagcccaaaaagaaaaggataggaaaacaaataaattggaaccaagaataaacataatttcgaaggtcatttatacaaacggcatcaatagtccacgagagcagcaaagtgtaacggtctaacggttccacttcactcattactcggacatgatatagttgagcatcgaagcgattttcgctgtcttataatcatcccggagctgaatgaacctcaaggcatcctttcggatgctgggggttccttcaaacagggatgctaaactttctggagcaacaatgaagacgttcgccacaattcccaacagttcgaacttctcatctatggagggggcattgaagctacgaacgaaatccccatattcagttatgtcacgtttcaaccgtaggccaccactgggactaaatgtgaacttctgccaatgattaagcagccccttatgcaagcgatttcccagctcagtcaaa

SEQ ID NO: 65933 - DNA, 500 bp, Zea mays
  unsure at all n locations
  Clone ID: LIB3075-056-Q1-K1-F1.R2
cccacgcgtccgcagcagtacttctcaaataccatatnnctcggctcttgctatcctgttgatgagtgctcatttccgtctgcttgtgaagatattggggtcatgcagtatcatgtatgttgaggcttgctgctcacataatggactgctatcatatgtattgatacctgttanntgtctgagggttgaaagaattgtgtgtcttcatgaacatgaagcgctacatgtattattcgaacatccatgattgatggatgctgcaccatgattcatcggccaactatattgcttgtatatagaattagtagcctattctctctacgtgttacttgatggctgcatttcatgtgccctatgaatggcctcaacataacagtntctttatngacctgatgctgggaatatcgcttcgcatataggggcttgtttatatcatttgtgcagaaacttcacatttatgtcccatgtggttggccttactgtttgaatacttgacataa

SEQ ID NO: 65934 - DNA, 239 bp, Zea mays
  Clone ID: LIB3075-056-Q1-K1-F2
tctcgtctcgctctgagcgtcttctctcggggcggcatcgttgggatgcatcgtgtttggttcatccgattaattaattgttttttttatttacgtggtttgcgattggttaattgtttgtttgttcgttcgtttcgtggtcgtgtgaattgtctaagggtttgttctgtaatcgtgactcgattctaatattattatgatcccaattttattttatttttgtgattcaaaaaaaataa

SEQ ID NO: 65935 - DNA, 572 bp, Zea mays
  Clone ID: LIB3075-011-Q1-K1-H3-F20A
gcgcggcagcttcccggtgaacccatagtccgccgaacagcagtctgtgatgccctgcgcctccgtgccgggcagccaggccgctactagcgcgtgcatgtagtccacgtacggctgcagcacgagggggcggacggacacgactagcacgacgcacctgacgagcccgcacacgtacttgatcacctcgcgccccggcgaccggatggtcaggttcttgttgtcgccggccgtctcggcgtacgggggttcgaccaccgctaccaccgcgtactcgtagccctcggcgctcttggccaggtcgtgcttgtccgggcgctccacgtagtacaccgacgtcttcttgtacaccgccttcttgatggccttcaagatcgtggtgccgacgcccgagaggttgttgcccgtctcccactggcacttgcatggtgcagcacgccgcactgactgctccaggtcgtgggcgacgctgccagccacaaggatcttcttgagcgtgttgtgcagctgtagcatgacctgctcctgcacctgcttgttattattgagcaggacgagcgagttgcggacgg

SEQ ID NO: 65936 - DNA, 364 bp, Zea mays
  Clone ID: LIB3075-017-Q1-K1-A2-F22A
caaatccttcgagagcaaggcgctcctgcctaaatttgcgaccaggaaaggggacgctttttatttatagcgaaccaccacgcactgacactatatgtccagatgatgctcatggactaactgtgcgcgggcgacgcgagtggaacgcagactggcggagcagcgcgaactcctgcttgatgtgctaggagggctggaacacgagcaggctgagcaccttcttctgcttgcccgtgcacgtgcacgcggcaccagaaggaggtgatgagactccgcgcggtgccgccatcctgacgaatgaagcaggggttgcgcgcgcaccggaaagctggatagaagccgctggggccgcagacggtgaaac

SEQ ID NO: 65937 - DNA, 469 bp, Zea mays
  Clone ID: LIB3075-017-Q1-K1-A2-F23A
acactgcgatggttgttgtgcaacaatgggtgtcaatgcatctctcagactgacacgaacttcatacgtagaggtgaagttcactctgagagaagcaaggtcggtaagccccataatacaagaatctctcaagtaatgttcgccccacgctgagggagagtcgggcaatggggcaccggggtcgtggcaccttcgatcaagatgcctgcttgaggaaagaggcctaaaaatgaagaacggacaagatgaatgaaggaaacaagtgtgtaatgttgatcaagcggaaggaataatgggtaaactgacaactctgggtcggtggatttgtaattggtttgggttttttagttgtagaacggtgtagcccccctcctagagagggatgaacacattatgcatgccaagtgtcagttcggtcggtgctatgctcgttgggatttgattgtcggaaataaaacatgggtgatga

SEQ ID NO: 65938 - DNA, 517 bp, Zea mays
  Clone ID: LIB3075-019-E9-F2B
gcctgtaacacattactgaattcaagattgaaattgttctgcatttacatgaaacagaagagggagcgttcctatggggaaaattcactacatcaaatcaatgacgaatctatcagttattaaccagatacatctctacaaggaaagtacggagagaggaatgtacagatgggggtggtgagactaccctgctatctaaaagctaaactccccatgatcaggtagccaaggtgtgagtcgtgaaaaagaatcatgtagactaaaatctccaaaaaggagaaagaaccaaataccaccttatctgcctacaaaccttttttactagcctaggaaaacatttggtctagtcttgagccagtgcaccatcttcttgtcaagcggtgaattattcaacacggtgtccatcattggactaccaaagactctcggatcactcttgaacacccatatactatcctttggccatggactatgcgcctgtttttccatgcgcgatgacatgaatctcacagttctg

SEQ ID NO: 65939 - DNA, 663 bp, Zea mays
  Clone ID: LIB3075-019-E9-R2B
caacagtgaagatcaagctcctgagttttacaacattatgttagaaaggccaaagggagacggagatggatatgacttggtttttgttgatgcgatgcacaaggccaactacgctagtagaatctgccactcctgcaacccaaactgcgaagcaaaagtgacagcagtgaatggtaaataccagattggagtttacacacttggaccaattgcagaaggcgaggaaatcacttttgattacaattctgtaactgagagcaaagaagagcatgaagcatcagtctgcctctgtggaagtcaagtatgccgtggcagctatttgaatttttctggtgaaggagcctttgagaaggtattaatggaattccatggtgtgctcgataggcatagcctgctgctacaagcttgtgaaatagactctgtctctcaacaagacttaattgacttgggtagagctggtcttggtacctgtttgcttgctggtttgcctggatggcttgttgcttacacagctcacctggtgcggcttatataccttgagagacagaaactccctgatgagatcttaatgcacaatgtggatgagagcgccagttccttatagaaataaacatggattctgagaagaatgatgctgaggttcaggcagagggagtattaaat

SEQ ID NO: 65940 - DNA, 514 bp, Zea mays
  Clone ID: LIB3075-022-A3-R2B
gggagctggcaccagcaccagcaccggcaccagcggctcttcccgtgccggatcagtgcaacgccggggacggcgaccgcgggaggaaggccggcgtcgctggtcccggcgtgtgcagcggggcgcggagacgggtggccaagggcgccggtggcccggcgagcaccaagttccgcggcgtgcggaggaggccgtggggcaagttcgcggcggagatccgcgacccgtggcgcggcgtgcgcgtctggctcggcaccttcgacaccgcggaggaggccgcgcgcgtctacgacaccgccgccgtccagctccgcggggccaacgccaccaccaacttcgccgcgtccgccgccactaacagcggctccggggccggggccgggcaggacccggcgacgacaccggcagcgggctacgagtccggcgcggagtcgtcgccgacgtccgtgctccgcaaggtcccctccctgtcctccctcgccgaggacgactccgacgcgccggccgccgagcg

SEQ ID NO: 65941 - DNA, 726 bp, Zea mays
  Clone ID: LIB3075-044-D2-F3A
gggcattcatggcacgagtcatgcagaaccctgatttcatgcgtcagctgatctcccagcgggagatgaggaaggagctcgaggatgctatctcgaagaagagaaggcgccgcatcgaccagggacatgaagctggtagcatgggcactggttctagcctggagcaagggccacagggagtgtttgaaccgcaggagccggtggaatcagtcgccaacggtgtgccatctgatctggagagttcgtctgttgaggcgaagggattggaggttcgacagggtgtttcttcaggtggttctgagcatctgaatggcaggccaagcggagagttaaatgatgatttctgggaggaccttctgcatgaggggggactcggcgcagatgcaggcaatgctgttggtcaggatgatatgaacatggacatggacccagatgttagcctgcctcaactgaaacaacatggacccagacattagccgctcttgtgctatgacaatggctgtgactctgtgagtatctttacagttatgctcgatatatccctgtggtgtacctgtttcgatcgatcgtcttcgaccaaatgtcacgtcgactgcagtctgcagatgataatacagtctgttcagcacgctgagttaagtattcgcgtcaagatgttcatactagtctgtggcatccacagatattatagtttgcttttcgaactgttggcgcagagaccatgct

SEQ ID NO: 65942 - DNA, 587 bp, Zea mays
  Clone ID: LIB3075-044-D2-R3A
atagcacaagagcggctaatgtctgggtccatgttgtttcagttgaggcaggctaacatctgggtccatgtccatgttcatatcatcctgaccaacagcattgcctgcatctgcgccgagtcccccctcatgcagaaggtcctcccagaaatcatcatttaactctccgcttggcctgccattcagatgctcagaaccacctgaagaaacaccctgtcgaacctccaatcccttcgcctcaacagacgaactctccagatcagatggcacaccgttggcgactgattccaccggctcctgcggttcaaacactccctgtggcccttgctccaggctagaaccagtgcccatgctaccagcttcatgtccctggtcgatgcggcgccttctcttcttcgagatagcatcctcgagctccttcctcatctcccgctgggagatcagctgacgcatgaaatcagggttctgcatgactcgtgccatgaatgccatcatctgctgctgcttctgctcggtgtcttgtaatttctcttccatggcctgtagatctgatctagtattttggtgctcctgcctcagcttcacta

SEQ ID NO: 65943 - DNA, 551 bp, Zea mays
  Clone ID: LIB3075-048-D11-F3A
gctccagcaagctatcatctgcattctctggaactcaagataaatgcgcggcctgccagaaaacagtgtatccattggagaagatgactctggaaggcgagtcctaccacaagagctgcttcaaatgctcgcacgggggctgcatcctcaccacgtcctcctacgccgcgctcaacggggtcctctactgcaagatccatttctcgcagctgttcaaggagaagggcagctacaaccacctcatcgagacggcgcagaccaagaagaacgaggccgcggaggccggaccggagccaccggcggacgcaggcgcgggtgagccggaagcacccgcgcaatcggcgtagaacgtacaaagattagcagcaacgcaaagagaaatagagccgtacgtgtctatctcctctatatatacgaaccctgcattattagtaagtagtcgtcacaagtatatgttcttattttgtaaccttggcagcttggttcagtctgggattgtaacaagtgcatgttgaattgcttgttatgtattatgaggctttggattcatg

SEQ ID NO: 65944 - DNA, 517 bp, Zea mays
  Clone ID: LIB3075-048-D11-R3A
cttctccatggatacactgttttctggcaggccgcgcatttatcttgagttccagagaatgcagatgatagcttgcttggagcctttgccgggtcgttcttgtttgaagatgctccaccttgaaagttctttgagaaggtccctgtctccttgaagagctgttcaaagtgcgtcttgcagtacaggacgccgtccatggaagagtagctgctaatcgagaggacgcccttgcagtggctgcacttgaagcatgtcttgtggtacgagacgccgtcggcggtgaggaggtcgatgatgtggaccgtcttgtcgcaggctttgcacttgtcctgcgtgccggtgaaagacatggcgatcgagctctgtgcttgcacctgccaatcaggactccagcctcaaacgaaggccgtacgtctggctagccgctgctcgtgcaggcggtcccccaccggcaggcaaaaccgatgagcaaacgggcgcggacggaggagaaagacgctcgttcgcgattaggagg

SEQ ID NO: 65945 - DNA, 364 bp, Zea mays
  unsure at all n locations
  Clone ID: LIB3075-019-Q1-K1-C10-F2B
tttnnnnnnnnccctnnnccgccacccattaatggaacccnnanagaggacggccggcggggttcataacaggcagggggggaaaacgcaacaccaaaaaacnacaanaagggannncancaaaaaaccaaaccaaaaaaaaaacattttaaaaaaaaaaccgaagaaacagccatggggtagagccgcaaaaaaagaggccgccgggtgggccaagcagcttcttgctcagaagcactagccgcgttcaaatcgacagagagatcaagcccccttccagggatcttgtagacaaggcgagcacacccttgaccgtcgactaaaaaggggagggggagacaaagccaccggggaggaaacagca

SEQ ID NO: 65946 - DNA, 582 bp, Zea mays
  Clone ID: LIB3075-019-Q1-K1-C10-SP6C
cgcgagcgaataatggaacctttatagatgatgggtaccgttgttcattacatgcatgtgacaaaaacggtaactccaaaaaacatacaataatggatttcatcaataaactatccatctatggaacattttaaaaaaaaaatcgaagaaatagctattgtgtagagctgcaaaaaaagaggccgccggggtgttcaagcagcttcttgctcagtagcactagccgcgttcaaatcgactgagagatcaagctcctttccagtgatcttgttgtacaaggcgagcacatccttgaccgtcgtctcaaaatgggtggtggagtcatagctatttgtgaggaaacagcagtcgtcgtcagggttgttgacgggttcatatctgtcgtagatgtcgaagaaggtctcctctacagggccaagcaggtcgatcccgggcttgagctcgatctcaggcttgtcggtctcggcctcggtggagacgaaggcgatgaacttgcctttgggcgcgacgttgtgggcgtaggagcagcagaacacgtacatgtcggatttgcgctttagctgctttttggggaggatgatc

SEQ ID NO: 65947 - DNA, 203 bp, Zea mays
  unsure at all n locations
  Clone ID: LIB3076-052-Q1-E1-A10.F3
cttgtgccctttnaaggnccagnacgtacaggnagctctctgcttccttagtgcacttgctttgcagcattccttgtntattctactctgaaatcatacatcatgccacaagaaccgatggttcgtgatgtcaagagagctgccctaattgttccattgtaacctcgtaattgtgttcttccgcaggagaaattggttctgca

SEQ ID NO: 65948 - DNA, 364 bp, Zea mays
  unsure at all n locations
  Clone ID: LIB3076-055-Q1-K1-F7.F3
agatgttcctccattctagtcctgctggtctacactatgctgccattaccgatattgcatggtcttnctgagctaagtacctggcagtgtcatcacgagatggctactgtactataatagagtttgagaatgaggaactgggacagcctcacatactccccggaccaaaggaagttgctaatgggaatctgacacctgagaccaagaagcctgtatcttcagatagcatgaaggttgataatagtgccaacaagcttaagatggaagccagtcctgttgctgtaggagttagagcaccactgctgccaactgaggacatcaagagaacaggagagcttgccgaaggaatgtaaccctgggaaac

SEQ ID NO: 65949 - DNA, 146 bp, Zea mays
  unsure at all n locations
  Clone ID: LIB3076-055-Q1-K1-F7.R4
tggtttgatagacaggcagaacgtctaccatatactttattgccccaggnagttgtatcgcaggccttgaaaggtcacgcctggacttacataagctgtattaaatcacctcggagagtgtttagaaaggcctgctggcaatacta

SEQ ID NO: 65950 - DNA, 727 bp, Zea mays
  unsure at all n locations
  Clone ID: LIB3076-047-G3-F4A
gtcgggatgacaatgctagaagggataaactttattatgagaatcagcatgtgctggagagtgttgattcgcctttagtttcagtagatttagaggatgttataaactatactaacttcatgaaatatctaactaaagaggatcgacgtcagttgctcaaatttcttcctcctgtggactccttaacacctcctgaaagccttagaagcatgttcagttgtatccaattctctgatgctattgacagctaccagatgctgcttcgagagggaattctcgacccatccttatgtggtgatgaggaatggaagaaagtgaagacgcttgccttaactaatttaacaaaatgcagttggctggagtgctataaacagaaaaagggagctaaagaaaccgggggagtggggggcatcagtggaccggaaggctttaccaagtctactatgaaaccactcaaaagaccccgtgacacccactttcagagtgacgcagaactagatggtaccatgaggagtcctctaagagttctaaaatccggggctttggctcttcagtttgaaagttcatctttgccaaaatctagctatgccaccgaagattcaacctgcactggaggagcacctaatctattcatgttacccctagaaaagctaccattactggtcccttctcagtatgccgtctctgatcaagacttgctgctggaaatacctntcaacgcacgaca

SEQ ID NO: 65951 - DNA, 760 bp, Zea mays
  unsure at all n locations
  Clone ID: LIB3076-047-G3-R3B
cagagaagttctgcctctgggtgtcgtgcgttgagaggtatttccagcagcaagtcttgatcagagacggcatactgagaagggaccagtaatggtagcttttctaggggtaacatgaatagattaggtgctcctccagtgcaggttgaatcttcggtggcatagctagattttggcaaagatgaactttcaaactgaagagccaaagccccggattttagaactcttagaggactcctcatggtaccatctagttctgcgtcactctgaaagtgggtgtcacggggtcttttgagtggtttcatagtagacttggtaaagccttccggtccactgatgccccccactcccccggtttctttagctccctttttctgtttatagcactccagccaactgcattttgttaaattagttaaggcaagcgtcttcactttcttccattcctcatcaccacataaggatgggtcgagaattccctctcgaagcagcatctggtagctgtcaatagcatcagagaattggatacaactgaacatgcttctaaggctttcaggaggtgttaaggagtccacaggaggaagaaatttgagcaactgacgtcgatcctctttagttagatatttcatgaagttagtatagtttataacatcctctaaatctactgaaactaaaggcgaatcaacactctccaggacatgctgattctcataatgaagtttatcccttctagcatngtcttccatatgcagcggcgact

SEQ ID NO: 65952 - DNA, 300 bp, Zea mays
  Clone ID: LIB3076-001-Q1-K1-B4
cccacgcgtccgcccacgcgtccgcaagaacaggtcgaagaaaggcaggaacgggtgatagagcattggtgggatctaacaggagggacgagtggaagggaaggtttggagatttcggctggtccgagtctgacgtcgaatattgggaagcgaccgcttgtcttcttttttatttgtgttaacggatttgctgccaactctttcgtttaaccccaattcgtttcggtcctgattactgctgcaatctgttggtagattttgagatgtggtggcttctatacaaccagtgatgcacaaaaa

SEQ ID NO: 65953 - DNA, 60 bp, Zea mays
  Clone ID: LIB3076-002-Q1-K1-D6
atcacatctggattattctgctggataatgtccgtgtctttgatgttaaaaaaaaacgag

SEQ ID NO: 65954 - DNA, 118 bp, Zea mays
  Clone ID: LIB3076-004-Q1-K1-B7
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 65955 - DNA, 137 bp, Zea mays
  Clone ID: LIB3076-004-Q1-K1-C3
gcgcagacgcgctatgttgccatgaactttgctatgttgaaatgaacgcttgcatgggatgagtgatagctgctagaggggctgaccacacacaaactatatctgcttaatcgttaaacatgcgcgcactgtctaat

SEQ ID NO: 65956 - DNA, 73 bp, Zea mays
  Clone ID: LIB3076-004-Q1-K1-C8
tatgttcagagtgttatgttgtaatgaacagtgttatgttgtaatgaacgcatgcaaggcatgagtgatagct

SEQ ID NO: 65957 - DNA, 285 bp, Zea mays
  Clone ID: LIB3076-004-Q1-K1-H12
aatttttagggagcagaccatgaagaatttgtgaatgcagcattcacagacaacgaggtacagtttgttgaaaccagtgatacaagtgttgccaaagttctatttccaggtattacgtccgaggagaaatttgtgggcctcgttaaaagcgagccagagaagtttgaaaagttcgatgggaaatttgaagaaaaggaaattgtgcggtttgtggagctcaacaatgttcctctaattactggatttactgagctcaattcttgtaaaagttattcaagccctatt

SEQ ID NO: 65958 - DNA, 332 bp, Zea mays
  Clone ID: LIB3076-005-Q1-K1-C4
cccacgcgtgcgcccacgcgtccgaatccctcatcaagcaggaggatccagggaaagcagtctctgggctattcggcaaagatatctcgcatgctggtgctacctagagacgacgcagatgagcaacagaataagccagaaacgctactccgggttgcatcatttcgagtaggggagaaaatcgagcgttgcaatctgaaatccaccctttcgcagagttttgatcgggcggcttgtttacctgacctgccaacttccccatgctgctataactttgtgtgacctagccatgtcaataatgacagattttagtgcaaactaatggacccaac

SEQ ID NO: 65959 - DNA, 226 bp, Zea mays
  Clone ID: LIB3076-006-Q1-K1-F1
tacctcggaactctggaaatgtgacaggtgaattcatatcacatatcgttagaccaccactatcagactctaaagagcggcgaatttacaacttactagtgtgtgctggtacatatatgttcaggatagatgatgaacgtgttatagattccactcggtttggaagtttagtccgtctgatcaattactcatgctagcctaattgttatatacttgccataacttt

SEQ ID NO: 65960 - DNA, 72 bp, Zea mays
  Clone ID: LIB3076-007-Q1-K1-G12
cccacgcgtccgcccacgcgtccgcccactcgtccgcccacgcgtccgcccacgcgtccggttctagatcgc

SEQ ID NO: 65961 - DNA, 276 bp, Zea mays
  Clone ID: LIB3076-009-Q1-K1-B3
ttttcttgctttttttttttttttttgacaccacctgatttcattagatcaatggctcaaaatgggccgtaggattacacaaagcagaacggagattacaaaaggggagaacaataccaatggcccaacacagcccggtcggattacacaaacatgacgcaggctataacggctaggacgacaacagccgatcgacgactagcaccaccagagaacaacatactcgccagcacatgaggaccattgcgcattcacatggcccctcgtagcaacgtc

SEQ ID NO: 65962 - DNA, 132 bp, Zea mays
  Clone ID: LIB3076-009-Q1-K1-B8
cggacgcgtggggaaaatgtttgcttacagcatttattgaccatgtaaacgcacaaggcaaactaataagtatcctaggattaatactttgatatatgaaaaggcagcgactagtcaaaatgaaaaaataaa

SEQ ID NO: 65963 - DNA, 93 bp, Zea mays
  Clone ID: LIB3076-009-Q1-K1-D9
caatttggagttataaattgaaagttatcaccgtttgaaaggtaaggtaaagttctacatgatccccaaactgatttcccttaattcctcacg

SEQ ID NO: 65964 - DNA, 263 bp, Zea mays
  Clone ID: LIB3076-010-Q1-K1-H5
ttacaatggagaatggcctatgcgtttatggtattttctatcaaatctgatacagaaggagtcagattacatgtacatggtgcaggtgaaaaattaaaatcggaatatagttatgtgtgccaaccctaatgttaccgttcaagattatgattatatttgtgtcttcaaatacaaaaaaaaaaaaaaaaaaataaaaaaaaaaaaaaaaatataaaaaaaaaaaaaaaaaaaaaaaaaaaacaaaataaaaaataaaatttgaa

SEQ ID NO: 65965 - DNA, 182 bp, Zea mays
  Clone ID: LIB3076-011-Q1-K1-D10
cctctctgtatgagctcgtcttctttagaacagatgcgcacgggggtcaagagattggtaatgcgatgttagatgagtttctcacgtggctgaaacgatttagagagtttgcgctagttaggctagcctattataccttatctggcctcaataacttttttatatggaaaaaaataccaaaa

SEQ ID NO: 65966 - DNA, 199 bp, Zea mays
  Clone ID: LIB3076-014-Q1-K1-C12
tgggattcccttgtttgccctctctgtaggagctcgtcttctttagaacagttgccatcggtgtcaagagtttgctaatgctgtgttagatgagtttctcacgtggctgaaacgtttcagagagtttgcgttagtttggcttgcctattataccttatctggcctcaatagcttttttctatggaaaaaaaaaataaaa

SEQ ID NO: 65967 - DNA, 426 bp, Zea mays
  Clone ID: LIB3076-019-Q1-K1-B3
gtgcgcgactacgagtcccgcgccggcgccgtcgccgcgccggccgccgcaccgaccgcgagggctctcccgtgctactgggccatggagcgccacgagcgcaaggaccggaacctgcccaccaacctggcgcccgaggtgttcgacgcgctcaccgacgtgctctcccgccgcgccgcgcgccgagggggcgcggcgatcacggccgccccgccgccaccccagctcgcgctgcctgctccgcctccgcctccgccgcttcctcctccatcgccaccgaagccgcccatcgtccagccccgcgctccgcctcctccgctgccgcttccggcggccgtgcctacgccggcgacgtccgtttccgcggaggagctgacggggtcgtcggagtccggtgaggacgacgactggtcggacgccgtggcg

SEQ ID NO: 65968 - DNA, 161 bp, Zea mays
  Clone ID: LIB3076-019-Q1-K1-D11
agttaaaagcatgcctcaccacattgatgcacttctatttctgggggattaagtgagccaatacatgttggggctcctaacttgttcttagactgctatatcctataactatattcttcttatctacagtgtatgctatatttgaagctaaaaactataag

SEQ ID NO: 65969 - DNA, 252 bp, Zea mays
  Clone ID: LIB3076-019-Q1-K1-G6
acgccacccgtgcctctcaagctatcacacacacgctacctcatggcatttgactatctctgcatgtgcattattcaaaaagtatgaaaatcatgaacgtaatcaaatttcaattactgatgcacattatcctgagctacattctacatacaccaagcttatacagaaaaccttctgtcgcttatcctaaaacgaatgcttgagaaacttacacacacctgactgacactcacaggcataattgtcacccta

SEQ ID NO: 65970 - DNA, 55 bp, Zea mays
  Clone ID: LIB3076-020-Q1-K1-C6
accaggacgaatgggcggactcgtaggcgtacttttggaaaaaaaaaaaaataat

SEQ ID NO: 65971 - DNA, 336 bp, Zea mays
  Clone ID: LIB3076-020-Q1-K1-F9
acgcacgcgtggagctcaccaactagccgaatctttagactttatgagctgcagaggagatgggggacgagcactagcatccacgtacgccgactacggagagcgatgattcgccccatgacactgttgctcgtctccgcctgctgcgcgctggcggagccggctgacgaggtcgatactgacggtattgtccagaacgggaacttcgacgatggcccgaccaagtctgcgctggtgaacagcacccaggtgtccgacgcgcacgccatgcatgagtgtgacgacgtccgacttcatggagtacatcgagtacgagcccaaagcgtgcgacatgct

SEQ ID NO: 65972 - DNA, 264 bp, Zea mays
  Clone ID: LIB3076-021-Q1-K1-C5
gcagttgcgagcgtctgctgtggaggatcattgcttgatcacgcctgggttcgacattatcagattcgggcatcatctctaggcatgcagttcattaccagcttcagcggtccacattgctgaggaaaagagattcacagggagatggcaatgggtacctgatacccgatgggtatttactgcattagggtctgtatgtgggctaaatatcgtacccgcgggtctgtgatcgggcagaaatgttcatgcaacacacactgtatc

SEQ ID NO: 65973 - DNA, 446 bp, Zea mays
  Clone ID: LIB3076-021-Q1-K1-F8
cggacgcgtgggcactggttgagtgaagttagcctcaccgctaccgccctggaactgttgccctccgtgagatccgcaagtatcagaagagcactgagctgctgatcaggaagctgcccttccagaggctcgtcagggaaattgcacaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggccagagggcctaatcgccacctcaaacatcgtgacataaacatgaaatcctggggttattgtaaatctggtgccattgtagggacatatgagtagggtttgttttgggatcgcaagtttctctctggtac

SEQ ID NO: 65974 - DNA, 283 bp, Zea mays
  Clone ID: LIB3076-024-Q1-K1-E3
gacgttatagtcggacgcatgagccagcacctactggctcgtctactgctactgctgacctctcctattctcttcagtagcatctatcacgaaaccatgctgtcagtgccaacaacttccaccccatctttctggaatctgaggtgagctgcatctacctggatgcacacctcaccgaagcttaccggccagcagtgccacactgctgcactcatcaacgggaactggaccttctgactgtttaagaacagatctgagctacacactcatgactactcacatt

SEQ ID NO: 65975 - DNA, 77 bp, Zea mays
  unsure at all n locations
  Clone ID: LIB3076-024-Q1-K1-E5
gcccaaaatcaaccgaaaccaagggatctcatgtaagaagtctcttctattagtgtcancctaaattcagtgtcgcg

SEQ ID NO: 65976 - DNA, 354 bp, Zea mays
  Clone ID: LIB3076-024-Q1-K1-F8
ctctggaaagcgaaagggcctctatactattggttaaggcttcggagtagcaccagcgaggcccgatcttgattcccctcgagggcggattttcgggcttggttaaaaaatctcctcgatgtgcctcattcgctctcgggttacgatgtcctgtgcgccattgtttcggttgacgccggtccgttagtaatttgaggccagggttcggggattttctcggctgggactattgtttcggtctcttcttaatgttataccgggagggtggtcattccctctgtcgagttattattctctggaaaaggtgcaacactttaaccatgttggtttgcttcatgtgtgatgtcctggttt

SEQ ID NO: 65977 - DNA, 294 bp, Zea mays
  Clone ID: LIB3076-025-Q1-K1-B7
aacatgcttactgttctatagtccaacctaaatacgagtcactggaagcagctttacaacatcgctactcgtaaatccctccccccacctcaacttaataacattgcatcacattccccttttgccaactggcctcctaccgaaatcccccagtctgataacacttctcaacatttgatcaggatgaatgcctaatagaacccgccctgtaacatcgcactaaactcgaaaactgttttgcttactcacagccataccgttactgtcgtcaacgacgttgctcccgcatacttt

SEQ ID NO: 65978 - DNA, 343 bp, Zea mays
  unsure at all n locations
  Clone ID: LIB3076-025-Q1-K1-H1
cggggtggcttataatacacctactcctcgtgttcagggttcgtgagactctacagagggcgatttcttgggtgagcggatcgagattgccgcatcngatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcc

SEQ ID NO: 65979 - DNA, 358 bp, Zea mays
  Clone ID: LIB3076-027-Q1-K1-B12
gactcgtccgttgtgtctttggggtgaccagaatgctatttacggctctccaagtgaccaacaccaagggctcaacggtcgacacaacccgtgaagttggctgaaccatgcatttccccatgttgaacatccaccagtggtcacgcctcatgcatcggttgctccatttgatctgcacaagactagacaaggaattgcctttaagatcttctgggtccctagtggatacaaccagtccatctcctgtgcaattgagctttccattgcccgctatccatgagcatgtgttacaaactcgaccatcgtctccggttaatgaattgctacctgtgcatatagagtgcttgctagagggatc

SEQ ID NO: 65980 - DNA, 335 bp, Zea mays
  unsure at all n locations
  Clone ID: LIB3076-027-Q1-K1-F1
tcttttttgtatgattcatctttatttgggtntggtttctatggtttgttgttttttttttttttttacaacccaacgatttttttaaaaaagcatccaattacattttgcatgcccttaaatccatggccatccatgaatactgtaaagcacacccaccctttttatttatttatgacatgggcattccaaaacccgcaacccatatgcatacatatgtatgtaaatatatatttcacggattgactttgaaggcaacacaccgaggtccaaattcctttaagatcttgtattccctgaaccctgttttggtgaaaagctgaccccattttttt

SEQ ID NO: 65981 - DNA, 146 bp, Zea mays
  Clone ID: LIB3076-028-Q1-K1-C5
acccggttcggcgaacggtcagttcatcgggaggatcgcccaactaattcgaagtaatcgcctggataagctagaactgcagtcattgtcaccaccggagccaccaactatgcgaataacggggactatgggcgcaaggctcgctg

SEQ ID NO: 65982 - DNA, 278 bp, Zea mays
  Clone ID: LIB3076-029-Q1-K1-C11
cccacgcgtccgcccacgcgtccgcccactcgtccggcttggcactcctgtatacagtatgcttgccaaggtaaaccctgccacgttccgaacatgattcagatgatgtgcggaacgtggcagggtttaccttgggaatgatggaatgatgggcagtgggaaggcttggcataggattgtgtcgcatgttcagactgagttgtatgagaatactgagtatgcttggcactcctgtatacagcatgcttgccaaataaaataatttattataataatat

SEQ ID NO: 65983 - DNA, 269 bp, Zea mays
  Clone ID: LIB3076-030-Q1-K1-A2
tcacactcttgcgaaaaaaaaaaaaaaaaattaaattaaaaaaaaaaaataaaaaataaaagtatagattccaatctaacgaacacaatcatacaaacctataaactctaacataaaactacctaaatctaaatcatcttaccaaaattctacaacatctattacttacaaaaccctacttttacacaacttaatcgccttccacaacatcctcctttatccaactgccgtattctctaaaacaccctttccgacttaactttccatca

SEQ ID NO: 65984 - DNA, 252 bp, Zea mays
  Clone ID: LIB3076-030-Q1-K1-G6
cccacgcgtccgcccacgcgtccggttgctggttgcgttagggccaagtcctaggcctggtgatggtgattacattgaggggtggtcaagattcacttatttatgtttcttcaccctttcctggactcggcgacttttttcatgtcgaactctgaattttcttattcaacagaagttgataaaaaaggacttcctgtgtaaaaaaaatacaaataaactaaatgaatatctagactagacaaaaaaaaacaa

SEQ ID NO: 65985 - DNA, 183 bp, Zea mays
  Clone ID: LIB3076-030-Q1-K1-H11
catgttattgcttaaaaaacaatattgagcttgaacaagcaatccaatcttggtagaattttttctcaggcaaacccttttgagttcaattcagccaggacaactataggtttggatataataatagtacatagattggattgcttgttaaagctcaatattggtattgaagtgttattgctt

SEQ ID NO: 65986 - DNA, 467 bp, Zea mays
  Clone ID: LIB3076-031-Q1-K1-E3
attatcgatggtccaaatcaagatatagtggttatatgtcagcatttgtagatgcaatccatccttctcgtctgttcaagagcgatctggatgtaagcggcattgaagatcttcgacttcagaaagaagaccatgtaacaaatattgaaggaatgcgtgaagctataaagacgcttcatagaaaacagagacagttagaagacgaagaggcaaatatacacaggcagaaggaagaaattattaatgcgatgagataccacaagaagacacgagaagagatacaaagacgtgttgatatcaaaaagcgaatactgaaggacatatccagagaagacgatgtagaatccagcacgagaaagcttgttaatcaggttgctaagataaatgatgagaggtttcatgcaatgataaaacttaaggatttgcttactgaaagctgtgctctcaaatggagtcacacagaaaag

SEQ ID NO: 65987 - DNA, 358 bp, Zea mays
  unsure at all n locations
  Clone ID: LIB3076-032-Q1-K1-G5
ggagttacgcagcttgtcggaccactacacgttctgcttgatttcgctctcgccgctggactggcgantctatgcgcttgttgaggagctgatgccctttatcagcgagttcagcctaatcagataccgagttctcatcgagatcaagtggctactgaaactttctcaaattcctgagatcactgaagtgcctcagttcatcaaggaagcacattccttgttaaatgccattattgataatttttacattagatgaatcaaaagaagttaataaaatctaaaaagttaccaaccatgaagtgaaaaccctaaaataccttcttaaacaaatggtacatttcaaattcataaattgcaa

SEQ ID NO: 65988 - DNA, 359 bp, Zea mays
  Clone ID: LIB3076-033-Q1-K1-A10
ttcttttttttttttttttttttttttaagaacattgttaaacctccacgggtattacatccattccatcccattctctccaagcttaacatgtactactaccactactaacaatctgacccttttttttcttaacacaacaaccaaattattaagtatcacacacaacacactctcacacacccactgccctaaacatacaccacttgcttttacgcacaaggaacaacactctacactcaaattaaaccacttttaaaattacccagccacctattcatcaactcttcacccctgcctttccaagtatcttttcatgtccccaacaagcgttaaactttcccaaattgtaaaaattt

SEQ ID NO: 65989 - DNA, 342 bp, Zea mays
  Clone ID: LIB3076-033-Q1-K1-G10
cccacgcgtccgtgtcaccggactgcaaacatttgaaccagggcggagccccattacggatgggccgatgtcgtcggagactcgacgcagctgctgtccatacagcccgtggagaggccacccggcgtgttcccggccatcgacttcagctccgcgccgccgccgaaggacgctccgccgggcatgcccccttctcctctggactgagtgaattaggcctgccagcacagacggatttttctgtctatataggctccagattttgcctgtaagggaacagcattctttgtaggaagttgaccggaccccgttcctgcgttcaaaaaaaaaaaaacaaaataa

SEQ ID NO: 65990 - DNA, 377 bp, Zea mays
  Clone ID: LIB3076-033-Q1-K1-H9
gtgacatcacctgatttcattagatcaatggatcaaaatgtgccgtaggattacacaaagcctaacttaaattacaaaatgggaaaacaataccaatggcccaacacagcccggtccaattacacaaacatgacccatgctataacggctaggactacaacagccgatcgacagactatcaccaccagagaacaacatattcaccagcacatgaggaccattgcgcatccacatggacccttttagaaactttgctccactgccatgcggccctctaagtgagggaccgcgcaagcgttaaccgatcccaaaaaccatgatctaccttcaaaccggctgcaacacccgacagagcatcctagctccgaatgccacca

SEQ ID NO: 65991 - DNA, 220 bp, Zea mays
  Clone ID: LIB3076-034-Q1-K1-B11
ggtggttttgtttgttccaattagtttttaccacttttcccattcagttggccgcaaggtttctgtaaatctttcggtactgttggtttcatatttagaaaattcacaaagcggccactcaattctctttttggaaagtaactttatttttttttcaaacaaaaaaaaacaaaaacaaaaaaaaaaaaaaaaaaggggcggccctagttctagatcgcga

SEQ ID NO: 65992 - DNA, 294 bp, Zea mays
  Clone ID: LIB3076-035-Q1-K1-A1
accgctgacgcgtggggccccccttttttttttttttttattttatggcaaaaccattcatcaaagcacaggtcaaaaacaaaacaagctctccatacaatacacctatcaaaaacactactttccctatttacaaatacttccgttttgtcccttaccccaagaccaaaatctaccatattctaatgaataaaaaagtctttgattaatttccctactattttcaccttttttcttgttaaaaagaaaatgtctccaattatacgctctaagcttcccccatttccttcaaca

SEQ ID NO: 65993 - DNA, 451 bp, Zea mays
  Clone ID: LIB3076-035-Q1-K1-B11
cgcgcacaatgcagtgaaccaggcacttgttgccacctgtttgggacttggcgcggagtactttcggattgtgctggggagcaactgtggcgctggtgtgctggacttcaccccacgggctgggggaggtcctcctaccgtctgccttaaccgcttaaatcaggtctgttagcatttccgcttggtaacaacttggagatcaaagaaatttcaccagacaatacagggaaaatggaagggtcaaacaattaaaacatggattaatctgcccccaaactgtatcttgtagtacagaccccaaactctcctgtcgctgggggaaattctgcgggaagaaagacgagcaagaggatcattctggcctgtcaaggggctacacaaagcagttctgagattagcttgggtggaacgggatatgcgccgctgaacatgctcgggactatacagtctc

SEQ ID NO: 65994 - DNA, 186 bp, Zea mays
  Clone ID: LIB3076-036-Q1-K1-E6
ctcgctggcgcttgtgctagttgcgtgggcaggacagcggactcctaggtatcgtgtctggttggctgctccgccatgtctgtgctctgctgtctgctcatacatcaccaggctcctggagctctcttgggtgctctgtgccatggtgtttgtacattatatataagtgcgcggattaactaaaaa

SEQ ID NO: 65995 - DNA, 304 bp, Zea mays
  Clone ID: LIB3076-037-Q1-K1-F6
acacacactctgtcgccttcgccgactcctcttctagcatcatctcgcacccttaaccctacgcatcgtgtcacatctcagccgtcacgggggatttgatgctcattcaccaacaacttatagtactcagcgcaagctaccattattacaacaattcatgacagccagcatctcaagcacatactgacaactcaacctctattagcgctgcaaatggcacttgtcacactaacacttaccttagaacttttccacgccaacgaatttcatcacttaccccttatcaatcttatatcgcgccctt

SEQ ID NO: 65996 - DNA, 74 bp, Zea mays
  Clone ID: LIB3076-038-Q1-K1-A1
accacgcgtccggttctagatcgcgagcggtcgaccttttgctaatataaaaaaaaaaaaaaaaaatgggaaaa

SEQ ID NO: 65997 - DNA, 69 bp, Zea mays
  Clone ID: LIB3076-038-Q1-K1-B11
aaaaaaaaaaataataaaaaaattttaaaattaaataaaaacaaaaaaaaggacgggcactggtataat

SEQ ID NO: 65998 - DNA, 200 bp, Zea mays
  Clone ID: LIB3076-038-Q1-K1-B6
aatcttaacggaaaatttgtacgtcatccttctgatgagaggaacgcattaaggaggcgaaataggtgtttttttgcgctgggaaaagtttacgcttgatgcataataatttgtaggacggcaacgctctagagcgcaggttttgttcacctcctgtaccgaggaatgcttaaagttacatttcacaaaaaaaaaaatat

SEQ ID NO: 65999 - DNA, 335 bp, Zea mays
  Clone ID: LIB3076-038-Q1-K1-B9
gttctttccttcccaattcccatgttacaatggagtctggattcattaaaaaaaaaaaaggaaaaataaaaaaaaagaaaaaaaaaaaaaaaaaaaaaaaaaaaaaaaaaaaaaaaaaaaaaaaaaaaaaaaaaaaaaaaaaaaaaaaaacaatataaaaaaaaaaaaacttaaatacaacaaaaatacaaaaaaataaaaaaaaaaatagggtcacctatattcaattcactggttcgaatctttacatatcttcaagactgtggaaaaccctagtggttacccaaaattaatttccttggaccacatttaaaaaacgccagctggggaaaaac

SEQ ID NO: 66000 - DNA, 110 bp, Zea mays
  Clone ID: LIB3076-038-Q1-K1-D9
cccacgcgttcgcggactcgtgggaaaaattataaaaataaaaaaaaaaaataagggtagaggataaactaaaaaacaaaaaggaaataaaaaccaaaaaaaaaaacaat

SEQ ID NO: 66001 - DNA, 396 bp, Zea mays
  Clone ID: LIB3076-038-Q1-K1-H12
gcgcctggtgcgtgagatcgcccaggatttcaagaccgaccttcgcttccagagctccggcgtcgccgcgctgcaggaggcgtccgaggcctaccttgtcgggctcttcgaggacaccaacctctgcgccattcacgccaagcgcgtcaccatcatgcccaaggacatccagctcgcccgccgcatccgtggggagagggcctaggcgtcgtcgcggtggaggtggaagtagtagtcgcagtttctgtcatcactgtctggctagaagttgtagagatgtgccggtttatgtagtttgggttattggtcgaatcattatgtagttgggtcttcactgctgcaatttaactatgactatgcaatggcaatgaagttctcggttaacaaaaagaaact

SEQ ID NO: 66002 - DNA, 278 bp, Zea mays
  Clone ID: LIB3076-038-Q1-K1-H8
cggacacgtctgtgaaggcgtccagtaccttgatgatgcatgtagcgtgacctgacaagggacagtataaagcccctgcaagcacatccggctataatatgtactagtatgagcatgcagacaacagttgacaattgaattaatcatgtgatcatctatcattgaacggctctattcgtgaccatatatcaaaatatataagataatacagataattggaggatgttaatacagtgcagtattttggatgctgcgttttcatggggggcaaacaattt

SEQ ID NO: 66003 - DNA, 463 bp, Zea mays
  Clone ID: LIB3076-039-Q1-K1-B9
gcacgcggacgagttctccaagctccgcgcctcgcacgacgccgtcgtcctccacaactgccacggcgacacggaactgctgaagatgaaggacaagctggcggaggtggaggaggagaagactaagctcgtcgcggcggcggcggctgcggccggcggctcaacgggcgcatggagcagcagcccgagctcgtcgtcgttctcgacggtgacgcaccacccggccgcggcgctgcatgtggggcaattcggagtgcagccggaagaggcctccgacctcgcctacatgaccgagtacgcctacaacagctacatgaacatgatggacctcgcgcccggctacttcggccgagtcttctactactactaccacttcaactgatccacgagcatgcaagatgaagatgaaggaagctacaagacgaatgaaggattgactggactatcatctatgtactatttt

SEQ ID NO: 66004 - DNA, 304 bp, Zea mays
  Clone ID: LIB3076-040-Q1-K1-H6
gagtccacacctccgcacacacgtcacccccggttaaagtataccctctgctgctactgcttaagaccatgatgcattctataccaatcactatacactctactatattgattacttacgatcatcagaattagattgaccactaatactcatgctgctccactattaagaacttgattatcatcacttaaaatgtccatcaatatcaaatgctacttttctaaccttacacaattagcattctacacaggaaatgatcctaaacgacctaatcttttatgatggatactacttccaacatact

SEQ ID NO: 66005 - DNA, 410 bp, Zea mays
  Clone ID: LIB3076-041-Q1-K1-H12
cgagaaacattaccgttatgtcacgagccatgacgtcgcttattggtcaaagagcttcatcatatacttggaaagggtttgtaaggatcacttcaagaggacttgttggggcatagggttgggttttggtttcagggtggtggccttggaccctcatttcacaaagcttaacatggattcaatcattaatgcttatgagctttcagagagcagggctatattgctcgattatgatggaactctggttccccaaacttacctcaacacggaacctagtccacaggttttgagcatcatcaataccctttgctcagatagtagaaacatcgtttttcttgtcagtggtcgagacaaagataccttgggaaagtggttctcctcatgtccaagattgtggattgcagctgaac

SEQ ID NO: 66006 - DNA, 73 bp, Zea mays
  Clone ID: LIB3076-042-Q1-K1-C1
cccacgcgtccgcccacgcgtccgcccacgcgtccggatggtgctagcttgcacgataaaagaaaaatttaaa

SEQ ID NO: 66007 - DNA, 231 bp, Zea mays
  Clone ID: LIB3076-042-Q1-K1-E6
tcctcttcccactatccatctaccttctactttaccaattaccacggctaatttcaccaggggattttttacaactcactccggaatcaaaaccttatccaaacaataatcagcacttctacacatacaatctatataatcattctcttcgttcatcgatctatcatgaaaactactcacgtactcactcctactacttcctccaaacattcctctcttaaataccacaac

SEQ ID NO: 66008 - DNA, 572 bp, Zea mays
  unsure at all n locations
  Clone ID: LIB3076-043-Q1-K1-H9-F2
acgacttagtatagggaaagctggcccttctttcggtcgctctataactagagganccnccngcttgatttgagcaagggnnccacacgcgggngctttgaattctttttttgccatcactntctgcctcatttgccacttcactccgggaggaggaagagagccaagataaccccttctacttcaactctgacaactcctggaacactctattcaaaaaccaatatggtcacattcgtgtcctccagaggttcgaccaacaatccaaacgacttcagaatcttgaagactaccgtcttgtggagttcaggtccaaacctgaaaccctccttcttcctcagcaggctgatgctgagttactcctagttgtccgtagtgggagcgccatactcgtcttggtgaaacctgatgatcgcagagagtacttcttccttactagcgataacccgatattctctgatcaccagaaaatccctgcaggaaccattttctatttggttaaccctgatcccaaagaggatctcagaataatccaactcgccatgcccgttaacaaccctcagattcatgac

SEQ ID NO: 66009 - DNA, 539 bp, Zea mays
  Clone ID: LIB3076-043-Q1-K1-H9-R2
aattcccgggtctaagctccatacttatccagaacacgcatgcaccctttcttcccttttgctgaccctgttggtgactacccttacgctgttcctgttggcgatggagaccatccacaaagcacgatccactctgcttgtagatcagctacataactctttcaccacacccatagaacgtaagccccaacacgtctttaccgtccagagctctaccgatgctgcttatgacattgtccgtcttacctgcaaagaggttcctattgatgatattaccattgataccgaaaccagagaaattcacgccggacgtagcctggatggctactggatatgctgctgagattacaaatacatagtgcctacaaagctcagctctagaactctcaaatgacaacggttccttactctctttatggccaaccaagtgcacacagacccatccttcaataaccactatgataaccatgagcttacaatagtactgtggcacaaaaagagcctcctctttcatcactatagaactgattaacacattc

SEQ ID NO: 66010 - DNA, 69 bp, Zea mays
  Clone ID: LIB3076-044-Q1-K1-E3
gcactcgtacgcccacgcttcctctcactcatcatcaaacttttcaacccaccccacccaccatgcaac

SEQ ID NO: 66011 - DNA, 69 bp, Zea mays
  unsure at all n locations
  Clone ID: LIB3076-046-Q1-K1-A5
cccacgcnttcncntactcatgcgcggacttttgttaaaaaaaaaaaaaaaaaaaacaggggcaaggtt

SEQ ID NO: 66012 - DNA, 374 bp, Zea mays
  unsure at all n locations
  Clone ID: LIB3076-046-Q1-K1-H4
ccgtaccaactactcaataaccctagctaaaccccacgccgccgcggcgacctcctccgccggcaggatggacaggctcaggggagccaagttgccgggcgtgccnaagggcgggagtgcgctcgtgaaggtggcgctgctcggcggcgcggggctctacgccgtcctcaacagcttctacaacgtcgagggcggacaccgcgccatcgtcttcaaccgcctcgaggggatcaaggacaaggtgtaccccgaaggaactcacctgatgatcccgtggatcgaaaggccgatcatctacgacgtccgcgcccgacccaacctcgtcgagagcacctccggaagccgcgacctccagatggtgagaattggtcttc

SEQ ID NO: 66013 - DNA, 219 bp, Zea mays
  Clone ID: LIB3076-047-Q1-K1-B7
gggtcttcaaagaaggttttcactgccaaacagtgcacaagccgaattttacatgccatggtatccttctccgtacaaatcgaaagaaattggcaccaaaattatgtacttacatggtgtctatctaccattcactcactcactcacgccaagaacaaagatgcagttttggagcattaacgcaacgcaacagctacctacctaccttttgcaattcac

SEQ ID NO: 66014 - DNA, 244 bp, Zea mays
  Clone ID: LIB3076-047-Q1-K1-E12
tacggcttatctctgctctactctcacctggggatgcatcactttcctgactcttcaacggccactacttataaaaccaaatcgtcaccatatcttaccaccaacaacactaatctgaataaacatcatgccatatacacaaacattctccaaccaatctactcaagcaacatgtacacccacatttaaagctaccggaatatccatgaacaccgccttatccatcacatggtatcatactcac

SEQ ID NO: 66015 - DNA, 181 bp, Zea mays
  Clone ID: LIB3076-047-Q1-K1-F9
tctttcattcaacggcatatttcggatatttttacacctaaggtgaattcactatccttcgttttacaacttcgtaactgacaaaaccctatcattacccaacttaaccaccttccatcacattcatcttcctacaccttacttaatacctaatattcccacacctatcaactcttccaac

SEQ ID NO: 66016 - DNA, 320 bp, Zea mays
  unsure at all n locations
  Clone ID: LIB3076-048-Q1-E1-B6
gacgggggcggcctggcggccctgaaggcggcgcgcgccgtgaangagacgacngngatcgtgggccttgaggtggtgcctaacgcgcgagaagttctggtanggctctacgagcgcacgctcaaagagatcaangccgtccccgaagacgaaggttaccgcaaggccgttgaatccttcaccggtcaccgcctccagatctgccaggaggaggaggactggaagcgcatcgaggaccgaatcggatgcgggcaagtcgaggagctcatcgangaggccgaggacgagctcaagctcatcgctaaaatgattgaatggga

SEQ ID NO: 66017 - DNA, 121 bp, Zea mays
  unsure at all n locations
  Clone ID: LIB3076-048-Q1-E1-B8
gacgtcatanctcttctatattgtcacctaaattcaggggactggcggtcttttttcaacgtcatgactgagaaacaactctcttttcccaactttatctccttgcaacacaacccccttt

SEQ ID NO: 66018 - DNA, 353 bp, Zea mays
  unsure at all n locations
  Clone ID: LIB3076-048-Q1-E1-C7
ctggcatcccatataatagaataaacctagctcatggacgagcccataatcctggatggactaacggtgatagtatccttgcagattctggtacggagcaacttgaattcatagctctgtcacagaggactggagatcccaaataccagcagaaggcggagaacgtcattaaacagcttcaaaagatatatccaagtgatggtttactgcctatttacataaatcctcattctgggacagcatcatactcaactatcacatttggtgctatgggagacagcttctacgaatatttgctcaaggtctggatccagnggaataaaactgagcatgtaaaacactacagacaaatg

SEQ ID NO: 66019 - DNA, 283 bp, Zea mays
  Clone ID: LIB3076-049-Q1-K1-B10
tctcccgcccacgcgtcctgagatgctgaatcgtcatttcgagaagtcttattcaaccattatcaaggttccatatcgcgactttgagatccctgcagaagctcaacgtggaacactttctactgtggaaaggattattatgcgagctgtggatgagctgcaagctcttcaagatgaacggaagaaagtggatcctcagaaggccgaaactatcgatcaatttttactgaaattgagatctcttgggtcatgaaaagctgcattcacttttattcttgatgat

SEQ ID NO: 66020 - DNA, 375 bp, Zea mays
  unsure at all n locations
  Clone ID: LIB3076-052-Q1-E1-B3
accacgagtccgcccacgcgtccgcctgtacttcctcataagaaggcggtggcgataaggaagcaccttgagaggaacaggaaggacaaagactctaaattcaggctcattcttgtcgagagcaggatccaccgccttgcccgctactacaagcgcacaaagaagcttccacccacgtggaagtacgagtcaaccactgcaagcactctggtggcctaagcgaggagctcagcgtcgggcgcttgaagccgagggcattgttggaaatcatttttatgtaccgttttaagagtttggagtgaactagagatggtgaatgtccctcctctggaggatgccatggaccctttttgtttacatanaactgccctgctg

SEQ ID NO: 66021 - DNA, 293 bp, Zea mays
  unsure at all n locations
  Clone ID: LIB3076-052-Q1-E1-C3
aaaaaaaaaaaaaaaaaaaaaaaaaaaaaaaaaaaaaaacaaaaaaaaaaaaaaaaaataaaataaaaaaaaaaannangggggggccccctcaaaaaattaaaaataaaataaaagggggggcgccccaaaagatttcatccttagttacccttaaattaaatttcagaccctttctttataatcactaaaattaaaaaaaccggcggttttttaaaatattctcgcttggaaaaacccccctttttcccaatttagtctcattaaaaaaaatcccccttttatcacttttc

SEQ ID NO: 66022 - DNA, 198 bp, Zea mays
  Clone ID: LIB3076-053-Q1-E1-C1
acgcggacacgtgggtctatatcgcgagcggcgccctttttgttttttgtctgtgtggtttttgtttgttttggtctccaggggaactcatgctctcgtgccccgagctgagtggatgaattggtctgccgaatggtaaattgtcgaactgtatgtagattagcgtctaaaggcactaagtataagtagacctggggg

SEQ ID NO: 66023 - DNA, 414 bp, Zea mays
  Clone ID: LIB3076-022-Q1-K1-E10
cccacgcgtccgccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctgtccatccagctccgtgggtccgcaaccaagggcaagctcgtgaaagtcaaggcttcgtacaagctctcggacgccgccaag

SEQ ID NO: 66024 - DNA, 425 bp, Zea mays
  Clone ID: LIB3076-022-Q1-K1-E11
ctcacgcgcacgatggttctgcagatgaggggcactatcctgcctgggcacaagtgggaagtcatggctgatctgatcttctacagacacccagaggaagcaaaggagcacgaggaggaagctgctgccgcccctgagtttgctgcagctcactgattaccaaggagctgatcagcggggcggtgaccagcggacctctgatgtggctgcaccacctgttgctcctactggtgctgattggggtgctgcaccagctccagctcctacccgtgatggctgggatcaaactgcaggccctgttcctgtggatggcactgttcctgcagaggccgctcatactggttgggaatcaccagcccaacccactgcccaaggctgggaataggcgttcaggcatcactacgagacgtcttgtgcaggattat

SEQ ID NO: 66025 - DNA, 381 bp, Zea mays
  Clone ID: LIB3076-022-Q1-K1-E12
ctcacgcgtgcgatgtcttctctgtctgttcgtgctcctccgactgatccatccaagacgggaatcgccatgctgtactcgcaggaacaccacttggaatccaaggccctcgctgaggcatccaatacctacccgcagcttgctggcaccattcgttacaacggcttcatcgtgatcgacagccatccctgctcggttgctgaggcttctacatccatgactggtactcatggtcactcgagatgccgaatcagctccatctacatattgcaatggaaataacttgactatattcgtccttcatctcacaactgctacattccgaatgtgaactggactgagtatcagctgattgatatatccgaagacggattagtgagc

SEQ ID NO: 66026 - DNA, 439 bp, Zea mays
  Clone ID: LIB3076-022-Q1-K1-E3
ggaggagaacaagaggatggtgaaggcaaggcccaagccaacgccggtcaaggcggccccagaagtgatcttcgacccaatggcctctggtgcccggaagccccgccgcccaggggcgccgtcagccagcaaagaatggcacagcttcatgggatcgagtctgtcggatatgtatcggaagccagttttggagaaatctgctgacacatctgatgaggagcctgacattgatatcatgaagctgctgaaagatgttgagatcattggtgcccctacatttaaggggcgaaagcaaatcgagaaccgcagagtagttgagttgggtggaaagtccgttaagaagcaccgcacaccattaagtgttgcgaagccagctctgaagaatcagaagaaacgagaacagaagaaaatggaagaggaaaaactacttgggatcttt

SEQ ID NO: 66027 - DNA, 295 bp, Zea mays
  Clone ID: LIB3076-022-Q1-K1-E4
ggtgctacaaggtctgggtgcaatgtatcacactatttcgttggttgtctatgaaatctgccaaacattctgcagacacaacagagcaggccaagctggtggcgaaggattggaagaaaatgattgacaacacagtgtgttgtagggaacttgacacgctgtctaggggtcttctccaattccttatcgcatataacattgtatctgaattcaatatccatgatatcatcagtatatttgctatggttcgcaaaggttacaagaataacaacattgccaagctttgcaaggatct

SEQ ID NO: 66028 - DNA, 335 bp, Zea mays
  Clone ID: LIB3076-022-Q1-K1-E5
cgcagatcgagtcatcaagctagctagcccggagcacgcctagacacgccagcagcaatggcggctcagctggccgtcgcgtttctcgccttgttgtcctcctctgccttcttggccgtgtctggccagaagttcaacgccatcttcagcttcggcgactccatgtccgacaccggcaacctgtgcgtgaacggtccccccgccggcctgacgctcacccagccgccctacggcgagaccttctttggccgcgccacctgccgctgctccgacggccgcctcgtcgtcgacttcctggccgagaagttcgggctaccgctgctgaagccgtcgaa

SEQ ID NO: 66029 - DNA, 394 bp, Zea mays
  Clone ID: LIB3076-022-Q1-K1-E6
tgctttgcagcccattaatggtcctatgggtggtccccaagaggttgaggctccgttagatccgatgagagagctgagcagactgatatctgaacgcaagtttgacgaagcatttacaatggctcttcaaaggagtgatgtttccatagtgtcgtggctgtgctcccaggttgatttgcgggcactatgtgcaatggttccagtacctcttaaccagggggtccttctggccttattgcagcagctagcaattgacattcacaatgagacatcacggaaggttcaatggatgacagatgttgccatggcaatcaacccaagagaccagatcatcgcggtgcatgtgcgaccaatctttgagcaagtctacagccaattggcccaacaacggaca

SEQ ID NO: 66030 - DNA, 328 bp, Zea mays
  Clone ID: LIB3076-022-Q1-K1-E7
cgcaaccaaaccagccgccgctactctagggatctagagtcagttaaaaacaggaacaagaatccagagccaagcagccaacgtgaacaatgtacacacgcacacgccgatcaccagatccaacggccctcgctaatccagcccaccccaatcgcaccccaaaaaaaaaaacaagagcagattaaaccaaacaaataggcacgcatcacaaggcaattccgaagaaggaccagcagcgccaggccgcgccctcactggctgagcgcgccgacctccgacacggcgggcgagtccgagacgccggaggactcgtccatggactcgtgcg

SEQ ID NO: 66031 - DNA, 363 bp, Zea mays
  Clone ID: LIB3076-022-Q1-K1-E8
ggtacctggaggccgagatgaagctagactggtccttcaacggaggcagggtgccatgagcgacccatgggtcgagcttatagacaagacataagctcgcgcacagtaagcaagagacttgatcaagcatatgcagtgagaagagtaaggtcatcgttatatagcgtagtcgcgatcaatgcaagttatcaactgagtcgcatgagtgagtgcatgcatggataaagctggctagcttagctagctctcatcatgcgatgggaccctgggtgtgagatcgagaggcgtgtttctctgactaatggactaagctatagtgctaattggacgcatgtgaagacccccttaggcgtggtggtggtt

SEQ ID NO: 66032 - DNA, 393 bp, Zea mays
  Clone ID: LIB3076-022-Q1-K1-E9
cccacgcgtccgggccggcggcgtcgtcgtcgtccggcgcgggcgcggcggacgcggcccctcccacagacgtgaacaaggcgctcaaggacgaccagttcagcgagttcaagcagctgctgcacgacacgcgcgtggacacgcagatcaacgcgcagctgacggacagctacaacgggctgaccatcatggcgcccaccaacgccgtcttcgacaagatgaaggccggcgtgctcaacgggctgtcgccgcaggaccagatccagctcgtcctctactgcgtgctgccccgcttctacagcctcttcatgctcggcacccttgacggcaaggtcaacacgcagggcttcggccacgacgggccctacaggtacgacatcaagcggtcgggca

SEQ ID NO: 66033 - DNA, 432 bp, Zea mays
  Clone ID: LIB3076-022-Q1-K1-F1
agagtgccaatctaagggatggcacaaatctctcactccagcagctgatgtagaaagagagattcatgaatcacagaaagcaggattttttgaagaaataaattttccttacccgatcgtctcggtgattggtgggggtaaaagagagatcgatctttatgcatattattttggcgccgacttggcagttttcttccttgttgcaatgttctatcaatctatcctaaaaaataagagtgaattcttggaagtttaccagctggaggatcagttcccaaaagaatttgttttcatccttatggttctctttatcttgatagtggttgaccgcattatatatctttggtcctttgctaccggcaaagttgttttctatctttttaaccttgtgcttttcacgtattctgtcactgaatatgcttggggaacgga

SEQ ID NO: 66034 - DNA, 435 bp, Zea mays
  Clone ID: LIB3076-022-Q1-K1-F10
cgacctcctggagcgcgagaagcggcgccagcgtcgcggcatcgagctcatcgcctccgagaacttcacctccttcgccgtcatggaggcgctcggctccgcgctcactaacaagtactccgagggcatgcccggcgcccgctactacggcggcaacgacgtcatcgacgagatcgagaacctctgccggtcacgcgcgctcgctgccttccaccttgacgccgcgtcctggggcgtcaacgtgcagccctactcgggctcccccgccaacttcgccgcctacaccgcgctgctcaacccgcacgaccggatcatggggctcgaccttccctccggcggacacctcactcacgggtactacacggccggcggtaagaagatctccggcacctcgatctactttgagagcctgccgtacaaggtgagcgccgcaac

SEQ ID NO: 66035 - DNA, 435 bp, Zea mays
  Clone ID: LIB3076-022-Q1-K1-F11
ctccggttcgtgaggaggtaaagggcacatattgtgcaacatacttgagctgcgatgatcaaagtcacccggatatggttcctgaattttaccatggagtgcaacggactactgaaatggtgcagaaacaaatggctgatttcaggcaatattccaccaacagaaggcctagtgaattagggaacggctctcttaatgccaatggtacagcagctgctcagaggggctgggaagacgtggcgaagctagttattacagccttgatcaagctcttctcctttatacggctgttcctttccagagccaccgagagtaggctatagaaggtccgtcgcactgccacatcactagcagcagataagccaaagccgctccgagccgttagcgaagaagaagtgcgcgcctgactgcagcgcctggacagtctcgagtcgc

SEQ ID NO: 66036 - DNA, 211 bp, Zea mays
  Clone ID: LIB3076-022-Q1-K1-F12
ctgacgcgtgggaggaggtaaatgtctgctactgcgcatcatactgatccatccatgacaggaatcgccctgatatacttgcaggatcacaccatggaatgcaacggactacctaaatggtgcaaaaactaacggctgcatgctggcactattccaccaaccggatgcctcgtgaataagaacacggctttcatagttgcaaaggttcata

SEQ ID NO: 66037 - DNA, 301 bp, Zea mays
  Clone ID: LIB3076-022-Q1-K1-F2
gcatcccgttatcccccgtcctggagcaatggaatcaagaaggccataccgccaagaagtgcgtcatccaggccatcgtcaagaagctcgtcggcctccgccgcttcgcccacgcactcgagctgtcgttctggatgaccgaccgcaggcacctccacctttcggtcggtgacgtcgcgtaccggctggacctaatcagcaaggtgcacggccttgagaaagccgtcgagtacttcggcatggtaccgaagcagctgaagaagccgcagtgctacggctccctcctgaaatgctatgtgga

SEQ ID NO: 66038 - DNA, 175 bp, Zea mays
  Clone ID: LIB3076-022-Q1-K1-F3
gcgacagcgcgacattcctggatcgggctgatttgtctctagagcgtcttatcgtcaatgagggagtcatggatgacactgagcaggatgtactgaagatacacattttccttacactcactgaatctgtgactgtggatgatcaaccagagatccctctttatgcatgttattg

SEQ ID NO: 66039 - DNA, 246 bp, Zea mays
  Clone ID: LIB3076-022-Q1-K1-F4
gaattgcgtcagccacggtaccggcaaagttttatccagtacgccggatggtgcaggaggtactcatggctgccatacagggtgatcacgtgactgtacaacaggtacataccggactctgtcggtaatggctggggacctaacggagatccactggcctgcgtgtcatacaggcactgtcttgggcggacataatcggcgaggattacggtatatcttgtaatcctccagatgatcttaatagct

SEQ ID NO: 66040 - DNA, 344 bp, Zea mays
  Clone ID: LIB3076-022-Q1-K1-F5
cccacgcgtccgcggccacaacatcttctgggagaaccaggacgcgacgccccggtgggtgaagaacctgacggcggacgacctccgcgccgccgtcaacacgcgcatccagagcctcatgacccgctaccgcggcgagttcgcgcactgggacgtgaacaacgagatgctgcactacaacttctacgagcagcggctggggcccaacgcgtccgcggagttcttcagcgtcgcgcaggacgccgacccgctggccacgctcttcatgaacgagtacaacgtcatcgagacctgcgacgaccccttctccaccgtcgacacgtacgtgtccaagctcaaggacc

SEQ ID NO: 66041 - DNA, 105 bp, Zea mays
  Clone ID: LIB3076-022-Q1-K1-F6
aagagacttccggtcgcactgaatgcggtgttagcgcatgtacacgccgagggtcagggcgtgcaacatgaggcgcgctggcttgcgtgcgaagcgcaccagtca

SEQ ID NO: 66042 - DNA, 260 bp, Zea mays
  Clone ID: LIB3076-022-Q1-K1-C1
cccacgcgtgtgtggacgcttcatgtgggctgactcattctctggtaaagttacagatgtgatcgattgaggtgtgatccgcgatgctgtcggattctctcatgtacgatctctgggacaggagagaactgtggcatcttagcctcagctatcttgtacgcacgcgcataagcagctagtatgaccttgacaaatggccgtctgtacacagcatagctaggggagcatgtacaagatcaaatagcacttagagaacggca

SEQ ID NO: 66043 - DNA, 434 bp, Zea mays
  unsure at all n locations
  Clone ID: LIB3076-022-Q1-K1-C10
aacaggcagagcaccgggatctagggtttcgcacccaacacccggagtgagcggcggcgagggatcggatcgtcggcggcgatggaggacgaggtgcagagggcagcggtgagcagttggaacgagcttgactatgaggcggaagcgcgtttggtggcggaggcgagggcgtcgtgggataggaaggcaaggggggaggaggaggatgaagaagaacatgatcctgagatgaccttggactactacgcctaccaggctaaaaagtttcgcaacacctggaacatcctctatttcggctacttcggtcgcttcgaggacaccacatggatccctcctatgcgctttacagagaagccgnctgactccccggcgtacccgcgcactacactgcaggtcttttcgatcaaagttgcaaggatagaggggggtttaca

SEQ ID NO: 66044 - DNA, 275 bp, Zea mays
  Clone ID: LIB3076-022-Q1-K1-C11
atcacgtacagctcagccctccaccggtacagacggatcagtcggatcgagcaacatcccgggactgctctgtcaccaggtctttcggacgatgttctctcgccaggagtaaccagccatatccagcttaactatgagacgctaacacggctcctaacgctgctcctgccaagaagggatatgccaacacccaggccttaaaagtagccaaagctgcataatcttgatcagaccattggaccatgcacatacgaacgtacgtgacatttcaccac

SEQ ID NO: 66045 - DNA, 405 bp, Zea mays
  unsure at all n locations
  Clone ID: LIB3076-022-Q1-K1-C12
gtcgaggccgtcgcccagaccgactccttttccccgcctacggtgcccaaggccaggccaacagttttgaggtggtaatggcggaccaggctaaccaacccactgtccttcataagctaggtggccagttccacctgagctccagcttctctgaaggtgtacgggcccgtaacatctgcctttctttctcatcttatgaaaggagatttgccacgaggaactacatgacccagagcctttggggcccttcaatgtctgttagcggtggcatcaatgttccagtgatgccgactccgctttttgccaatgctccagccgagaaaggtggcaaaaacttcatgattgatttcatgatgggcggtgtttcagctgctngttcgaagactgcagctgctcccattgaac

SEQ ID NO: 66046 - DNA, 441 bp, Zea mays
  unsure at all n locations
  Clone ID: LIB3076-022-Q1-K1-C2
atttattttatatttattgattttgaatttttgccattaaatcttcttgttaaattttatataatatactattaggtgagtgcctgtgcgttacaagcctgagtttctcttggatatcattctggatggcttgcggatgttgtcattcatctcataatcgtataacacatatttgtatatataagttatcaagatattatatgttccagatgtaatgcacggacactgacctatcttatataatacactaagtgagtgcccgtgcgtcacaggcccaagtttctcttcgatgtcatctcgaacagctcgcatatgtcatcctctatctcataactatataacatatatgtacgtatataatttattgagatattatatggccttgntgcaacgcacgtgcactgacctagtaatggtttatgagcantaagtgtgttggat

SEQ ID NO: 66047 - DNA, 345 bp, Zea mays
  Clone ID: LIB3076-022-Q1-K1-C3
accacgcgtatgtccacgcatcctgaggttttgctgttatacgatctcgatctattatgggtgctatactatgcggggagtgcctgtgcgtgaacgccatggtctgtctagaatatcagacctggataggaccgcagatgtaggcatgcatttgatagtcatagtacacatgtttgtacttctaaggtgtcaagacattatactggccagatttagtacacagacgctgcactcactggtgtagtacactaagcgagggattttacgactaacggcggtgagactatgctatactgctgggatcccgtatggtatgacaagcttgatggcctcacggtatgatac

SEQ ID NO: 66048 - DNA, 262 bp, Zea mays
  Clone ID: LIB3076-022-Q1-K1-C4
atgacgcgtatatggactcattgtcaatctttgccaattaatcttcttgataaattataggtaatatagtaatatgatactgcctacgcgctacaagattcaatgtctattgtatatcatatctggacgtatagcggatgtagtcattgatcttatacacctataacacatatatgaatatagtaagttctcaagataatatatgtgccagacataatgcactgacactgacctatcttatataatacactaagagagtgcc

SEQ ID NO: 66049 - DNA, 431 bp, Zea mays
  unsure at all n locations
  Clone ID: LIB3076-022-Q1-K1-C6
cggacgcgtgggcaattggaagggcagctaataaggtaaggggcgacgaagatggctccaacgaccgccaccaaggacgacagtggctacggcgacgagcgccggcgcgagctgcaggcgttcgacgacacgaagctgggggtgaaaggcctggtggactccggcgtcaagtccatcccgtccatcttccaccacccgccggaagccctgagcgacataatttctccggcgccgactctgccgacgtcgtcgccctccggcgccgncatcccggtggtggacctctcggtgacgcggcgcgaggacctagtcgagcaggtgaagcacgctgccgggacggtgggcttcttctggctggtgaaccacggcgtggccgaagagctgatgggcggcatgctccgcggggtgcgccagttcaacgagggcccccg

SEQ ID NO: 66050 - DNA, 448 bp, Zea mays
  Clone ID: LIB3076-022-Q1-K1-C9
gttggcgcaatgggagcgcggtgaaaagaagcgggccgcgaggtgaggaggaacaaaacgactggctgtccgaacggggacgcctggttcctctcattccccttccacctctctctttctttccactactcgccctctctctcttgcgcgcgcgtgacaacatccctccacgggcgcgcggcgcgggagcacccaccgacttatcgccggtggggcggggcgggggcgatctgatgccggcgcggcggtgatggcagcgccgtccggcggtgggggcggcggtgcgggggagggctcctcctcggccgccgcagctatgacgatcggggcccacggggtggaccaagtcacagaagcgatgtggcagatgaatttaggagatgccatggaactggggccatacccagagcgtgttggtgatccagactgtagctattacatgaggact

SEQ ID NO: 66051 - DNA, 224 bp, Zea mays
  Clone ID: LIB3076-022-Q1-K1-D1
accacgcctctgtccgcgagggcagttgtgtgtaacaccaacactcgcagtagcctgcgcgattcagctatcactccacgcctgactgtactaataagctagtattgatgatcctatcgtctagcacagagacatccgttctcgagatgagtagctatatgcatattgactgggctccgagttgccattgctgcgcctaggccgactgttcagtcagcctatac

SEQ ID NO: 66052 - DNA, 219 bp, Zea mays
  Clone ID: LIB3076-022-Q1-K1-D11
ataacgcgttgcagtacgtgtctgtctgttcgttctcctcagactattacatccaagagggacttcgccatgtggtactcgttccagaaccacaatgactgcaccgcctacactaaatcgttcgagaacaaccctaaggagcctaggaccattgcgcaacaacaactcacctgtgatgaacaaaccagtatgcacagaagctatggtaatgtccaacca

SEQ ID NO: 66053 - DNA, 418 bp, Zea mays
  Clone ID: LIB3076-022-Q1-K1-D12
cccacgcgtccgcggacgcgtgggcttcaaggcggctgctagcgagctaaaaccaatattaggtgaaattgaaagtagatcttctaggaaggagtacgcacagattctttctgagtgtcacagtttgttctgtgagcagcggctgtgcttggtacgaggcatggtgcagcaacgaatcttggagtttgcaagaaaagaggccttgccttctttgacaaggtctggctgtgcctatctgatggaggcatgccagtttgagcaccagctttttgcccacttcttcccagcatctgctgctgatgtttctagtatggctcctttaatggaccctctgtgcacctacttgtatgatactctgaggcctagactgatttatgaaggaaacattgattctctttgcgaacttgttgatattctg

SEQ ID NO: 66054 - DNA, 307 bp, Zea mays
  Clone ID: LIB3076-022-Q1-K1-D2
cggacgcgtgggctcggcctgttcacaaacgcctgcgcttactctcgcccgagcccgagggatctttaggtccctattccggtcaccgatcgaccttcacaccagtctcggtctcttccgaaagcgtcgcgcgcggttgtttgagaggagaggaggaagatgagggagtgcatcttcgttcacatcgggcatgccgtcattcaagtcgttaacgcgtgctgggaactttactggcttgagcacggcatccagtctgatggtcatatgcctgtagataagaccgcgggacattactatgaatgccttt

SEQ ID NO: 66055 - DNA, 173 bp, Zea mays
  Clone ID: LIB3076-022-Q1-K1-D3
cttaagcgaaagagtattagatcttaggtgaaattgactttgatctggacattcaggatggaaaccacgtgcatgttcactggtacagatcgcttgcattgcgacaagagtgacatgaatgaagacacactgtacgctaaaagaatatacgccgagaacaccatggcgaacgg

SEQ ID NO: 66056 - DNA, 422 bp, Zea mays
  unsure at all n locations
  Clone ID: LIB3076-022-Q1-K1-D7
cccacgcgtccggcgagacgacgagaccgcgattgctagctagctagttcgggcagcgagcggggtgagacggctatggcgtgctgctccgccgtcctgcaccatccgctgggcttctcactcaccccgtgctccgcctcccgagccccaccgcgcatccagcgcgtgggcgtggcaactccctcggccgcctccgcccgccctctttctcgcgccaggatctcaccgcgctgcacctactccggtggcgccagcgctgcccctggtcctggggagctacccgcggcggcgctccgacgggtccttgagatgccgggtgcgcaccaggcgcccgnctgctacgacgcgctgagcgcacgcctcgtcgagcgcgccgagttcagggcctgcttcacgagcggtttctcaatctctgccgcacg

SEQ ID NO: 66057 - DNA, 382 bp, Zea mays
  Clone ID: LIB3076-022-Q1-K1-D8
cccacgcgtccgcccacgcgtccgcggactcgtgggttcggttgcgatgtgagctccctgcacgttcggacgaggtctatcgtgaacccactatccgagattgatgtggatcattgggttgacaggtcatacagtatatagccagtggcagaggaattcctgtttgctgtgggtaaagcttatcttctgctctcgtgttgtttcttgcttctttcgattatggagtaggtcataatgtattagctgagtatcctttccctgctaattggactgtattacgcttcattaagtctggctgattactgtttaacggggaaaagttgcacctgtgtacgattatttatttggacctggcatatttatggagaactaagccttgcgg

SEQ ID NO: 66058 - DNA, 268 bp, Zea mays
  Clone ID: LIB3076-022-Q1-K1-B9
cccacgcgtcgggaccaatgacgcagattttgccctgaaacttgtcgccgacgcaaacgtttacattaatgacacgatcggatctgtatacacggcacatgcaataagtgatggagttacaaaaatcttgaagccttgtgttacatggttccttttatagaaggagcttgactacctggttgaagctctcatatgcactgcacgcagatatgctgacatagaggttggttcatacatgtcatccgatatcaggggcattgaatccttg

SEQ ID NO: 66059 - DNA, 297 bp, Zea mays
  Clone ID: LIB3076-022-Q1-K1-D9
ttcatgctcaccgcacaaaatctgcagttatgccacgtaccctgtcgttgacggaatcgggagaattggtcttgcccacgagctctctatatgagcgaattctacaaaacgcactggcccctactgtgacgacgccaaccagaagctatgagtgatgctacacgtgtttcagatctgggtgaccaacatcaatcttaacctctggatcaccaaaccagctataaactagaaaggtacaaattcacacccatctacacacggacatcaggcacgtgtatagcatgaaaagatactaac

SEQ ID NO: 66060 - DNA, 282 bp, Zea mays
  Clone ID: LIB3076-022-Q1-K1-E1
ccgacgcgtgcgcggacgcgtgggctctgtttagatgatcacatgcagttgtaacagccggacacaaggagttcaatgacgcggatcggaccgtccgtcaaggtgaagaaccataaagctctctactaacagacatagtgcatgagcctgtcacaccagatgaaacactgtccgctgagcacacaaaaaattgctgctacccaccgaccaccagaaaatgctgctgctgttatgactgagcaacatatcacgaacttggtacttacgccagacatgaatgct

SEQ ID NO: 66061 - DNA, 101 bp, Zea mays
  Clone ID: LIB3076-055-Q1-K1-G9
cggacgcgtgggcggacgcgtgggggcaagtgatactctctcctgcccatctaagaatagagataaggtgtaatcactttttgctctatacacggaggact

SEQ ID NO: 66062 - DNA, 106 bp, Zea mays
  Clone ID: LIB3076-055-Q1-K1-H10
caactttagttctttgaattctcttccagaagtttacaaagcggtgctgttttctaggaggccacaggacacatgttctctatatgcatgtctggaagcttttatt

SEQ ID NO: 66063 - DNA, 230 bp, Zea mays
  unsure at all n locations
  Clone ID: LIB3076-055-Q1-K1-H12
cgacccacgcgtgcggttggtgagatggatctgtaggagcggaatattaagacggaaacngnngagacgcgcaaggaacaggagcgtaaggaggaggtggangcnnaagcggnggagaggaaaacccaagagccgccgcagcaaggccagggcctcagcctctcactcgccaacggcagtggcaggtctggaatgttggcgatgtcaaacatgtcagctaatccttcaca

SEQ ID NO: 66064 - DNA, 210 bp, Zea mays
  Clone ID: LIB3076-055-Q1-K1-H3
gatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctg

SEQ ID NO: 66065 - DNA, 132 bp, Zea mays
  Clone ID: LIB3076-055-Q1-K1-H5
cggacgcgtgggcttccttccgcggactagttttttctgaagattcggcgatggcggcgacgatcgaatccgtgaaggcgcgccagatctttgacagccgcggcaaccctacaatcgaggtcgacgtgtttt

SEQ ID NO: 66066 - DNA, 165 bp, Zea mays
  Clone ID: LIB3076-055-Q1-K1-H6
gacccacgcgcccggctgctctggggagatcgaagagaagctgaggcctatcgccgcacccgccgccgcatgagccatgagccatggcgctggccgctcgcctcgtctcacgctcccgtcagctacattcggttcaagcagcttttgcgaatggaggtgtcactc

SEQ ID NO: 66067 - DNA, 399 bp, Zea mays
  Clone ID: LIB3076-055-Q1-K1-H7
cggacgcgtgggtacaatctcatattgggcaagctatattgcgatcactatggtactatgcgcattcaaggtaatcgtgagtattcatgtaagcttaagttcaaggagcagtcaattatcgatcgcaaccctcaccaggtgcaaggtgttgttcaagatagaaatggtcgaactgttgctacactatttggaaaatgggatgaaagcatgcactatgtaatgggtgattgctttgggaaaggcaagggaactgaacagttatcggaagcccatttgttgtggaaaagaagcaaaccacctaagtttcccactagatacaatctcactcaatttgcaattacatcgaatgaacttacccctggattgaaggagaaactgccacctacagactcaagatta

SEQ ID NO: 66068 - DNA, 387 bp, Zea mays
  Clone ID: LIB3076-055-Q1-K1-G7
gctacgcatctgtccacgcgttctagaacctgtaaaatatatgcaaaaaagcctcagggccgatccaaaaacgcggagaggtggaactttgtttgccagcatacactaatgaaggtagaataccagaatcatgatgaatctaagccaccaaccaaatctcatttgtttcatgatgagacactaccatctttcttccgaaggttggcatggtcacctgatggatcttttctagtattgccagcaggcctttctaaacactcctccgaggtgattaatacagcttatgtaatgtccaggcgtgacctctcaaggtctgcgatacaacttcctgtggcaagtaaagctatagtggtagtacgcttctgtcctgtactattcaaaacacgt

SEQ ID NO: 66069 - DNA, 439 bp, Zea mays
  unsure at all n locations
  Clone ID: LIB3076-025-Q1-K1-D3
acggccagaatcaacgaaaccaaggatctcatttagaagagggctaatgaacttgacaaaataggagtggtaagaggcaagcttgacaaangaggatactcatcaatatctggtccacgcgtgattgaaaaaacgtttagtgacatgagcatcagtggttctggatttggtagtggttctggattaggtggactgagcactgacatggactcatttgccagcaagcccaaaggtcgtccatctacagcagctactgcacctggtaaaggttttggtatgaaattaggcaagacacagaagacaaatcaattccttgagtctttgaaagctgaaggagaagtcattttggaggatgtacaaccaagtgcagtttctacaagatcatctgctcttccaccaagtgaccctgtcacagtgaacatagaagagaagctcaatg

SEQ ID NO: 66070 - DNA, 366 bp, Zea mays
  unsure at all n locations
  Clone ID: LIB3076-025-Q1-K1-D4
gaaaaccgggcgggcggggcgtgcgggcgggcgtccgcccactcttccgccttctctttctgtggcggcctgcactgggaggaagaaatcttctcattcgccgtgcccanncttccccccngttcatcctcctgggccgggatgtctgtgctcgtcacgggcgccgctggcttcgtgggcacccactgctccctctccctccgcatgcgcggcgactgcgtggtctgcgtctacaacttcaacgcctactacgacccgtcgctgaagaaggcgcgcagggcgctgttcgccttccacggtgtgttcgtcgttgagggcgacatcaacgacggtcggctcctggccaatcttttcgatgtcttgccc

SEQ ID NO: 66071 - DNA, 262 bp, Zea mays
  unsure at all n locations
  Clone ID: LIB3076-025-Q1-K1-E3
catttaattaaatatacacctctatccaaacgtanaacaaangaagaattttaaaaacttatcccccaacttcaataaaatttcctatatattaaaaacctttcacaattctctcttctaacttaaaaatatttacttccttttaaaatatttcacttaaaactcttcaactcattccataaatacatcctccctaattacacaaaaattcatattccttcaatcaaaacctattaattcactctctttacataaaaattcc

SEQ ID NO: 66072 - DNA, 257 bp, Zea mays
  unsure at all n locations
  Clone ID: LIB3076-025-Q1-K1-E7
taannncacatncaccnnacatttaatactttataataancacaanccattaaagcgtatttattataaaaaactatcccaccccccaanaacannatcttccattttaatttgttctactattcaccttcgaatacatttctattatattattccccttacatattttttttcattcctacacatactaccatttttcctcactcctacatttacttaaactataattactattctctttttcccaatttatacct

SEQ ID NO: 66073 - DNA, 300 bp, Zea mays
  Clone ID: LIB3076-025-Q1-K1-E9
caccctattaaagtaaattccgtccgtcctaccagtgtggccgaaactaattgttccatgtcctccaaaaagaaaggatctcgttccaataccataccctttaatgaaggtgcttttccccccaatttcctatttatagctctaatactatagctggaatgacctatatgaccggaaccacctaaacatctatatgacccgaacggaacctcaacctatatgtatatgaccggaacctacacaacctactggacttgctttgctacttgagcctaagctatatgatctgaaccaacccta

SEQ ID NO: 66074 - DNA, 145 bp, Zea mays
  Clone ID: LIB3076-025-Q1-K1-F1
ataacccactacctcaaaaatcttctcaacttcatttaactccaatctcccatcttcacccttaaaaaaaaccttaaaaatacaaacattgattttaccaacactcaaaactactttaaatccctccaaacccccaaccaaataa

SEQ ID NO: 66075 - DNA, 391 bp, Zea mays
  Clone ID: LIB3076-025-Q1-K1-F12
gggacggatgagtctactcgttgacattcgacagatcccaaatcactcctgtggcggtagccgtggcatccccgaggagttcggctccttgatcatggaccatctgctccggagcatctggaccgcataggatacccaggccaaggcctccgcctctatcgcaagagcgagcgcggggatgccccccacgccaatgcagctgcagggatcgtctctcacactgccccgtatgctcagcaccaagacggtcgacgaggcgtggagaaatctcgtgcgcgacgaaccgccacatggggcggaccgcagctgacaccatccgcaccaccgccagtcaacgctctgggagatgactctggaggagttcttggtcagagcttgcgcggtcaaagag

SEQ ID NO: 66076 - DNA, 184 bp, Zea mays
  Clone ID: LIB3076-025-Q1-K1-F2
gccttccttccccacttcgttttaccttatgggggacataaaccttctgggacagtggtagattttttttccctctccttattttaaaaccttttattatttgggagtgtataataggagcttatgtcacctctgcggcttcccccgcggctgatttggtttaaagggttagaccaggaccctt

SEQ ID NO: 66077 - DNA, 414 bp, Zea mays
  unsure at all n locations
  Clone ID: LIB3076-025-Q1-K1-F5
tgaaaggggagagagagagagagaanaaagtgttganagagagagagagagaggagtgggagagcctctagaggcttccgtgtatggaccgtatactcagcgactgcgaaggagggataaggggatggccgggatcggaccgatcaggcatgactgggagccggtcgttgtgcggaagaaggcacccaccgccgccgccaagaaggatgagaaggccgtcaacgccgcgcgccgtgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctgaagaagaatctcatgcaaccagagagtgctcagattggaga

SEQ ID NO: 66078 - DNA, 157 bp, Zea mays
  Clone ID: LIB3076-025-Q1-K1-F7
gctgctcaactgcagggagctcgagtcgcgcgtcggcaccgtgagagaaagccttaaaaatgcaaagagggattttaccaagactgaagacgacttgaaatctctgcagagcgtggggcaaataattggagaggttctccgacctcttgataatgaa

SEQ ID NO: 66079 - DNA, 338 bp, Zea mays
  unsure at all n locations
  Clone ID: LIB3076-025-Q1-K1-F8
cccacccttcctcccacccttccgaagcctttataccatggcggaccagctcactgacggggaagtcgccgagttcaaggaggccttcancctcttcgataaggacggcgacggttgcatcacaaccaaggagcttggaactgtcatgcgttcactgggtcagaacccaacggaggctgaactccaggacatgatcaatgaggtggatgccgacggcaatggcacgatcgacttccccgagttcctcaacctcatggcccgcaagatgaaggacaccgactccgaggaggagctcaaggaggcgttcagggtgttcgacaaggaccagaacggcttca

SEQ ID NO: 66080 - DNA, 367 bp, Zea mays
  Clone ID: LIB3076-025-Q1-K1-F9
ccaaggtttcttcgaacaaccaacaaggacaaccggcttaggcccgtgcttggcgctaacaaacttcattctcacggtggtgggggtgggccgcggcggtgatgctgctgcggaaagacgtcaagcagtcggccaccgtcttccgccgcaacgtgcgccacatccgcaactggctcgaggaggagtccgccgccgccgccaaatctactgaacagtcttcagtgaaggagttggagtcccaagctaccaagaaagacgctgtgcccaaggacgacaagcattagatgatcttacaccctgtttcttgtaatgcgttggcagtttgaggtccaagattttgaattggtcctttaaaaaaatgtatgtg

SEQ ID NO: 66081 - DNA, 389 bp, Zea mays
  unsure at all n locations
  Clone ID: LIB3076-025-Q1-K1-G10
actcatttctttctacaatcccaaattctttttggccatagccacnccatccccgaagattttttttaaattaacatccaccccctcctccnncncatctnaaccccatattaaacccataccaatacctccacctctatcacaatatctacctcctccattccccccactccaatccatcatcaacaatcatctctcacacttccccacattctcaccacctaaactntctacaaatcattccaaaatctcttncactactaaccctctcatataacttacttcaacttacaccatccttacacaccacactcaactctcttctatattactctataataaatcttantcaaaacttactctatcaaaaaaaaacccactccttcttc

SEQ ID NO: 66082 - DNA, 333 bp, Zea mays
  Clone ID: LIB3076-025-Q1-K1-G2
gctgctcatgtgggtcgacacggggctcgttccggaggccgtggccagagggtttggagcaagctatcgacggaagccgtggctcgcatgggggccgatgcgcgcctcgcgcctggcggcctggaacataagctgcacgtcgtggagcgcagggtccgccagcttgttggcggtgaggggatcgccaattgcagctcgcgagactccgtctggcgattccaccagaatgatcagcaagtgttccactggcgctgcacggagtacaaatacgcggcggaggaggtcagcgtctgggggagccctctccgcacctccagccttctccaagagcac

SEQ ID NO: 66083 - DNA, 233 bp, Zea mays
  unsure at all n locations
  Clone ID: LIB3076-025-Q1-K1-G4
tttgttttcacaaactgtactattcaagagtgtcactcacggcaacaagatggcttgcacaagaacacatattccncatgtacaaaacattaatgaaggactacctctcttcctctccaattatgatgatcgaagattgtatggtatttacgaagcttcatggaatggaaagtcctgtcctgaatcaaattcatggtcacaagttatctaggtcaatacatgctatcctgctc

SEQ ID NO: 66084 - DNA, 323 bp, Zea mays
  Clone ID: LIB3076-025-Q1-K1-G5
gcaactttttggttcattggtcgctgcaagtattgcatggcttggaccatgtatgtatcattgtctttagaatttgtattgattgaaatcatgctttggcttaattacgtcaaacatgggcaggacaagctcctaataccatggctgatgattaaatttcttcacttgttacttcacctttacaacctgtccaatctcaagaatccaaacctttactctttattatgtttgaaagtttttgtcctatttttctatcactcctccatatattcattttttcgtttcttcttttaattctttttatttattctttttttattttt

SEQ ID NO: 66085 - DNA, 440 bp, Zea mays
  Clone ID: LIB3076-025-Q1-K1-G9
cgcttccgcacacgcttcgggagccccagagatatagagagagggcggcattcacagccaggcagtcggggaggcacttccatggagtactactacgcctaccagcacagcagcagcagcggcagcggcttgagctcaaaggaaaaaaggccgccgctgaagcgggggcagctcaagcggcaaatcgtgaggaccatcagcagcctcgtggtgccgaggcacgccgccgtcgctggcgctgctgctgccgctgggtcgagggagacggcagatcgcggcagcggattcggcggaggacggagctacaactgatgatgaatctctcagaggaggcgtgatcagagatacgattcgcagcgtcaggtttgtgtgtacgtactacttgccgatgccgatgcaaaagcagcacgtagcgcatctgttgagcgcgtgttcttctt

SEQ ID NO: 66086 - DNA, 435 bp, Zea mays
  Clone ID: LIB3076-025-Q1-K1-D2
cttccaattaagcaaattccttttcctgcatggtctgtgctccaccacttcttcacctgcggtcaccgctaatgcctaagactggttgcttttcttaaatcaagaaaaggttttgtcaagatagctatacagtctggatgtcctttagtcccagttttctgctttgggcagagctatgcatacaagtggtggaggcctggtggtaaattgtttatcaagatcgctagagcagttaaatttactcctattatcttctgggatagatttggcacaccattccccttcccaaaacccatgcatgtggtcgtgggtaaaccaattgaagtcaataagattccccatcctacaattgacgagattaatgaagtccatggacagttcatcattgccatgcgggacctctttgagagctgtatcatcagtgtctgaatcacc

SEQ ID NO: 66087 - DNA, 417 bp, Zea mays
  Clone ID: LIB3076-025-Q1-K1-H11
tccccacgcgtccgcacgctccggacatctgcttttccaagcaaccgtgtgaaggagaaatgggccaagaacctttacattgcttcaatatgctatggccggacagtgtcatgaggcttgctcggctgcatccctagttgggaagagcatgttctgatgagtatatattgggaaaaaagcagcaatctttgttgctgctctctattaatctctgtatgtgtaggtaacccgttcaagatgaagcaccttacagtggccagagtaggagctcaagaaagaaccgagaggaaggtggaaagcaatcggccaataagcagaccaggagtatgtgatctggctagtagcgggtacaggcgcttatggcgtcaaatgttttgtatcacagtatcaacatgttttgcttttgcttctctcctg

SEQ ID NO: 66088 - DNA, 351 bp, Zea mays
  Clone ID: LIB3076-025-Q1-K1-A10
aacccttgaaggccatgaactaggacccgcccttaaaaaaccgttccagcgcgggcgagttcccctacaccctgctcttcccaaacacctccaacaagggcaataacaccggcgtcaccgccaagggcatccccaacagcatttccatctgattcaatcgagtcctggccagcgtttcacccaaaaaagcagagctagcggtgattcccgtatgtaatccgtttcattttttacatgaatgagaagcgtggtaataaaaaggtttgtagttgcgtgcgcgccgtgtattccttggtgtactggtgctggcggtaaccacttattaccagggatcctcgtaatttttcctgt

SEQ ID NO: 66089 - DNA, 330 bp, Zea mays
  unsure at all n locations
  Clone ID: LIB3076-025-Q1-K1-A2
accctgcacataaatggggtggtctcggagaggtccttggtggaaatgagctgattgagaggcagatcgatataaagttcataaaaaatgtggacaagggggccatttgcacaattgaacttgatgttcaaaaggttcagcaatttgctaatgccattgaaaactcatattggtttgagcttttcatagatgatctgccattgtggggttttgttggggagactgacaaaaacaatgagaaaaagcactacctttacactcacaagaacattgttgttaaatacaatggtaacaggataattcatgtgaatctaacacanaagtcaccta

SEQ ID NO: 66090 - DNA, 345 bp, Zea mays
  unsure at all n locations
  Clone ID: LIB3076-025-Q1-K1-A3
tcattttaacacctattctttataacttgaaagaaatgtgnactcaaagcaatttctattgcccagatgtctcgcgtgataaacagcanctcaaaataaggtatgaaacggctatccttcgaggaaatgacaaaaatgctaccgctcgagagaagcacgtatgctcaaatgtagcaaaggaactaagagagcgaatcaagccatactttttgcggcgcctgaaaagtgaagttgtctttgatactggtgcatcagaagaaaaaacattatccaagaaaaatgaacttattgtctggctgaagttaacaccatgccagaggaaactatatgaagcttttctaaaat

SEQ ID NO: 66091 - DNA, 405 bp, Zea mays
  Clone ID: LIB3076-025-Q1-K1-A4
cccacccttccggcttcatgttaccaaaattgattgagaattcagccttttctaatggaagggtggtttcttactgctgatctggtggcaatttcctgttaaacttctgcttactagcatatgtttcaataatctttatgcatggtcaaatgtttcaatcttatgtcctgatataatcaagtgcatgataacccatgtcaagttcatcatgaaatatgggaccattgagttttgaatttatcttatgtaattgttatccttcatatcagaaataatggtttttttgtcactgcctttgagttttgaacatttaagacacttgttggctatttgcttgagtacaccagatttcttaactgtcgaagcttcttgcttcagcacaaaagatttcttaactatcgaaac

SEQ ID NO: 66092 - DNA, 440 bp, Zea mays
  Clone ID: LIB3076-025-Q1-K1-A5
cggccccgtggggtgaaaaaagaaggaaggcagaattggaccgaccccaaaaaccattggggcgtgcggcaaaagctctggttgaaaaaaatgaccgtgactggcaggctcagcaggagcaagaagagcgacatagaatgggtgaatcacttgattttgagataaagaggtgggctgctggcaaagaaggcaacctacgggccttgctaacaacgttgcaatatattctttggcctgaatgtggctggcgacctgtatcattgactgatctgattacagcagcatctgtcaagaaagaatacaggaaagcaacattgtgtatccatcctgataaggtgcagcagaagggtgcaaatcttcaacagaaatacattgcagaaaaggtatttgaccttctgaaggaagcctggaaaaaattcaactcagaagaactcttctaa

SEQ ID NO: 66093 - DNA, 198 bp, Zea mays
  Clone ID: LIB3076-025-Q1-K1-A6
ggtgtcgggtgtggaacttatcctctcattcccttgctttgaagggtggggggctagggcgggccgcactgctcaacgagcgggcgccgggcggacaactaatcggcgaggcagtcactcgggagagatgtcgggcggcaggaggagggggcttgtgtggagcctccccgtggcgaggtcggatgcgctcggaaaact

SEQ ID NO: 66094 - DNA, 406 bp, Zea mays
  Clone ID: LIB3076-025-Q1-K1-B1
cgtccgaccactattacccgttccccgggtccacctacctggcgccggtgctcggcctgctggtgggggacgccgccaatctttccgccgcggggctgcaggagctcaacgtcatcgcgtcgggcggcccaatttcggtgcgcttcggcggtaatgtcagggcggttccggcaggcagtgcagcgccaaggtgcgtggtgttcgatttggatggcgtgccgcagttccgggacctggaggcaaccgatatgtgctcgacgtatcgccaagggcatgtctcgatagtggtgaactccagtgggattgctcctgctccacctccacctggcgcgatagccccgtcgattccgaccactggaggaaataccaagggaagctcaaaggcgtggaagattgccgtcagtgt

SEQ ID NO: 66095 - DNA, 437 bp, Zea mays
  Clone ID: LIB3076-025-Q1-K1-B10
cttgtctctgctggcagaaccccatttacttctgggattgggcttgaaactcttggcggtgagacagataaagctggcaggatccttgttgataagcgcttcatgaccaatgtgaagggagtctatgcaattggggatgcgatccctggtcccatgcttgcccataaagctgaagaggatggtgtcgcttgcgtagagttcattgctggaaaggaaggccatgttgactatgacacagttcctggtgtggtttatacgcatccagaagttgcatctgttggcaagactgaggagcaggtgacggctctaggaattccctatcgtgtgggcaagtttccacttttggctaacagtcgtgcgaaggccattgatgatgctgaaggggtagttaaggtgatcgcggagaaggaaaccgataagattctaggtgtgcacat

SEQ ID NO: 66096 - DNA, 358 bp, Zea mays
  Clone ID: LIB3076-025-Q1-K1-B11
cggactcctgggttcccttatatgatagcttttagggaaagggggttgtttttctggggggagtatagttgaagttcagtgacgtcaaaacttatcgaaggtcgccccacattatgtctgctaagtgcaagcttcacaaatcatacattcatactgttggagtgacccaatatatcctggtagaaagcaactgttgagcacatagatcttgtatcttagacctcttgcggagattttttttttttgcattgccacaaattagcgagcgaataactatagtgattagagattgtgaagtagatgcattgtgcgttagttgaaaagccacaatagtcaagcattgcacttactgtactag

SEQ ID NO: 66097 - DNA, 212 bp, Zea mays
  Clone ID: LIB3076-025-Q1-K1-B2
gcccaatgcgaataatgcgcccaatgagaagaaggcgcctaaggagaagaagctttccgcggcgaagaagccggcggcgcaccctccctacgctgagatgattgtagaggcgatcgctgccctcaaggagaagaaggggtcgagctcggtggccatcagcaagtacgtcgaggggaagcatggcggcaagctccccaccaacttccgcaagc

SEQ ID NO: 66098 - DNA, 429 bp, Zea mays
  Clone ID: LIB3076-025-Q1-K1-B3
ggggaacctgaagttgtcatccgaggaaagaagggcactgggggcattactatcaaaaagacgggcatgtccttgattattggtgtctacgacgagccaatgactccagggcaatgcaacatggtggtggagaggctcggcgattacctgatcgagcagggcttctaaaagttcgtcatgttctgttttggtcatttgggcaccaaagtttgcgcctcatttggttctgtaatccgtgagctcgtgcatgtacttggcgtattgcatgcagtgaataatttagcttgggtttgtttgttgggggcagtgttggggacggatttggattggggtttatgcttggcatcgcgtcgtatcgaaactcagctgctgtttcgctgagtaatgtacatttccctggtaatggtacttgtggactctgatgctttt

SEQ ID NO: 66099 - DNA, 323 bp, Zea mays
  Clone ID: LIB3076-025-Q1-K1-B9
acgggggttttgtcttcacaacaatgcagcagtttctgcgttagctgcaaaaagagcagggggcaggaaagtcctcatagtgtgactgggatgtgcaccatggaaatggcacacaagagatattcgacggggacaaaacagtcttgtacatatcattacatcgtcatgaggatggaaacttttaccctggaactggagctgctcatgaggtgggagttcttgatggtcaaggattctcagttaatataccttggagccgtggtggtgttggagatgatgactacatctttgcttttcagactgtggtgcttccaatagcttca

SEQ ID NO: 66100 - DNA, 391 bp, Zea mays
  Clone ID: LIB3076-025-Q1-K1-C11
tgcagtctccgagtctcgctcgcaccccgttccctgcagcctgtgctctgggttggaagaaggtgagctgcgagggagcgcggatggggctaggagatggaggcagattcggcgaggaagagacttgcattgctggccctgcttctcctggcggcgcccgtccgcccggcctcggcggctccggtggaggatggcctgctcagcaatggtgactttgagacagcaccaagtggtggttttgtaaaatctgcgtctgttgctgagggtgcatcgtcaatccctggttggacgatcaacggcacggttgaactcatttcagcatgccaaacaccaggtggcatgatccttgatgtttcacaagggggaccatgcagtaaagctagggaaatga

SEQ ID NO: 66101 - DNA, 381 bp, Zea mays
  Clone ID: LIB3076-025-Q1-K1-C6
tgcagtctccgagtctctctcgcaccctttctccctgcagcctgtgctctgggttggaagaaggtgatctgcgagggagcgcggatgtttcaaggagatggaggcagattcagcgaggaagacacttgcattgctggccctgcttctcctggcggcgcccgtccgtccagcctccgcggctccagtggacgatgggcttctcaacaattattactctcatacagcaccacagtggtggttttgtaaaatctgcgtctgttgctgagggtgcatcgtcaatccctggttggacgatcaacggcacggttgaactcatttcagcatgccaacaccaaggtggcatgatccttattgttccacatggggaccatgcattaaggc

SEQ ID NO: 66102 - DNA, 389 bp, Zea mays
  unsure at all n locations
  Clone ID: LIB3076-025-Q1-K1-C8
tggcacaagggggtggtggggatagttatgcatcantgaaaaagtaccttnnccgtatcctttctgaggtggtggatgcttccattcaaaaacttgttgattcacgcagtggtctaagtgtgtcccatgcaatgcacgtcgctgctaacatgtctgtgatggagcgggcatgtgagttcttcacacgccatgctgcacaactgtgtggtgtgccactgcgtgctgcggaccgtggtcatgtggactttccacttcgcaggtcacgtgatgcttcagaggcgctcctgctgcggctcctatgtgctaaggttgatgagttcatgcggcaatctgatggtgttaactggatggctgatgacgctccttctggcggcaatgagtatgccaac

SEQ ID NO: 66103 - DNA, 344 bp, Zea mays
  unsure at all n locations
  Clone ID: LIB3076-025-Q1-K1-D11
aaaaaaaaaaaaaaatttatattaactaattctaaatcacaaaacaaaagaaatttttaaaacattttttccctccccatacctnccacnccctttatattatatactctcaccttcacactactacctctccatattttttcaccaaattcacttaaaattccatttcctttacccaactttaaacacctttcaaccctttaaaacccctctcctttccccaatattaactaatttcacctcaaaccacccttccttcccaacaattttacccccctaaatccccaactctttcaccccttttaaaacttttattaatctcaataaccaatttctaccccccc

SEQ ID NO: 66104 - DNA, 350 bp, Zea mays
  Clone ID: LIB3076-025-Q1-K1-A1
tattgtggaaaacctcactgttggggagcgtaacctgtggtcgggcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacga

SEQ ID NO: 66105 - DNA, 309 bp, Zea mays
  Clone ID: LIB3076-024-Q1-K1-G1
acgcggacgcgtgggcggacgcgtgggtagttcctaccttcgccccccccccctcactccccctgcgtcgattcattctgcggtcagcttgacccagttcaatatcgccggcgagggaagcaacatcagaagctccggcgagaacccccaccttcggctatcgcctggggataaaatggggtcagtaggggcggtgacctatggggagcaaaagggatcccatatggagagatgaatcaatcaatttattctttcgccgtagtccctgctaaagcccccactactaaccctaagatcaaactggctttt

SEQ ID NO: 66106 - DNA, 97 bp, Zea mays
  Clone ID: LIB3076-024-Q1-K1-G10
gaaatcgcgaggggaagcgtgacacctgactagctgagcaggcaggcggtagtggccgagggaaagcgtcctcgatctcgtcgtatcgtagctgccg

SEQ ID NO: 66107 - DNA, 419 bp, Zea mays
  Clone ID: LIB3076-024-Q1-K1-G11
cccacgcgtacgcccacgcgtgcgcccacgcttccgctggacagccgcatagcaatggttggtcctagtggcattggcaagtccactatactgaaactaatttctggggatctgcagccaacttctggaacagtatttcgctctcccaaggttcgcatggctgtattcaatcagcatcatgttgatggccttgatttgacggtgaatccccttttgtacatgatgaagtgctatccgggtgtgccggagcagaagttgaaggcacatctgggttcgattggtggttcgggaagccttggccttcaatctatgtacactttatcaagtggtcagaagagtagggttgcattcgcgaaaataaccttcaagaagccgcacatcattcttcttgacgagccttctaaccatcttgatctgga

SEQ ID NO: 66108 - DNA, 332 bp, Zea mays
  Clone ID: LIB3076-024-Q1-K1-G12
aatagacccacgcgtgcgcggacgcgtagggtctttgcttccctcttacaaagggttatcagttctagaacttgatgcgggaataggacgctttactggagatctggcaaaagaagctgggcacgttctggctctagacttcattgaaagtgtgattaacaagaaccaaagcataaatgggcatcacaagaacataaccttcaggtgtgccgatgtgacatctaacgacttgaagattgaagataacttctgtgatctgatattttcaaactggctattaatgtatctttcagatgaagaggtccaaaagcttgtggtgaaaatggttaaat

SEQ ID NO: 66109 - DNA, 376 bp, Zea mays
  Clone ID: LIB3076-024-Q1-K1-G2
cccaaatgggagccacgatgaggcttgggtcgaggaggacctatttccatgtcagtggctgcaaatgtgcgaagctgtacggcaacgccagctctgtagatgaaagacatcgccacagatacgaggtgaaccctgacatggtcccagactttgagaaggccgggcttcagttcgtgggcaaagatgagagtgggaaacgcatggggatcgttgagcttccctctcacaagttcttcatcggtgcacagttccatcctgaattcaagtcgagaccagggaagccatctccgcttttcttagggctgatagccgcggcgtctgggcagctagaaccattgcttcagcgcagcaacccgacaacgaaagcatgttcgat

SEQ ID NO: 66110 - DNA, 149 bp, Zea mays
  Clone ID: LIB3076-024-Q1-K1-G4
acaccacacctactatgaggctaggatctagttttacctatatccatgtcagtagctggcaaagcttctatatcattactgcaacgccatctctatatatgaaatacatctccacacatactaagtgaacccttacataatcccacact

SEQ ID NO: 66111 - DNA, 456 bp, Zea mays
  Clone ID: LIB3076-024-Q1-K1-G5
cccacgcgtccgatttggttgcacaaacagtaccattcaagagtgtcactcacggcagctgtttggcttgccaagaacacatatttcgtatgtacaaaacattaaggaaggactacctctcttcctcttcaattatgatgatcgaagattgtatggtatttacgaagcttcagggaatggaaagttctgtcctgaatcaaatgcatggtcacaagatagcaagggcaaaacaagctatcctgctcaggttgcaatgcgggtaaaggtgtggtgttttccgctagcagagaatcagttcagaaatgcaattatagccaattactaccagaaaattcccggtgtccctggccagaagcttcattttttcaagtttgaattggatcatgctcaaacacgtgttttgatggatattgggttttactccttctccttctcccaacagtttctggacgcccc

SEQ ID NO: 66112 - DNA, 444 bp, Zea mays
  Clone ID: LIB3076-024-Q1-K1-G6
cccacgcgtccgaccacgcgtccggagagacgcacatctatctgtcaagcgacgccgcgggctcgatcagagtcggaggcgaacacccccatggcggcggctggcggcggcgcaagagggaaggtatccttcaagatcatcctcaccttcgaccccaagctacctttcaaagtgttcagcgtgcccgaggcggcgccctttaccgcggtgctcaagtacgccgcggaggagttcaaggtcccgtcccagaccagcgccatcatcaccaacgatggaattggcatcaacccccagcaaagtgcaagcaacgtgtttctgaaacatggttcggagctgcgtctgatccctcgcgatagggttggagctgtagtcatgtcttccagttagaggatatatacagtccaatgcataatttggagcaaaactgagagaaataagcttgat

SEQ ID NO: 66113 - DNA, 451 bp, Zea mays
  unsure at all n locations
  Clone ID: LIB3076-024-Q1-K1-G7
cccacgcgtccgaccacgcgtccggagagacgcacatctatctgtcaagcgacgccgcggcgtcgatcagagtcggaggcgaacacccccatggcggcggctggcggcggcacaagagggaaggtatccttcaagatcatactgacctccgaccccaagctccctttcaaagtgttcagcgtgcccgaggcggcgccctttaccgtggtgctcaagtacgccgcggaggagttcaaggtcccgccccagaccagcgccatcatcaccaacgatggaattggcatcaacccccagcaaagtgcaggcaacgtgtttctgaaacatggttcggagctgcgtctgatccctcgcgatagggttggagctgtagtcatgtcttccggttagaggatatatacagtccaatgcatnatagttgagcaaaacttgagagaaataaagctttgatgtt

SEQ ID NO: 66114 - DNA, 436 bp, Zea mays
  Clone ID: LIB3076-024-Q1-K1-H11
cggacgcgtgggtgggagttcatttctgattatacaagacactgatcctgatgcggtatctaatatgccacgtggcagaaaagcgtaaggggagctcgggtccacaaatgaagggagggaaaacaggaacacctcaaagtgatgttaagaatcctcccaagaagagagggcgtccaaaaggcatgcacgacagcaataatatgccaaatgctgatagctctgtgactccagccagactgaagggaaaaagtattgagaaggatactcaagtgacacctaagactggcaataactccaaaaaggaaggtccagggccttttgatctactactggaaagctcagaatgcttgtgtcaaagcaagcagcaaggatgaacctgatagcaccgacaacttaaaagatgatgcttgcagtgaagacaagaattcaaaagatg

SEQ ID NO: 66115 - DNA, 345 bp, Zea mays
  Clone ID: LIB3076-024-Q1-K1-H2
gtccggccacgcgtccgggctttgctagatctaacttcatattaggatatgctgctgctgctgcatcaggtttgaattttactaatccttttctcaagcaattggatgaatgtgacacttatggtgaatcagtagaaaacactaatctggaagctaatggtccatgggaaaggaagagacagaagaagctcaaggctgtggttagagaggcacgggaaaagttttctaaccctagcagtgatgctttaaccatcgctcgtgccctgcagttctttgagttgtcagaaaacccagtggaattctgcagagccaattcacttcatcttaaaaccatggaagagatgt

SEQ ID NO: 66116 - DNA, 282 bp, Zea mays
  unsure at all n locations
  Clone ID: LIB3076-024-Q1-K1-H4
cggacgcgtgggcgccgaggtacggcgtgacgtcggtctgcgggtcattttcacagatatactggaacatcaacctgattgcccgcctgaggttgttgagaagcttgtggcaatgcgggaagacattccaagaaaggaagccaaggagattgtacaagaatgcaaagagatatacgagaactcgctcgtggatggcaaccctcgcaagtcaggttttgtgttcggcaaattgaagtgcttgacagcatagaaaggcatatggaggaagcttgngcagtaagt

SEQ ID NO: 66117 - DNA, 402 bp, Zea mays
  Clone ID: LIB3076-024-Q1-K1-H5
aatatgcccaaaccctagctccctatctcgatgtctaaccctcacgtcttcttcggcgtgagcgtcatcagctccccggcggaccggatcgtgatctagctttcctccaacgaagtgcccatgaccgcggataacttaactgcgctatgcactgccgagaaatgctttggcaagtccacaaagtcgcttcactacaaaggctgcaccttccaccggattatcacagagttcatgtgccatggctgtaactttacccacagcaacaggaccagctgcgagtgcatgtacggtgataagttccgctacgagaagcttttgcgcaagcacaccatgcccggtgtgatctgcatggccaacgccggtgccaacaccaacggctgccacatcttcatctgcactgac

SEQ ID NO: 66118 - DNA, 306 bp, Zea mays
  Clone ID: LIB3076-024-Q1-K1-H6
ccagacgtatcggccacgccgtccgagtctgcgctagaatctacacttcatatgtaggatatgcctgctggctgatagagatgggtgggcatcggtgacccgcccgtcccggagttcatcaacggccaccacttcttcggggtgttcgacggccacggctgctcacacgtggcgacgtcgtgcggggagcggatgcaccagattgtggccgaggaggcgacagctgccgcaggctcgtcggtttcggacgaggcggcgcggtggaggggtgtcatggagaagagctacgccaggaatgacgccgag

SEQ ID NO: 66119 - DNA, 438 bp, Zea mays
  unsure at all n locations
  Clone ID: LIB3076-024-Q1-K1-H7
gcggcggattggcgtctacctccatggggactttgctctgccgacgtcgacaagacgtggaggacgctgtgaccgcccgtccggagttcatcaacgggcaccacttcttccgcgtgttcgacggacaccgctgctcacacgtgtcgacatagttcggagagcggatgcaccaaattgtggccgaggaggcaacagctgccgcatgctcgtcggtatcggacgacgcgtcgcggagcaggactgtcatggacaagagctgcgcgaggatggacgcaagatcctncgnatnctcaaggcccatgggttggcgccggagatcccggaggatctctactttctcattaagaaagcggtggcgattatgaagcatttggagaggaacatgatggacaaggactccaaattcagaacctttattcttgttgagagcaggatcca

SEQ ID NO: 66120 - DNA, 227 bp, Zea mays
  Clone ID: LIB3076-024-Q1-K1-H8
tctacgcctgggcattgtcgcctacctccatggggtttgtatgtctgcctacgacttctagagatgggcgacgctttgaccgtccgtccggagttcatcaacggccaccacttcttccgcgtgctcgacggccaccgctgctcacacgtctcgacatcgttcccagagcggatgcaccagattgtggccgaggaggcgacagctgccgcatgctcgtcggtttcgga

SEQ ID NO: 66121 - DNA, 449 bp, Zea mays
  Clone ID: LIB3076-024-Q1-K1-F7
ctctggaaagcgaaagggcctctagactagtggttaaggcttcggagtagcaccacgcgagtgccgggcttgattcccctcgagggcggattttcgggcttggttaaaaaatctcctcgatgtgcctcattcgctctcgggttacgatgtcctgtgcgccattgtttcggttgacgccggtccgttagtaatttgaggccagggttcggggattttctcggctgggactattgtttcggtctcttcttaatgttataccgggagggtggtcattccctcggtcgagttattattctctggaaaaggtgcaacactttaaccatgtggtttgcttcatgtggatgtcctggtttgggtaggtgtgacttgtgagtagtaaaacttttatctgggtgttggaattgtagccatttggtacattatgaaaatatttcttgccttctagacct

SEQ ID NO: 66122 - DNA, 439 bp, Zea mays
  unsure at all n locations
  Clone ID: LIB3076-055-Q1-K1-E4
cagcgccgtgccgcccacgccccgtccgcccacgcccgtccggcttttggttcttcatnngtcgttccactggcccaccgagacaaagcgcgccaatctcaaagggctgccatgnnattggtgttgctgcgggtnggacttgttattcctcctgatgatncttagtnagctgtatgcanggccacannccatccacctgcttttaaaagatgccactgtaagcccaagccagtgagcaatggtcccacccannagctggtgatccttcatatgaacccatggctcttcatgtctnttgatgaatataatgaggatganctgagaacttgagttgagaaataccatcattggataccggggcatcaaagtacaagtttattaaatgtgttctaaaagaatttgcaaaccagtggcaataaaaaaagctgtatgcccacta

SEQ ID NO: 66123 - DNA, 200 bp, Zea mays
  unsure at all n locations
  Clone ID: LIB3076-055-Q1-K1-E5
agactgcaaaattgtacaaggagaattgtataaatttgctttatcaggatccactcntancatgcgattgcaaaatttaaaccttaaagacttcatcttttaaagttcttaaatactactcacttaatatttctactgtattttaatcatcaatattacctctgaaaattgtatgcaatttacctgtagttaactacata

SEQ ID NO: 66124 - DNA, 231 bp, Zea mays
  Clone ID: LIB3076-055-Q1-K1-E6
tataatacatatgaatgattataccaagctaaaatgacaaataagtagaaataactatagagatggttattaatatgagtatgacaatctaaaactgaactgttgttatacctatcctttcagaattcagggccggcacaatgtgctaccggctggtcactgtggctccgcagggagggatgatggagggaatcccttgtggggtttgccccaagattcatgaagtctctc

SEQ ID NO: 66125 - DNA, 378 bp, Zea mays
  Clone ID: LIB3076-055-Q1-K1-E9
cccacgcgtccgcccacgcgtccgagcagctgcaaggaaatgctaaggttctagaggaggaaaggaataatatttccagtctccaggaaaaaaatgacgaaatcgttgctcgtttgaatttactggatcgtgaaattataaatgatgactcaagattcacatctgaagctgcacaaatgaaagatgagttggagaaaaagaagaatagtttgatttctgctgaaaagcaggcagatgattttcttaagaaatcggagaagaggctccaagatgtaacacttaaagttgaagaagaaactcaggcagctgctaaggagctgctggagcttcttgattccatggctgaacataaagagttcatggaaacaacaattgctc

SEQ ID NO: 66126 - DNA, 245 bp, Zea mays
  Clone ID: LIB3076-055-Q1-K1-F10
cggacgcgtgggcggacgcgtgggcggacgcgtgggtgccaccagcatgcacaagggagatggtggttttaggatccttgtcctactgtgttgtgtagaccaccgggtgtagttgactgtatctggttgtttgtatgtatggacaagacaaaactagcactgcagatggtatggtaaggcgtaagcaaatacaatatgacattggtccagttccaggaatgaatggaatatgacattggtccgag

SEQ ID NO: 66127 - DNA, 306 bp, Zea mays
  unsure at all n locations
  Clone ID: LIB3076-055-Q1-K1-F11
acgcacgcgaccgcngacccctgggcggactcgtggtcggacttgtgggtgccaccagcatgcacaagggaggtggtgtttttaggatccttgtcctactgtgttgngtaaaccaccgggtgtagttgactgtatctggttgtttgtatgtatggacaagacaaaactagcactgcagatggtatggtaaggcgtaagcaaatacaatatgacattggtccagttccaggaatgaatggaatatgacattggtccgagaaaaatatatatatttattattaaatttttatttttaatttttttttt

SEQ ID NO: 66128 - DNA, 370 bp, Zea mays
  Clone ID: LIB3076-055-Q1-K1-F12
gtggtttgctctccacgggtacgcatcattatgttcttgataggatcatcctgaccatgggctttatcattttctccttggcggttctttatgttgtctcaagacgtattggtctattgacgctgcaaaggaaactggccgatgccatcagatccggttcattatcagccgatgacatcgtagcgaatgcccaacgtggacctgccccagcaaatgttcctgctcccatctacgatgaactgtgattcgtttgtcctctgtattgttaaggttagttttgcatgtggctattgggattttgtccagtgtgtggtggtcatgtaccgatctgcgattcattaaaataatttcaaatgaaaaatagttaact

SEQ ID NO: 66129 - DNA, 347 bp, Zea mays
  Clone ID: LIB3076-055-Q1-K1-F4
atcaaacaattctttgttgctgttgagaaagaggagtggaagtttgatacactttgtgatctttatgatacactcaccatcacccaagctgttattttctgcaatactaagagaaaggtggattggctcactgaaaaaatgcgtacaaataacttcaccgtatcagctatgcacggtgacatgccccaacaagaaagggatgccattatgggtgagttcaggtctggcgcaactcgtgtgctaataactacagatgtttgggctcgaggactggacgttcagcaggtttcacttgtcataaattatgatctcccaaataatcgtgagctttacatccatcgcattgg

SEQ ID NO: 66130 - DNA, 322 bp, Zea mays
  Clone ID: LIB3076-055-Q1-K1-F5
atccggtccaacggcaaatgcctgaccagcagcggcgacgcggccggcgcccgcgtggtggtcgacgactgcccgcgcttccccacgggccgcgtcgtctgggaggtgcgcgtggacggtaccgtcgcgctcaagtggtcccgcggcctggtgctggccgtgacctcgtcgacgctcttcgcggggctcacggtgcggcaggacgaccgcggcaccggccagtcgtggacgccgaccaacgtcaccgcgcccctggacgccgccatcgtggggttccgcgacctctgtctgcaggcggactacgcgggggcggtatccgtcg

SEQ ID NO: 66131 - DNA, 380 bp, Zea mays
  Clone ID: LIB3076-055-Q1-K1-F6
gcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacatggtggcggtggcggtcgtgtt

SEQ ID NO: 66132 - DNA, 396 bp, Zea mays
  Clone ID: LIB3076-055-Q1-K1-F7
cccacgcgtccgcccacgcgtccgagaacctgtaaaatatatgcaaaaaagcctcagggcagatccaagaacgcggagaggttgaactttgtttgccagcatacactagtgaaggtagaataccagaatcatgatgaatctaagccaccaaccaaatctcatttgtttcatgatgagacactaccatctttcttccgaaggttggcatggtcacctgatggatcttttctagtattgccagcaggcctttctaaacactcctccgaggtgattaatacagcttatgtaatgtccaggcgtgacctctcaaggcctgcgatacaactccctggggcaagtaaagctatagtggtagtacgcttctgccctgtactattcaaaccacgtggttctaac

SEQ ID NO: 66133 - DNA, 101 bp, Zea mays
  Clone ID: LIB3076-055-Q1-K1-F9
cccacgcgtccggctgtgttgtgggttatgtgatactctctcctgcccatctaataatatatataaggtgtaatcactttttgctctatacacggaggact

SEQ ID NO: 66134 - DNA, 383 bp, Zea mays
  Clone ID: LIB3076-055-Q1-K1-G1
cccacgcgtccgcccacgcgtccgccgtgttccgtgtccgcgtccagtgtgtccgctactccgctgcccctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtcgatgaaatgaagaccattgctgag

SEQ ID NO: 66135 - DNA, 379 bp, Zea mays
  unsure at all n locations
  Clone ID: LIB3076-055-Q1-K1-G10
cggacgcgtgggcggacgcgtgttctgactcgtgggtgccaccagcatgcacaggggaggtggtggttttaggatggcgtgtcctactgtgttgtgtagaccaccgggtgtagttgactgtatctggttgtttgtatgtatggacaagacaaaactagcactgcagatggtatggtaaggcgtaagcaaatacaatatgacattggtccagttccaggaatgaatggaatatgacattggtccgagaaaaaaaaatttaatatttataatttttttaataataatttataatatttatttaatttgtttgggggggtgtgtttttgnattttaattattanaatttttttgttttttttttttttaattataatttttt

SEQ ID NO: 66136 - DNA, 408 bp, Zea mays
  Clone ID: LIB3076-055-Q1-K1-G11
cggacgcgtgggggctcgtctgcctctgctctgcccttgccctgcccccatatagtgcatgccattgccacccccaaagtgtaagcacaaccaacagcaaagaagagacgacgtcgatcgatcgatctcagcaaccaagcaggtcgtaggtaggcatggcggccgagaaagagggcgcggtggtgaccaaaggccacgactaggggatgaaagcggcggcggcgctgctggaagagttcgggctcccgccggggctgctgccgctggaagacgtgacggaggtggggttcgtgcgggccaccggctacttctggctcgcgcagcgcaagaaagtggagcaccggttccgcaagatctgcaagcaggtgagctacgacgtccagatcgccggatacgttcgggccaggg

SEQ ID NO: 66137 - DNA, 373 bp, Zea mays
  Clone ID: LIB3076-055-Q1-K1-G3
ccacttctgacgaggcggcgtgtgagctacctggagctggaggtccagttctttggctatgtggcaagagggttgtggttagtaatttattcgatcagcaaccaagctccaatactgggagcctgcaacgacaacgtgtggcagacatggaactggacgcttcagctcctgagtcaccgactagttgtggaactgggaagaagctgtcctcccatgccgcagaggaagcgaagacatggcacccgtggctgaccggtacgcggcagtttatgcactgtcttcctcaaggcgaggaggtgttctccgtgcattctgcttgccgacccctgagctacggtgatggaagcatgccttgcaccacggtgtggaacgc

SEQ ID NO: 66138 - DNA, 391 bp, Zea mays
  Clone ID: LIB3076-055-Q1-K1-G4
aaaaccgggcgacccacgcgtgcgatcaacaattctttgttgctgttgacaaataggagttcacgttcgatacactttttgagggttatgagtacactcaccatcacccaagctcttattttctgcaatactaacagaaacgtggattggctcactgaaaaaatgcgtacaaataacttcaccgtatcatctatgcaccgtgacatgccccaacaagaaagggatgccattatgggtgagttcaggtctggcgcaactcgcgtgctaataactacacatgtttgggctctaggactggacgttcagcaagtttcacttgtcataaaatatgatctcccaaataatcgtgagctttacatacatcgcattggtcgttctgggtcgtttgggc

SEQ ID NO: 66139 - DNA, 225 bp, Zea mays
  Clone ID: LIB3076-055-Q1-K1-G5
atcaaacacaactttgaatctcttgacaattacgattacacgttcgatacactctgtgaggtttatgattcactgagcgtgacccaagctcttattttctgcaatactcacataaacgtggcctggctcactaaaaaaatgcgcacacataacctcaccgtatcatctatgcacctttacatgccgcatcaagaaagggatgacaacatgggtgacttcaagtct

SEQ ID NO: 66140 - DNA, 439 bp, Zea mays
  Clone ID: LIB3076-055-Q1-K1-E3
gtgagaatggtcacaggagataacataaatacagcgtaggcaattgctcgtgaatgtggtggactgagctgaagatggcatagctattgaaggaccagagttcagagagaaaagcctagctgaactccttgaactggttccaaaaatacaggtaatggcccgatcatcaccacttgacaagcatacacttgtaaagcatttgcgcacaacattcaatgatgttgttgctgttactggtgatggaacaaatgatgctcctgcattgcatgaagcagatattggacttgcaatgggcattgctgggactgaggtggcaaaagagagcgctgatgttataattctggacgacaacttctccacgattgtaacttgtgccaagtggggacgatctgtttacatcaatattcaaaaagttgtgcagtttcagctgactgtcaat

SEQ ID NO: 66141 - DNA, 236 bp, Zea mays
  unsure at all n locations
  Clone ID: LIB3076-055-Q1-K1-G6
gctcctcatgtgggtcgacacggggctcgtcccggaggccgcggccagggggtttgggcccaagctatctcccgaagccggggcgcgggtgggggcctatacgcgcctcgcgcctggcggnctggaacataagctgcacgtcgtggagcgcacggtccgccagcttgtttgcggtgaggggatcgccaattgcagctcgcgagactccgtctggcgattccaccagaatgatcagc

SEQ ID NO: 66142 - DNA, 249 bp, Zea mays
  unsure at all n locations
  Clone ID: LIB3076-055-Q1-K1-C4
cccacgcgtncgcccacgcgtncgcgataaacggacactatccacagataatgcaagatcgcgtgggggagaagctgcccagggtcaatcctgaacaagctaaactggtgaagggctcggcagactacatcggtatcaacgagtacacattcagctacattaaggggcagaagctggtccagctggcagcccagtagctactctgccgataggcacgttcaatatgtatttgcacgcaatggcaaaccg

SEQ ID NO: 66143 - DNA, 148 bp, Zea mays
  Clone ID: LIB3076-055-Q1-K1-C5
gtggcatatactgctctatagagttatttgtgacaagcgaactcatgttttcactacagttggtaacaatgcgaattttcaggctaatgcacactaaaagtttgaaacggtgcacatttactacttcaagtttgatggtctagaggat

SEQ ID NO: 66144 - DNA, 383 bp, Zea mays
  Clone ID: LIB3076-055-Q1-K1-C6
cttggctgtttgcttttggtttagcctttttctgacagggaactggtctgggtactactggccaaaggaccatatatcataattggaaaggagcaaggcaagctgtagggaagatcactgcacaattatttttatattatcgctcctataacgttttgagaatctgtggttaagttgtattgtaaagctagttagtagcaaaattgtttataaggctatttgagctcttatatcttcatacacatttaatttttcgcagcttgtgaacattgggaagcccaattaaatatttgaatctgcatagagtattggaaatagtcaatactggtgaacttttgaatgattcagattttgagactcttgctaggagcaatgtgtagcct

SEQ ID NO: 66145 - DNA, 415 bp, Zea mays
  Clone ID: LIB3076-055-Q1-K1-C7
gtgctctgtcaagtttgcctagagtcaaagcaacctcaagaccctcttaccacatcatatacatgtaatggcagttcgagtctgactccaagttcgaaggaggctttgctaaagaacatatcatcagggataacagactacacaaattggtctttaatgttttgcttgatggcacagaagtagcttactatgttgatgggcagagaaaggttgacgggtatattaaggatcaaagaatctactgtaatcactgcaacaaagtggttagcccatcagcatttgaagctcatgcgggtgagggatcaaggcgcaaaccgtatgataacatattcacatcaaacggagtatcattgcatgagctggcaatgaaaatatcaaaggatatggaactgtcagaacgtgagactgatgatct

SEQ ID NO: 66146 - DNA, 358 bp, Zea mays
  Clone ID: LIB3076-055-Q1-K1-C9
cccccctctcacctcccacaccaccccccccctctccccccccccacccctccattcccctccctccccacaccccccccctcccccccctccacccatacacccccccccattccccctcacaaccccctcccatcacaccccaccccctccccccacaacccccctccatccccctctccatcccctctcaccccatccccccccccccctcccatccccctcttctcccccccacctcccatcccccccccttcccctcatcaccccccccccctaccccccatcacctcccccactcctccccacctcccccccccccccccccctctcccctcccatccccacccctcccccc

SEQ ID NO: 66147 - DNA, 401 bp, Zea mays
  Clone ID: LIB3076-055-Q1-K1-D10
cccacgcgtccggtttgtttcggcaactacaatgaacttcttcagaactatagattcacgtgcattgggactcctaaagattttggaagaatcaaagatggaacatcaaaagcaactcttccagcttcagaagaagtttgaggccgttgttgctgacgaagagaagtacttgatggagaaggttgcagggttgtttgcagaatcaaacgctcgaaagaaaaatatggttcaagatgacatatgcagcctcaataggactgtttctgagcgttcgaacaatttacaaaccgaaactaccaagctgcatgattttacatcttctatgaaagagcaatgggaaggctacatgaagaaaactgaagaggcattccagcaaaatgtatcatctattgaacagaaaa

SEQ ID NO: 66148 - DNA, 295 bp, Zea mays
  Clone ID: LIB3076-055-Q1-K1-D11
gtacgaagcctgtttcgtcagtggtcgtctctgtgctggctgatcccagagaggctggcgatggggatggtgagggaaggatctcttcaaaatcattgtcccgcatcttagttgtcgttcttatagatagtgttaagtatgttacgtactcttgtgtcctgccgttcaaaagccatagccctcacctttaggtctgggttttggacgtgagttgataaagctgacctatacattttatagcagaagaggtgtaagacagctgcctttgttcatttattcaagttttgtgtgctca

SEQ ID NO: 66149 - DNA, 407 bp, Zea mays
  unsure at all n locations
  Clone ID: LIB3076-055-Q1-K1-D12
cccacgcgtccgcttccgtccccaaatcgaccgagcgaattcaccacagcttctcaccaccgctaccttcgatggcacccaaggcggacaagaagccggcggcgaagaagcctgcagaggaggagcccgcgacagagaaggcggagaaggctccggcggggaagaagcccaaggccgagaagcgcctcccggcgggcaagtccgccggtaaggagggcggcgagggcaagaaggggaaaaagaaagcgaagaagtccgtggagacctacaagatctacatcttcaaggtgctgaagcaagtgcaccccgacatcggcatctcgtccaaggccatgtccatcatgaactccttcatcaacgacatcttcgagaagctcgcggccgagtccgncaagctggcgcgctat

SEQ ID NO: 66150 - DNA, 293 bp, Zea mays
  unsure at all n locations
  Clone ID: LIB3076-055-Q1-K1-D2
gcgtccggngagactggtcacagcagataacataaattcagcttatgcaattgctcgacaatgacgtgtactggacaaagatcgcgtagggaatagaaggaccaaacttcatagagaaaagcctagcgtgaactctattgaactgcttccaaaactacagggaatggccccatcataagcacttgacgagcatgcacttagtaagcatttgcgcacaacattcaatgatgttgctgctgatactggtgacggaacaaatgatgcttccgcattgtataaaacatatattgaac

SEQ ID NO: 66151 - DNA, 443 bp, Zea mays
  Clone ID: LIB3076-055-Q1-K1-D3
gtgagaatggtcacaggagataacataaatacagcgaaggcaattgctcgtgaatgtggtatactgactgaagatggcatagctattgaaggaccagagttcagagagaaaagcctagctgaactccttgaactggttccaaaaatacaggtaatggcccgatcatcaccacttgacaagcatacacttgtaaagcatttgcgcacaacattcaatgatgttgttgctgttactggtgatggaacaaatgatgctcctgcattgcatgaagcagatattggacttgcaatgggcattgctgggactgaggtggcaaaagagagcgctgatgttataattctggacgacaacttctccacgattgtaactgttgccaagtggggacgatctgtttacatcaatattcaaaagttgtgcagtttcagctgactgtcaatgtagtg

SEQ ID NO: 66152 - DNA, 216 bp, Zea mays
  unsure at all n locations
  Clone ID: LIB3076-055-Q1-K1-D4
acggtgacacttgtcacattacataacctaaattcacattaggaccttgctaacaaatataggggtcggaataaaaaaaccgtagccactgcaanaccaaaactcacaaacaaaacacaagcttaacttccaatacaagattccataatacatgtaatagccctatcatttacactatgtaagcatacacatacaatatatttgtgcacaacattc

SEQ ID NO: 66153 - DNA, 404 bp, Zea mays
  Clone ID: LIB3076-055-Q1-K1-D5
gtggacagcgacagactgctgaatggtacaaggagaatggtatagaggtgctgtatgaggatccagttgtagcatttgatggcaaaacgcaaaccttaaagacttcatcggggaaagttctgaaatacggctcacttattatttctactggatgtgaagcatcgagattacctgagaaaattggagggaaattacctggagttcactacatacgggatgttgctgatgctgatgctctagtatcctcattgggaagtgcaaagaaggtggtggttattggtgggggctatattggcatggaagtagctgcagcagcttgtggctggaatcttgacacaactattatattcccagaggaccacattatgccaagattatttacaccctcgcttgctaagaagtat

SEQ ID NO: 66154 - DNA, 287 bp, Zea mays
  Clone ID: LIB3076-055-Q1-K1-D6
aaaaaaaaaaaaaataaaaaaaaaaaaaaattaaaatttaaaaaaaaaaaaaaaaaaaaaaggagaagagaaaaattaaaaaataaagtaataaaaaaataaaaataaataaaaataacgcttttttttttttaaaattatatttttcatttgtgtgatttaaaactttttttttttttaatataaaatttattattttttccgttcgttttaaattttatatctttatatataaaaaaatcatttcctttcttatattttttgcatacttgtttattactcctatt

SEQ ID NO: 66155 - DNA, 391 bp, Zea mays
  Clone ID: LIB3076-055-Q1-K1-D7
gtgctctgtcaagtttgcctagagtcaaagtaacctcaagaccctcttaccacatcatatacatgtaatggcagatcgagtctgactccaagttcgaaggaggctttgctaaagaacatatcatcagggataacagactacacacattggtctttaatgttttgcttgatggcacagaagtagcttactatgttgatgggcagagaaaggttgacgggtatattaaggatcaaagaatctactgtaatcactgcaacaaagtggttagcccatcaacatttgaagctcatgcgggtgagggatcaaggcgcaaaccgtatgataacatattcacatcaaacggagtatcattgcatgagctggcaatgaacatatcaaaagatatggaact

SEQ ID NO: 66156 - DNA, 225 bp, Zea mays
  Clone ID: LIB3076-055-Q1-K1-D8
ctgacacgtccagtttgacatagttactattaacaacttcaccataacaataaattcaggtgcattcatactggtgcggaagccacaacaaatcaaaaagttacatacataacaactatttcatctccagtacaagtttccagacgttgttctttactcatataattgcttgaataaaacacttacactactttttttcagtatcaaacgctctaaatgatatat

SEQ ID NO: 66157 - DNA, 271 bp, Zea mays
  unsure at all n locations
  Clone ID: LIB3076-055-Q1-K1-E10
gcgtacgcccacgccttcngtttgtttccgcaactacttttaacttcttcagaactatatattcacatgtcattgttactcctaaagattttggaaaaatcaaagattgaacactaaaagcaactcttccagctttaaaagaagttttaggccgttgttgctgacaaaaagaagtactttattggaaaatgttgcaaggttgttttcaaaatcaaacgctcgaaagaaaaaaatggttcaagaatacatatgcagccttaataggactgtt

SEQ ID NO: 66158 - DNA, 293 bp, Zea mays
  unsure at all n locations
  Clone ID: LIB3076-055-Q1-K1-E11
gtacgaagcctgtttcgtcagtggtcgtctctgtgctggctgatcccanagaggctggcgatggggatggtgagggaaggatctcttcaaaatcattgtcccgcatcttagttgtcgttcttatagatagtgttaagtatgttacgtactcttgtgtcctgccgttcaaaagccatagccctcacctttaggtctgggttttggacgtgagttgataaagctgacctatacattttatagcagaagaggtgtaagacagctgcctttgttcatttattcaagttttgtgtgct

SEQ ID NO: 66159 - DNA, 308 bp, Zea mays
  unsure at all n locations
  Clone ID: LIB3076-055-Q1-K1-E12
acgcgtccggtaccaancctgtttcgtcagtgttcgtctctgtgctggctgatcccaaanagggtggcgatttttatggggagggagggagtctcttcaaaatcattgtcccgcatcttagttgtcgttcttatagatagtgttaagtatgttacgtactcttgtgtcctgccgttcaaaagccataaccctcacctttaggtctgggttttggacgttagttgataaagctgacctatacattttatagcagaagaggtgttaaacacctgcctttgttcatttatttaagttttttgttctccccc

SEQ ID NO: 66160 - DNA, 370 bp, Zea mays
  unsure at all n locations
  Clone ID: LIB3076-055-Q1-K1-E2
gaccacgcgtgcgtgagaatggtcacaggagataacataaattcagcttagcaattgctcggaatgtgtagtctggctgaatatggcatagctatggaaggaccagagttcanagagaaaagcctagctgaactccttgaactggttccaaaaatacaggtaatggcccgatcatcaccacttgacaagcatacacttgtaaagcatttgcgcacaacattcaatgatgttgttgctgttactggtgatggaacaaatgatgctcctgcattgcatgaagcagatattggacttgcaatgggcattgctttgactgatgtggcaaaagagaacgcttatgttataattctggacgacaacttctccacga

SEQ ID NO: 66161 - DNA, 366 bp, Zea mays
  unsure at all n locations
  Clone ID: LIB3076-055-Q1-K1-C3
cggacgcgtgggcggacgcgtgggcggacgcgtgggcttttctggcgacggcggcggcgacgacgacgagcagccacctggggaagagcaggtagcaggaaatggcggcgttcctgaggtcaaaatgttcaccagttggacgtactttgatgggaagccttggaaatagtttgtttggggctgccaactcttctgttggggcaataacaaggccttctcattgcgatgctatcagtcagcaaatcagaacattcatccagatgaggactaacctgaaggtggtcgataactccggggccaagcgggtgatgtgcatccagtccctgagggggaagaaaggagcaaggctcggngacatgatcatcg

SEQ ID NO: 66162 - DNA, 380 bp, Zea mays
  Clone ID: LIB3076-053-Q1-E1-H5
cccacgcgtccgcccacgcgtccggccgagaacacccgtgcggcggcggcggcttctctgctgcctcctacgacgccggcggccccggccgccgcgagggcgaccaaggcggcgggcgccgtgcccgcggagaagcccaggtccaaggccaggaagcccggcgccgtgctgccggtggcgacgttcgcggcgccggaggcgttcgagccggcggggagcatcgccgcggcgcggcgggagcacgccgcgcaggcgcaggcgcagcgcaagtcgcggatcgcgcactacggccgcaccgcgtccttctcccgggtggagggccgagtcggcgccacggccacggccacggccgccgccgagccggccgttccagcctcccc

SEQ ID NO: 66163 - DNA, 365 bp, Zea mays
  Clone ID: LIB3076-053-Q1-E1-H6
cacgcgaccgcccacgcgtccgcccacgcgtccggccgagaacacccgtgcggcggcggcggcttctctgctgcctcctacgacgccggcggccccggccgccgcgagggcggccaaggcggcgggcgccgtgcccgcggagaagcccaggtccaaggccaggaagcccggcgccgtgctgccggtggcgacgttcgcggcgccggaggcgttcgagccggcggggagcatcgccgcggcgcggcgggagcacgccgcgcacgcgcaggcgcagcgcaagtcgcgggtcgcgcactacggccgcaccgcgtccttcggcccggggtcgatggccgagtcggcgccacgggcacggtcagggccgc

SEQ ID NO: 66164 - DNA, 369 bp, Zea mays
  Clone ID: LIB3076-055-Q1-K1-A2
acgccacgcgtccgaactgggtcgccaaggatgagcagttctggtacatggctctgttggttgtctcggttgtctgttacattgccacgttctgtttctcgggtctcctatttcactggttcactccatctggacatgactgcggactcaacctgttcttcattgtcttcacgttgattcttgtttttgcgtttgctattgttgccctgcacccaaagatcaatggaagcttgttgcctgcatcagttattggtatgtactgtacatatctgtgctacagtggactctccagtgagccaagggattacgaatgcaatgggcttcacaatcactcaaaagctgtgtcaacttgtagccctacattgggac

SEQ ID NO: 66165 - DNA, 348 bp, Zea mays
  Clone ID: LIB3076-055-Q1-K1-A3
cccacgcgtccggctccggctcaaggacgagaagctggaggcgttccggtggcgcgcggtgagcatggacgtcgaggcggcgcgtctccggagccggatccacgagctggagggccgtctagcgcggcacgagaagcacagcgccgcgctggaggccctgctccaggacagggaaagcgagaacagagcactcgaggagcagctggagacgctccaagcgcaggcgcttggtgtggagatctgcacgccggcccgtggcagtggccaagacgacgggctcgacgaccagtgcatcgcgtgttcgcccgtggatgccgtccagagaacaatgtcatccggaagctcgcg

SEQ ID NO: 66166 - DNA, 372 bp, Zea mays
  unsure at all n locations
  Clone ID: LIB3076-055-Q1-K1-A4
cccacgcgtccgcccacgcgtccgggtaactgatgtcgagcaggcagaaaattggttttccttaagggcagctcagcgcatatgtgacatgtttcttgcactagataaggatacaaacggtacactgagcaaacaagaactcaaggaatatgcagatggcacattgactgagattttcattgaaagagtttttgatgagcatgtccgccggagcaaagttggaggtggaaacagtcgcgagatggacttcgaaagctttcttgattttgttttggctctagaaaacaaagatacccctgaaagcttgacatatttatttagatgcctngatcttaatggaaaggggttccttacaactgcagacatccacac

SEQ ID NO: 66167 - DNA, 395 bp, Zea mays
  unsure at all n locations
  Clone ID: LIB3076-055-Q1-K1-A5
cctcccgctgcacgcatctccagggtccggatccatgggctgcttcctcgcctgcttcggcggcgacgccggccggcgccgccgacgccagaagtcgcggaggcagtctcccgcgaggactccgccgcggtcgattcatgttgcggtggcccgcgaggcggcggatgtggtggtgaaggaggtgtcgccgccgttgcgcggggcaaagccctcaacgctggcggaggccgtggaggcgccgcacgatgaggtcgccgaggatgcggatgtggcggcgaaggacgcgtcgctgccgtcccatgaggtgaaggcttcaacgccgccgccggctgtggcggctgcngatgaggcggtcacagacgctagccccgtcgacgagctcagggatttgactg

SEQ ID NO: 66168 - DNA, 329 bp, Zea mays
  Clone ID: LIB3076-055-Q1-K1-A6
attccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaagatcaggccaagctggctgcctcctctatcgacagcatcgtgaacggcagcgacgccgtcatggagccggttgttgctggcagcaacacggtagtagc

SEQ ID NO: 66169 - DNA, 307 bp, Zea mays
  Clone ID: LIB3076-055-Q1-K1-A7
cccacgcgtccgggaagcggaagcgaggcgcccgtcatgctctgcctcagcctggtcgcgccaccaccgatggcccccgccggccggcggcggcggcggcggcatccgacttctgtgacccgccgcggccaaaccctcgccgccctcccgtgccactgtggacggcggcacgtcatcggtgcctcctcggctgccgctctccttcctttcctcgcccctccttctctggccgctccgcccgtcgaccccgacgtggtgctccagcgagtgcacccgtcgaggccggactggtatgaggagttctatg

SEQ ID NO: 66170 - DNA, 366 bp, Zea mays
  unsure at all n locations
  Clone ID: LIB3076-055-Q1-K1-A8
cccacgcgtncggtttttgaagtttgggagcagtacattttaatggagataaaaatggaccatgtacatgaggcgagatccctttataagcgttgttatagcaaaagatttgctgggtctggatcagaggagatatgctactcatggataagatttgaagaggagaatggcaccttggatgattatgatcttgctgtaaagaaggttacccctcggctaaaggagcttatgacattcaagtctcaagaggaggctaaagttgaggcttaccctaacctcaatgataattctaatgcaaatgattcctctcagaaaagaaaacccagtnacaataaacagcagccccctgctaaagaaagaaaagag

SEQ ID NO: 66171 - DNA, 359 bp, Zea mays
  unsure at all n locations
  Clone ID: LIB3076-055-Q1-K1-A9
caagacggacctccgcttccagtcctccgccgtcgccgcgctgcaggaggccgccgaggcctacctggtgggcctgttcgaggacaccaacctctgtgccatccacgccaagcgcgtcaccatcatgcccaaggacatccagctcgcgcgccgcatccgcggcgagcgcgcctaggcggttcggttgcggcgcctgctcgctactgctggaggtgcttagtttagcccgtcatggttgtgttataggtgtgcgttgttttcaagagtaggcttcttgctatgtgctgatgttaacggaggattatgattagcagttctgaaaaaatgcaatggatgtgatctgctctatctaananaaa

SEQ ID NO: 66172 - DNA, 379 bp, Zea mays
  Clone ID: LIB3076-055-Q1-K1-B11
gtcttggagggggtgacccttggagaggggccagatcagcatgtgtggaagtttactcaggccgattgctacactagctaatcagcctactctgctttctttgaggggtctgtcaagttcagaccttggagattaatttggaagagttgggctcctctccgctgcaagttctttctttggcttgccaggaacaaccgatgttggactatggatcggcttgccaaacgaggcctttctcacccagattcatgtcccttgtgtgaccaagccggtgagacccttcagcacattctaattggctatatcttctctagacaaatctgggccttgattttgcaatccttgcatctagaggccattacgcccaatgggggcagag

SEQ ID NO: 66173 - DNA, 357 bp, Zea mays
  unsure at all n locations
  Clone ID: LIB3076-055-Q1-K1-B2
gaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcactgagcaggatccgtaatgctgcaaggcacttgctcacccttgacgagaagaacccccgtcgtatctttgagggtgaggcacttcttcgccgcatgaaccgctatgggctgcttgctgagggtcagaacaagctngattatgttc

SEQ ID NO: 66174 - DNA, 367 bp, Zea mays
  unsure at all n locations
  Clone ID: LIB3076-055-Q1-K1-B3
cccacgcgtncgcccacgcgtccgtgataaacggacactatccacagataatgcaagatctcgtgaaggagaggctgcccaggttcactcctgagcaggctaaactggtgaagggctcggcagactacatcggtatcaacgagtacacatccagctacatgaaggggcagaagctggtccagctggcgcccagtagctactctgccgattggcaggttcaatatgtttttgcacgcaatggcaaaccgattggaccacaggcgaattctaagtggctctacatcgccccgacggggatgtacgggtgcgtgaactacctcaaggagaagtatgggaatccaacgatctacataacggagaacggaat

SEQ ID NO: 66175 - DNA, 266 bp, Zea mays
  Clone ID: LIB3076-055-Q1-K1-B6
gggtttcaagatcttccggtttagcattctagcaaaggcagcatccatgtgggtccgcgtactttaccctaaggccgaggatctcaacaagttgtcagctcttcacatgaacatcaacaccgccaagggccttcatgacttgctcaagaccaacctcttccccaaggtcaccatcaagatgcttgtggttggagctggttacctgaatcttactaaagatgtgaacaccctcttgaatgaaatgcatattcataacccaacttcaa

SEQ ID NO: 66176 - DNA, 393 bp, Zea mays
  Clone ID: LIB3076-055-Q1-K1-B9
cggacgcgtgggcgaaagagaggcagagcttggcaatggagctcccgtggggaatgctgctgccgctgctgctggtcctctccgtctcgtcctcgtcatcgtcgtcggctgctgccacgctcgccgtcagcgctccgcccccactgcctgttcctcctcctcgtcatgctcaagacgccgaaggcatgctcatcaacggcaacttcgagacggcgccgcggaagctgaacaagaccctgatcgtggggcgccactcgctgccggggtggacggtgcaaggccacgtggagtacgtctcgggcggtccccagcccgggggcatgttcttcgcggtgccgcacggcgtgcacgcgcttgcgcctcgcagccgcgcgtccgcgtcgcagaacgtga

SEQ ID NO: 66177 - DNA, 337 bp, Zea mays
  Clone ID: LIB3076-055-Q1-K1-C1
cgacccacgccggcggaagcggcggcggcggagcaaacgcaggctaaggctatggtgtgagggaaggagcaccagccatggtgcacgtcaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcactgagcaggatccgtaatgctgcaaggcacttgctcacccttgacgagaagaacccccgtcgtatctttgagggtgaggcacttcttcgccgcatgaaccgctatgggct

SEQ ID NO: 66178 - DNA, 364 bp, Zea mays
  unsure at all n locations
  Clone ID: LIB3076-055-Q1-K1-C2
ttttgctgcataacacataacattaggtattatacagactttacactccaaagtcaggaatcggttctgcaatacggtacaaaacttcnaagactagttaatttccggttcctagaactatacaaccaaagctaatggaaatatggacatttggtgggaacctgcaactgaatgaatgaacaaccattcacatgctacctaatttctggcttgctacagttctatcatagctcggagagtatagcagggatatagtgagatagctcatcggtgagtgactggaacccattgacaagttgggtgtggaattcctggtcttcttcccctatcaatctgaaatgcacacggattggacgcttgcaaa

SEQ ID NO: 66179 - DNA, 451 bp, Zea mays
  Clone ID: LIB3076-024-Q1-K1-C8
cgctttctcctcttccgccccaccccggtgtggcgctgatccatcgcctcggacaggggcgccagaacctccgcgttgcagtggttggggttggcttcgtgctattcagaaacacagtagcgagaactattcggtggggccgaagatggtgtcgctgaaggtgccaaagcgcctcgccgcaagcgttctcaagtgtgggaaaggcaaagtgtggcttgaccccaatgaagttagtgagatctccatggcgaactcccgccataacatccggaagttggttaaggatgggtttatcatcaagaagcctcagaaaatccactctagatctcgtgcaagaagggcgcacgaggctaagcagaagggacggcactcaggatatgggaagcgtagaggtaccagggaggctaggcttttcccccaccaaggtactgtggatgaagaggatgcgcgt

SEQ ID NO: 66180 - DNA, 435 bp, Zea mays
  Clone ID: LIB3076-024-Q1-K1-D10
cccacgcgtccgctccgagtctccggttccttcctctcggcggcggctcaggtgcctctgggtctccggcgtggcgcttggcgtctgacctcaacaagcaagaaagcaaatggcaggcggcagggttgcacatgccaccctcaagggcccgagtgtggtgaaggagatcttcattggactgaccctgggtctgatcgcgggaggcatgtggaagatgcaccactggaacgagcagaggaagactaggtccttctatgacatgcttgacaagggccagatcagcgttgtcgtcgaggagtaaagagttcttcccagttattttcaaagaactctctcgagagcatgacaaagtgattgcttgctgtggagatttgtcctggaaataagcacaaccatttgagaacaccagattttgtcgaattttcctttcctttt

SEQ ID NO: 66181 - DNA, 122 bp, Zea mays
  Clone ID: LIB3076-024-Q1-K1-D11
attcgaagtatgaagatgactcaccgggtgatcgcaaccggtcaggaagcaaagcgattggagcactgctctaaactcatgctgatgcacttgccaataatgattcagcctatcatggtgat

SEQ ID NO: 66182 - DNA, 392 bp, Zea mays
  unsure at all n locations
  Clone ID: LIB3076-024-Q1-K1-D3
gtccagatacacaagtgactgggtagataggtaatatcgtagcaggtatacggtaactttctagggccaataaaccaagcatacaatacaattatgtttttcacttatgaagtaaagcaacggtcgttatgcaagaactatccacactagggtaactttggacgtggtccaggtagctgaacaccgcagcttcactagccggcaatccttctgagcctgagcccacagcaccaagcttcctttggttgaagttctctaccttctgcaccaactcatccttggttctgctgcatgatgtgatgaccaatataccaccacgggaaaccaagctatcaacggactgccaatacatcattctcttcacaggtccatcangatgggggagcccaatc

SEQ ID NO: 66183 - DNA, 411 bp, Zea mays
  unsure at all n locations
  Clone ID: LIB3076-024-Q1-K1-D4
gtcatcactcgtcatggcgtcggtgaagcggtttcgggtgacagggaaggacaagatcgtgcggtggtgcgccgggaagcaacacttgctcgccaagaagaacaccaagcgcaagaagagactctccaagatgctatttttgactgcttcaacgggggcgatgtcggtgaggccgaggcgggagaggccaagtcctgccgggccacacccggacccgagctccacggcccgagttcccgggaagcggggcacgtcggcaaaggggaaggccgggtcgcggatgcagcgctcgacgaacttgacgaggaccagggacgagggccacacagaggtgcccacctcgaaggagtcgttgtcctgctcgaacatcagcaccgggccgncgaccggaagctccaccaccggagacgc

SEQ ID NO: 66184 - DNA, 272 bp, Zea mays
  Clone ID: LIB3076-024-Q1-K1-D7
ttttttttgtttttttttttttgttttttttttttttttttttgttttttttttttttttttttttttttttttttttttttttttttttttttttttttgttttttttttttttttttttttttttttttttttttttttttttttttttttttttttttttttttgttttgttttttttttttttttttttttttttttttttttttttttttttttttttttttttttgtgttttttttttttttttttttttttttttttttgttttt

SEQ ID NO: 66185 - DNA, 455 bp, Zea mays
  unsure at all n locations
  Clone ID: LIB3076-024-Q1-K1-D8
cccacgcgtccgccagcgacgaggatagggtgcacgctgaaaagctcatggagtaggagagcaaacgtggaggcagggtgaggctccaatcgattgtgacgcctttaaccgagtttgaccaccctgagaaaggagatgctctgtacgctatggagctggctctggccctggaaaagctggtcaatgaaaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaagaagaggcctaaaaagaagaacggacagatgaatgaaggaaaaaaacaagtgtgtaatgttgatcangcggaggaataatgggt

SEQ ID NO: 66186 - DNA, 405 bp, Zea mays
  Clone ID: LIB3076-024-Q1-K1-E1
gagggctaatgaacttgacaaaatgaggatggaaagaggcaagcttgacaaaggaggatactcatcaatatctggtccacgcgtgattgaaaaaacgtttagtgacatgagcatcagtggttctggatttggtagtggttctggattaggtggactgagcactgacatggactcatttgccagcaagcccaaaggtcgtccatctacagcagctactgcacctggtaaaggttttggtatgaaattaggcaagacacagaagacaaatcaattccttgagtctttgaaagctgaaggagaagtcattttggaggatgtacaaccaagtgcagtttctacaagatcatctgctcttccaccaagtgaccctgtcacagtgaaaacccctagaagagaagcttaatg

SEQ ID NO: 66187 - DNA, 274 bp, Zea mays
  Clone ID: LIB3076-024-Q1-K1-E10
ctgaactgttcagagttccttgtttgttcactaacgattctttgtcaatcttctttgaaaaggagcatggcctcatatgctaggatttgtgagtaaatctgcgcacttttaggagactcggagttcgtcctagatgcaaaagtacctggctggttatggagaggtcagctgaaggcttgaggtttgactttgtttttgatatgtaaatcactggtggtagaagattgacacctgattaatttgaatcttgatcgtccttaattacaaaactctt

SEQ ID NO: 66188 - DNA, 434 bp, Zea mays
  unsure at all n locations
  Clone ID: LIB3076-024-Q1-K1-E2
ccgggccgaccgcacgcgtccggccagaaatcaacgaaaccaaggatctcattatgaatagggctaatgaacttgacaaaantgggatggaaagatgcaagcttgacaaaggaggatactcatcaatatctggtccacgcgtgattgaaaaaacgtttagtgacatgagcatcagtggttctggatttggtagtggttctggattaggtggactgagcactgacatggactcatttgccagcaagcccaaaggtcgtccatctacagcagctactgcacctggtaaaggttttggtatgaaattaggcaagacacagaatacaaatcaattccttgagtcttttaaagctgaaagagaagtcatttttgatgatgtacaaccaaatgcagattttacaagatcaatttgctctttcaccaagttacccttttac

SEQ ID NO: 66189 - DNA, 163 bp, Zea mays
  Clone ID: LIB3076-024-Q1-K1-E4
ccctatccacacaaccacactatctactcttacatcccaccttagaatttctctaaaccactacacaacaatgacaggcttccaatcaccacaccaactcactctacctaatccacatccacctccaccaaatcatccaccatcaccaccgaatccacccatc

SEQ ID NO: 66190 - DNA, 253 bp, Zea mays
  Clone ID: LIB3076-024-Q1-K1-E6
cgctatctactcttccgtcccaccccggagtggcgctgttccatcgcctaggacaggggcgccagaacctgcgcgacgccgtggttactgttggctccctgctattcacaaactcagtcgcgagaactatcatgcggggccgaacatggtgtctcttaacgtgccggagcgcatcgacggaagcgttctacagtgtcgcaaacgcaatgtgtagcttgacccccatgagaacagtgcgatctgcatcgcgaac

SEQ ID NO: 66191 - DNA, 250 bp, Zea mays
  Clone ID: LIB3076-024-Q1-K1-E7
attcccggctcgatcgcacgctccacaccttgcctactcttccatcccaccttatagtctctctataccatcacctaaatccggttcggtggattttacacgacaccgtggctactgttaaaaccctgctattaccaaactcaatcgccttaactatcatccccctcccaacatcttgcctattaacgaacaaaaccgcatcgatcgacgttacctacagtttcgcaaactcaatgtctaacttgacccc

SEQ ID NO: 66192 - DNA, 406 bp, Zea mays
  unsure at all n locations
  Clone ID: LIB3076-024-Q1-K1-E8
gtctaaatgcacattcaccggacataaaacactggagaataagcacaagccattagtgctgaaggaattgagaaaactatggaacgtggaagaacaagatcttccatgggaagtgggggactattcaccttcgaatacattactagtggatgattccccttacaaagctctgcgcaatcctccgcatactgccatttttcctcactcctacagttacttaaactggaatgacgattcgctgggtcccaatggagaccttcgtgtgtatctgcagaacctagccgctgcagataatgttcagcattttgttcgtgataatcccgttgggcaacctttcattactgagagcgatccgcattggaacttctatgctcagatngctgaatgaggacgtgcacccttgaca

SEQ ID NO: 66193 - DNA, 398 bp, Zea mays
  unsure at all n locations
  Clone ID: LIB3076-024-Q1-K1-E9
cttatcatccccatccgcacctctctccatctccctgctcctccgnctccttcttgatccagccaagcganggatcgccatgtcggactcggaggagcaccacttcgaatcgaaggccaaccccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagangatggatttgtgagccttctta

SEQ ID NO: 66194 - DNA, 100 bp, Zea mays
  Clone ID: LIB3076-024-Q1-K1-F11
atcaaaatttgaactcgcccccccaacttcttggtaaggtttctataataaaggtatttaggagaacgttgaaggcggcaaggaactgcccaacggtgtc

SEQ ID NO: 66195 - DNA, 124 bp, Zea mays
  Clone ID: LIB3076-024-Q1-K1-F3
ttctaaatgtactctccctgtatctgtcacattaatctcttccttttttttttttttctctcatcttaacctcttcactttccttctctctatctcccccttcttttgctttctttccttcctt

SEQ ID NO: 66196 - DNA, 294 bp, Zea mays
  Clone ID: LIB3076-024-Q1-K1-F5
ttgactagtcacatgcttttatcaatcaagaacctactccagggcccggactatctactatgcatcggcgacgacaattccaacaagaacatgatccatcttatcgacaccgctgcctgcatgaactcgctgacatccaatgcttacttgttcttatacaccgtcagcctcaagcccagcaaggccaactactacctcgacgacgctctctacttcgtgagtctgatacaaggcctctcctacgtctacgacgagctggctctatcgaaccatctacattaagactatgactcc

SEQ ID NO: 66197 - DNA, 145 bp, Zea mays
  Clone ID: LIB3076-024-Q1-K1-F6
gacgcactcgtccgctgacgcgtgctctcgactcggcactatgcttttatcaatcaataacctactccacgtcccgttctatttactatgcatcggcgactacaatttcaacaagaacatgttccatcttatcaacacccatgcc

SEQ ID NO: 66198 - DNA, 289 bp, Zea mays
  Clone ID: LIB3076-024-Q1-K1-C7
gcccacgcttcctcactcatgtatctttgcttttactcctagtcctagtacatgctagatagttttatctagcaaaactgcctgtacatagcaaccatcaacggcgaccgatccaagtattgagcattagtggatctactacgtacatatatagaatgaaacagcttcatctctctctctctcgctgtttccttcgtgatctgcttgtgtatctactaactatctatcgtatcggaacctattggctgctattatgaagatatgcttctgttcccgtcctttgtctttc

SEQ ID NO: 66199 - DNA, 439 bp, Zea mays
  Clone ID: LIB3076-024-Q1-K1-A2
actaaggaagggatgtaggtctcaatcaaatatttccgtttgaggcaaagatagcaaatggcaagtgcgagcaaactctgagccgtgacagctaccggctaggtcatcgctttgatttcttcaggatgctgtcttgttactacacaacaattggtttctacttcagtacaatgattacagtatggactgtatatgttttcctctacggccggctatatcttgtacttagtggactcgatgaagcactggctactggaaagaggtttgtgcacaatacaccttttcaagttgctcttgcgtcagagtcttttgtgcaacttggatatttgatggcccttcccatgatgatggaaatctgtttggagagaggattcataactgcattgagtgattttatactgatgcaactttaattgtgggacctctggtttcttaacat

SEQ ID NO: 66200 - DNA, 446 bp, Zea mays
  Clone ID: LIB3076-024-Q1-K1-A3
cccacgcgtccggatcagtggaacacctattcaaaataacttgaaggaaatgtggactctgttcaatttctgttgcccagatgtcttgggtgataaacagcagttcaaaataaggtatgaaacggctatccttcgaggaaatgacaaaaatgctaccgctcgagagaagcacgtaggctcaaatgtagcaaaggaactaagagagcgaatcaagccatactttttgcggcgcctgaaaagtgaagttgtctttgatactggtgcatcagaagaaaaaacattagccaagaagaatgagctaattgtctggctgaagttaacaccatgccagaggaaactatatgaagcttttctaaatagtgagctggttcatttagcattgcagccaaaggcatcaccgttggctgcaatcacaaaaatattgaagaaaatatgtgatcatcact

SEQ ID NO: 66201 - DNA, 402 bp, Zea mays
  Clone ID: LIB3076-024-Q1-K1-A4
cgcagccggaggaggcctccttccgcggcttcggttactgcatgcagggctggtaccaccgctgcgtcggtctcgacccctgaaccccgccgccacttgcttctttgatttgatttcattcggttcgttcggtgcccctcccgtcctggatctgttgcgcgagagcgcggcagcgcgcgagattcgcccccttctcttctcctaggaagcaggaagcaagccgaccgctcgctgagcgccgccgccgatggccgtcgcggtgccgatgaagctctggagggtggagacccgcggcaaggccgccgccgcggggcccgacgaccccctgcgcgtcctggtgacggtgaccgtcctcgggagcgccggcccgttgcgcttcatcgtcctcgagggcgacacggt

SEQ ID NO: 66202 - DNA, 291 bp, Zea mays
  Clone ID: LIB3076-024-Q1-K1-A5
gacgcacgcgtccgttgaatacacagtaaccccaggaatcgattaaatcaccggaaagacaatactagggcttgatcatataccccacatgctggagcacatctagctaaccaccctatgctataacctctaaatgcacgacattaaacatactcaccagcagtcacagaacaatttttcaatacccaatcctcttcaaaatatttcttgaccgtgcataacattttacgcataaatcaacacattacaataaccatttatggtcaactgcacagcctctgataaaaccta

SEQ ID NO: 66203 - DNA, 113 bp, Zea mays
  Clone ID: LIB3076-024-Q1-K1-A9
cttaccctcttattagctctaggctctagctaacctcaccactccttcgagaagccatcagccttcacatcgccaccaatggccactgccgaagtccataccccgaccatcct

SEQ ID NO: 66204 - DNA, 210 bp, Zea mays
  Clone ID: LIB3076-024-Q1-K1-B1
ctcatctactgcatacggcatcgtgaatacttctaggatgattggtctgataaacaactatagaactacttatatgattattatcttgtgttttattgccctttccatatttaactctttacacatgttccagttcttcttaactttttctagcaccttaaactaataaatatcaacttttgctctgtctaccttctttattcacaattt

SEQ ID NO: 66205 - DNA, 435 bp, Zea mays
  unsure at all n locations
  Clone ID: LIB3076-024-Q1-K1-B10
cacgacacgaaccatgcaaccagctgccgattaggaacctagcggaacactgttcacattgcggcgtgtgacactaccggtggcggatacggcngcgtcgtccccctcagcccctcctccatccccggcgcggcagcgccagcagccggcctgcaaatttatggacagatctgattgaataaaccgtgaaagatatgccctggaataaaatcaatgcccttcttttcaaaatgttcgacttctacccgtcaaacattttcatcatattcatctttttactcgtccttcttcccgatacaaccatagttatatgtgggtcttggcaaccctggtgagaagtatcaatccaccaggcacaacgtgggttttgatatgatagatgcatttgcgcaatcccagggtatacccttgactacacattacttcaaagcactc

SEQ ID NO: 66206 - DNA, 437 bp, Zea mays
  unsure at all n locations
  Clone ID: LIB3076-024-Q1-K1-B12
ctctccctccctccctcccgcagcacacataaactcgagatacatatatatcagtaggatggatgtgcgaacctagcctgctgcctttgtagctgcaaattaaactgagctgtacctgttggccttnctcctcgctcctcttggttctcgctggttgccgggagcttggggtcgagagtacttctgttggtccgcacggcgaggcggcggcggagaccggtcagaaagaatgtcttcgtcccaaatcgcgccggcagatcatgtgtgctatgtgcactgcaacttttgcaacacagttctcgcggtgaatgtcccggggaatagcatgctcaacatcgtgacaattcggtgtggacactgcgcaaatctactgtcagtgaacctgaaagcacttacgcactcactcccagaacaagatcatcagcttcaagagaaca

SEQ ID NO: 66207 - DNA, 184 bp, Zea mays
  unsure at all n locations
  Clone ID: LIB3076-024-Q1-K1-B3
acgcagacgcgtggtggattgttgttgtgtggtcactctattaaattgtacttaccaatttgtgctngaaatatttcatggaaaaatatgcttttgtaatccaaaacctattcatatcaaaaaaaaaaaaaaaaaaaaaaaaaaaaaaaaaaaaaaaaaaaaaaaaaaaaaaaaatacaaaagg

SEQ ID NO: 66208 - DNA, 209 bp, Zea mays
  Clone ID: LIB3076-024-Q1-K1-B5
cgaacctccatacataatttaattacataatgaaatattccaaaacatcaattaacttctatctatatttaactgaatcatctggcaataataaatactcctctaatcgttattaattatcctctacattcttcattttcctacttatgccttactctctcatacttacatatataacaattttttgaatcttcatattatcacaacta

SEQ ID NO: 66209 - DNA, 431 bp, Zea mays
  unsure at all n locations
  Clone ID: LIB3076-024-Q1-K1-B7
gnggcgtcntgagatggctcgtaccaagcatactgctcgcaagtccacgggagggaaggggcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatcaggaagctgcccttccagaggctcgtcagggaaattgcacaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggagggatccgccgggcgagagggcctaatcgc

SEQ ID NO: 66210 - DNA, 389 bp, Zea mays
  Clone ID: LIB3076-024-Q1-K1-B8
atacccgtgccgaccgcactcgtccgataagctctcgacatgcctcttaccaagcttactactctcaactccacagtaataaaacctgccacttttcaacttgccaccgacccttcccttaactctcaccccaccacttctagactgaataaacctaacctctaccgtcctcaaactcatcccctccatgacatccgcaagtatcataacatcacttacctactcatcattaacctgccctttcacattctcgtaactcaaattgctcacgacttcaaaactgattctcgtttacaaaaccattctatacttcccctccatcaagcatctaatgcatactcttcttcaactgtttcaacacactaactctttctctattcattctaaac

SEQ ID NO: 66211 - DNA, 445 bp, Zea mays
  unsure at all n locations
  Clone ID: LIB3076-024-Q1-K1-B9
cacgacacgaaccaggcaaccagctgccgattgaggaacctagcggaacactgttcaggtgacngcggcgcactaccggtggcggatacggcggcgtcgtccccctcagcccctcctccatccccggcgcggcggcgccagcagccggcctgcagatttatggacggatctgattgaataaaccgtgaaggagatgccctggaatagattcatgcccttcttttcaaaatgttgtacttctaccgttcagacatcttcatcatattcatctttttcctcgtccttctccccgatacaaccatggttatttgtgggtcttggcaaccctggtgagaagtatcaatccaccaagcacaacgtgggttttgatatgatagatgcatttgcgcaatcccaaggtatacccttgactacacattacttcaaagcactctttggtgaaagg

SEQ ID NO: 66212 - DNA, 436 bp, Zea mays
  Clone ID: LIB3076-024-Q1-K1-C12
aaatgcccctgtcccgctaggattccccgctaaccctcccccaaaaccccagaggggagaggagcgcatgatgttcggcttcgggcaccacggccaccacggccagaacccgccggcgcacggcggcgtgcaccagcccaccttcaagatcttctgcaaggccgacgaggggtactgcctcaccgtccgcgacggcaacgtggtgctggcccacgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagcggcgacgtgggcaag

SEQ ID NO: 66213 - DNA, 442 bp, Zea mays
  unsure at all n locations
  Clone ID: LIB3076-024-Q1-K1-C3
cggacgcgtgggttcattgaagattctgtgagcttcatggcacaagggggtggtggngatgcttatgcagcagtgaagaagtaccttggccgtatcctttctgaggtggtggatgcttccattcaaaaacttgttgattcaggcagtggtctaagtgtgtcccaggcaatgcaggtcgctgctaacatgtctgtgatggagcgggcatgtgagttcttcacacgccatgctgcacaactgtgtggtgtgccactgcgtgctgtggaccgtggtcggcgggacttcccacttcgcaggtcacgtgatgctgcggaggcgctcctgctgcggctcctatgtgctaaggttgatgagttcatgcggcaatctgatggtgttaactggatggctgatgacgctcctnctggcggcaaaatttgagtatgccaacgaggtcatcatc

SEQ ID NO: 66214 - DNA, 195 bp, Zea mays
  Clone ID: LIB3076-024-Q1-K1-C4
ctaacgcctttgtacatttaagattctgttttctttatggcacaacgacctcctccacatgcttaggcttcatagatacaatgcctatgccgtatcctttctaactctttcgatgctaccattaaacaacttgataatttatgcactcgtctaaatgtctcccatccaatccatatatctgctaacatttatctt

SEQ ID NO: 66215 - DNA, 266 bp, Zea mays
  Clone ID: LIB3076-024-Q1-K1-C5
ttattttaaagggcgattaccccatacttacttatacaaccttatagcatatataacgtttacacaatacacatttcacaatgcacctgaacgcttacaccatcaaccttctaaatgctaacatccattttcccaaccagttcatttacttcaacaatatacaaacaatataatcaccaacacaaacactcttaactttcctaatttccatcctagtttattaaacttcatatatccaaacaactcaaacaacaaccgttacatca

SEQ ID NO: 66216 - DNA, 443 bp, Zea mays
  Clone ID: LIB3076-024-Q1-K1-C6
cccacgcgtccgcactcctgtatccgagctactactcctagtcctagtacaggctagcggaggcagagcgagcaaaactgcctgtacatagcaaccatcaacggcgaccgatccaagtagtgagcattagtggatctactacgtacatatatagaaggaaacagctgcagctctctctctctcgctgtttcctgcgtgatctgcttgtgtagctactagctagctagcggagcggaacccatgggctgcgaggaggaagagaggctgctgttcccgtccttcgtctttcccgagagcttcgcggaggccgccacccccggctccggtggtgagcagaagaaggctcggcagcgtcggaggcgcaagccgcggccggcggagggcggcgagggcgcggacgagcaagccaaggaaatagcggcggctgagcgacgaccaggcgc

SEQ ID NO: 66217 - DNA, 365 bp, Zea mays
  Clone ID: LIB3076-024-Q1-K1-A1
tcattggaacacctatttaaaataacttgaaagaaatgtggactcggtcaggttctattgcccagatggcttgggtgataaacagcagatcaaaataaggtatgaaacggctatccttcgaggaaatgacaaaaatgctaccgctcgagagaagcacgtaagctcaaatgtagcaaatgaactaagagagcgaatcaagccatactttttgcggagcctgaaaagtgaagttgtctttgatactggtgcatcacaataaaaaacattaaccaagaagaatgaactaattgtctggctgaagttaacaccatgccagatgaaactatattaagctttactaaatagtgagcttggtcatttaacat

SEQ ID NO: 66218 - DNA, 479 bp, Zea mays
  Clone ID: LIB3076-023-Q1-K1-F1
gcgaaggcgaccattccttcttcgctccttcttcgccgctatggttaagtactcgcaggagccgcgcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaaggcttggacgtggacaacctctatgtttcacacatccaggtgaaccaagcccagaagcagaggcgccgcacctaccgtgctcacggacgcattaacccttacatgtcctccccttgccaca

SEQ ID NO: 66219 - DNA, 425 bp, Zea mays
  unsure at all n locations
  Clone ID: LIB3076-023-Q1-K1-F2
gtggagaacttgtacgagggaccccttgatgatgtgtatgcaactgctatcanaaactntcgtccagagggtcctcttatgctgtatgtttcaaagatgattcctgcatctgacaagggcaggttctttgccttcggtcgtgtcttctcagggaaggttgctactggtatgaaggttcggatcatgggtcccaactatgtccccgggcagaagaaggatctgtatgtcaagagtgtccagcgtactgttatctggatgggaaagaagcaagagtcggttgaggatgttccgtgtggtaacactgttgctatggttggtctggatcagttcatcacgaagaatgctacactcactaatgagaaggagactgacgcttgcccaatcagagcaatgaagttctccgtctctcctgttgtgcgtgttgc

SEQ ID NO: 66220 - DNA, 437 bp, Zea mays
  unsure at all n locations
  Clone ID: LIB3076-023-Q1-K1-F5
cggacgcgtgggatcgagcgccagatggccgtcgccaggctatttgcggaggaacagcttgccgggggtctcgcgcttaagaggggtatctccntgggggctgcggcaaacctgctggttgctggtggggagaaggacgacgacatcatcttctgaccactccttccatggccatccagtcattcaatcgtggcagaaacaataagttgatgctggagctccagaattgtatctgtttatagaatgatggagattttgattcagtaagtagtctggagtctagccatccgagaccctcaataatctgtacctggaaaccaaacagtgccaaataacttttacggagcgttatgtgcagctcatgtagaaaattcaattggaccgtatttcctgtcgtgtaccttctagtaatcgattatattatatnattattattc

SEQ ID NO: 66221 - DNA, 418 bp, Zea mays
  Clone ID: LIB3076-023-Q1-K1-F6
cccacgcgtccgcggacgcgtgggggacaaaccaaggaagagcatgggagggaactagcagcagcaagtctccgcctagccaaccaaagtcaaaaaagaggtccttgcctccaaagaagaaagggcaacccaatgataagcgaagaaagactgcagaaagaaacaattctgtagaagaggagggtattggagctggtgacaatgattcagattcatccagtcctcttgcgcactcagatgttgacaaagatgtaaactctgttggccacatggaggaagtaatagttagcttagctgagaaagagaagaccaggaaggactccaaaggcatggaaatgaaagagaagggaaggaaggactccaaagacgtgaaaataaaagagaaggctgggaaagagtccaaagacgtggaaatgaa

SEQ ID NO: 66222 - DNA, 265 bp, Zea mays
  Clone ID: LIB3076-023-Q1-K1-F7
accttactttcctatttgcactcattcaaatctgatcacaaacacacactcatctaaaacacaatactttcagactttatcataccctaaattcaactaaaactctccctcacgaacctattaataatcgtagaagctacactctttttccactttcagctaaattccactccatcaaagatacacttcataactactaacataatgttacagctcctatagttactaaccccctcaactacccacttaaattgatttctaaaaa

SEQ ID NO: 66223 - DNA, 369 bp, Zea mays
  unsure at all n locations
  Clone ID: LIB3076-023-Q1-K1-F9
cacgcgtccgcccacccgtccgcccacgcgtgcgtctactcgtccggtctgcccgcccccagtgcgggccaccaccacctgttcgttatcctcccccacacggtcncctcctctgcctcccagcgcgcgcagccccttcccttgctccactccgttgcgctccgaaatggcgcagctggttccttctccccgtgcttcttctcctcccgcgcccgttcctcggtcggcgccgcgaagagccttgtggaagacgaggcggagctcagcgactggattagcgacctcaaaactgactcgttccacctcggtctcagcagcggagacgaaggcgatgcgccgtccacccgcaggtcctcggtcggctcatcc

SEQ ID NO: 66224 - DNA, 445 bp, Zea mays
  Clone ID: LIB3076-023-Q1-K1-G1
cggacgcgtgggctcaacaactcctccgagctttccgtccgccgcgtcgccgcgctcgcgggggaccactcccgcaagctctctttccacaagattgatctccgtgacaagggagcactggaaatggtttttgcttctacaagatttgaagctgtcattcacttcgctggattgaaagctgtgggtgaaagtgtacagaagccattactttattatgacaacaacgtcattggcacgataaatcttctagaagttatgtctgttcacggttgcaagaagttggtgttctcatcatcagctgcagtttatggatcacccaaaaactcaccctgcacagaaaattttcctcttactccaaacaatccatatggcaaaacaaagcctcgttgtgaagatattttgccggatatctaccgttcaaatcctgaatggaagatcattttac

SEQ ID NO: 66225 - DNA, 433 bp, Zea mays
  Clone ID: LIB3076-023-Q1-K1-G12
gcagaattcactcggatatttgggggaaataagaactgtcgtcactttcgctttgatgtagctgggagatagatgcccttattgcatcaggtgttctttagatggtaagaaagagggaaagaggacacggcaagtgctaggccggatggatggatggattgagcgacctatagtctggatctggatcctgctgtctcgcttgttgtggaacgttccatgaatgaatgcgtaggaccacttccgttagaattagtagtattgtgcaaggtaggcttcgaaatcggaagtggtagactaaattgtgtgtcaaggtacttctggtcgcagatttcagaagttgtaagcacttctgattaaggagatctttttttttgttgtttgacgtaagatttaaggagatgtttatattcgagaagtttgggaccagtcatga

SEQ ID NO: 66226 - DNA, 71 bp, Zea mays
  unsure at all n locations
  Clone ID: LIB3076-023-Q1-K1-G3
cgctccactttcatcttttcgcggtttagaaaacctctatataatttcctcccactttcgccanngtcgca

SEQ ID NO: 66227 - DNA, 403 bp, Zea mays
  unsure at all n locations
  Clone ID: LIB3076-023-Q1-K1-G5
gcgggcagatcggcaatggctatgccccagtgctggactgccacacctcccacattgctgtcaagtggncggagctcataaccaagatcgataggcggtctggcaaggagcttgagaaggagcccaagttcctgaagaatggtgatgccggtatggtgaagatgattcccactaagcccatggtggttgagaccttctctcagtatcctcctctgggtcgttttgctgtccgtgacatgaggcagacggttgctgttggagtcatcaagagcgtggagaagaaggacccaactggtgccaaggtgaccaaggctgcagtaaagaagaaatgatgcgtcctctcatgtgccctcgtttattttgtacttgtgcccgtatacttcgatctgttaaaatctattgg

SEQ ID NO: 66228 - DNA, 416 bp, Zea mays
  Clone ID: LIB3076-023-Q1-K1-G7
tccgacgaacttgaaccgaccgcaaagccacaagtcaaaggcggcggcggcaatggggaccgacccgggggcggaaaaaaaggcctcggtggccctgatgtccattgcgaaacccctcgctggaaagaagctctgcaagcggaccctcaagctcgtgcgacgagcctccgaggcgaagtgcctcaagcgcggagtcaaagaggtagtcaagagcattcgccgcgggaacaaaggattgtgtgtgatcgctggaaacatttctcctattgatgtgattacacatgttccgatactatgtgaggaagctaatgttccttacgtatatgttccatcaaaagaggatcttgcgaccgcaggaaccactaagaggccgacttgttgcgtcttggttctgaccaaaccaaacaagggggagc

SEQ ID NO: 66229 - DNA, 402 bp, Zea mays
  unsure at all n locations
  Clone ID: LIB3076-023-Q1-K1-G8
actccactcatctcnnnnaaccacaagtcttgattcttcttcggcgatngngacccacacggannagtgttaataaagcctgtgtggcgctcatatccattgcaaaacccctcgctggaaagaagctctgcaagcggaccctcaagctcgtgcaacgagcctccgaggcgaattgcctcaagcgcgtagtcaaagaggtagtcaagagcattctccgcggtaacaaaggattgtgtgtgatcgctggaaacatttctcctattgatgtgattacacatgttccgatactatgtgaggaagctaatgttccttacgtatatgttccatcaaaaaaggatcttgctaccgcatgaaccactaataggccgacttgttgcgtcttggttctgaccaaaccaaaca

SEQ ID NO: 66230 - DNA, 382 bp, Zea mays
  Clone ID: LIB3076-023-Q1-K1-H1
ccccggcgacccacgcaaccgcggacgcctagtcttactcatgggcaatattatcaatcctatataaaaattgatacccgcggtacgcttataaatgaattgcggccgcatactatctaccacagctacctggattattatccatttctgctgtacttattgtattgtatcttattgtctctaaaacaaattaacattcccataggattacagtgtcacgcactatcaatctgtatctcatagattttgttctcttatataaattccttgctatattcacattcttatattcatctcaatagcaactccttactttccttatgttcatcattcaacatactactaaattacttgctctacctttttatttccatgtttgaac

SEQ ID NO: 66231 - DNA, 468 bp, Zea mays
  unsure at all n locations
  Clone ID: LIB3076-023-Q1-K1-H11
ccggncctgaanncccggggatactggtggtcaagaacgtgttcnaactattacaaccgcctactacatgtgtgcaatgggaatttcgcttgtctatcggggtactgatgagtcatctttcaataatataagaaactggataaggaacattgagcaacatgcttccgacaatgtgaataaaattttggtaggcaacaaaactgacatggatgaaagcaaacgcgctgtaccgacttcaaaagggcaggctcttgctgacgagtatggcatcaagttttttgaaacgagtgcgaagaccaacctgaatgtggagcacgtttttttctccatagcaagagatatcaagcaaaggctttctgaatctgattcaaagccagaggatcgcacgatcagtattaacaaacctgatggcggtgaggcttccgcttcacaaaaatcaacttgcttcagatcgtgaaggggttacat

SEQ ID NO: 66232 - DNA, 74 bp, Zea mays
  Clone ID: LIB3076-023-Q1-K1-H12
cccctactctttctatcttgaccctctacctgggcaggtggtttcaaccgtgacacacgccacctccatcccat

SEQ ID NO: 66233 - DNA, 182 bp, Zea mays
  unsure at all n locations
  Clone ID: LIB3076-023-Q1-K1-H5
aaccctaactccccaccccccgcnattttctcaaatctacttncccccccacccccnnnccaccnatccccaccaattccaatctccttctccctcaccatcaccctaccccttccccaccaatcccaaaccccaaatcctattcccaatccaacaccaaccttcccccccctaaaacccct

SEQ ID NO: 66234 - DNA, 310 bp, Zea mays
  unsure at all n locations
  Clone ID: LIB3076-023-Q1-K1-H6
aacacccccactctttctgatgttagcgcctgctacctgtgcancgtggggttcccaccgggacacaggccccctccatcccatggcgcgcgccgccacctccaggctcgccgtcgtggccaacttttcctctactcgcgagtcgttcgcccgccacctccccatccctgccccctcgccatccaccgcaccgctcaatctgcctgaaccaacgaggaagcggcggaccccgttctggtcgtgtccgaccaggtcgttccatgccacaatgcaagtgtatacaacaagattactatgatgtgcttggagt

SEQ ID NO: 66235 - DNA, 485 bp, Zea mays
  Clone ID: LIB3076-023-Q1-K1-E9
gcaactgccacctccaccaccgcctccccttgctaagccacctatggctgacccggcggctatggcgggagagaggcttccacccactccgaagaagccagagcctcctgttgtgacacttgatgatctcttcaggaagacacagtcctctccaaggatctactatctgcctttatcagaagaggaggtggcagccaagctcgccgcacagggcaaaggaaaaaaggagtaggaggtgttggcttccattttcggctatctcggagtttgttgtggaacatggcgtgcggtggtcacagcatcagacaggtgctactgctgcagaccatttgaaataaccggcggccgtgactgccgcggcggaagagtagtcgtagggctgtttctgtggaaaagggactagtgtaggagcagcagcagcggcttgtatttcttaaagagattattagttttggttgggtctccgactgcagtgtgtgctaaag

SEQ ID NO: 66236 - DNA, 443 bp, Zea mays
  Clone ID: LIB3076-023-Q1-K1-C12
cccacgcgtccgctggacgcggagctgatttctaaggggctgtcattgcactgatccatggggggattactagaaccgataaagtccatgctcttcacgaggctatctaccgacagaaccttacaaatgtgaccaatttgcttgccactgtcatggtattcctcatacatatctatttccaaggcttccgagttgtgctaacagagacatcaaagaatgctcgttgacatcaaggctcatatccaattaatctgttctacactacaaacatgcacatcattcttcactctacgctgattaccaacctctattttatataccagcttctctacaggaactacagtggaaacttccttgttaaccttcatgagaagtggaacgagtctgaatactctggccattctattcctgctggcggtcttgcttactatgtaactgcccca

SEQ ID NO: 66237 - DNA, 313 bp, Zea mays
  Clone ID: LIB3076-023-Q1-K1-C2
aacatcttcatgcacaccttcatctccaccacctcccaacccaatttcaaagaacatcctccctctattcatcccaataacaacctctaccagtccttcccccacctcaataactaacaatcagcaaaaccatatgctctactcaactaacacacaaatactacatatatatatatataccctgtgtgtcaattaatgcgttctaagctccttctcatgcaccttctttcttcctctttccccctcttattatatactgtaacccttgtctttcaacctcctcttctaaaaaccatatcttctctttccatac

SEQ ID NO: 66238 - DNA, 206 bp, Zea mays
  unsure at all n locations
  Clone ID: LIB3076-023-Q1-K1-C3
tcatccaaaccttcatctncaccacctcctaacccaatttcaaanaacatccttactctatccatcccaataacaacctctaccattccttcccccaccctaacaactactaaccancataaccatatactcctctcacctaaaaaacaactactacatatatatatatatactctttttctcaaaaaatatcattctaacctcct

SEQ ID NO: 66239 - DNA, 328 bp, Zea mays
  Clone ID: LIB3076-023-Q1-K1-C4
ccggattcccggtcgaccacgcgtcggagcggtttgactctgagtctggcacgcccccacccacacacacacatgggttttaatcaatgccagcggagaactactttgctcggaggaagaccaccaagaagctagacgcgtgcaatggcgaggcatgcgaaaggcggagcggagctgcacccgcgccgctcggcgccgcgtgcgaccggtcaaaacggcggagcagacgtgcgttccacgagctgtcgttccggcccctggactgctgtcatggctgcggagccggcgcctgtcacgcccctatgccgcttttctctttcgcagctct

SEQ ID NO: 66240 - DNA, 434 bp, Zea mays
  unsure at all n locations
  Clone ID: LIB3076-023-Q1-K1-C5
gggatgatggagaagcgacacggcggcgactgtggttccggagctggaggcttcactgtgctccaccgcctcggcgccggtgtcttggcgttcctgctgccgcgggccgccggagcgaccgacgatgccaagtggcacgcccatgcccattccgccgctggcagcaacggcgccgtcaccgtcggccacggtgcccccgcgccccacgtgcacgcggccggtctcccgccgctctcggcaccggcgcccacagcgggagctgacgacctgccgccaccgcccgcgcccgtgccgacgtccgtgtcctcaccgccgagccgcgagcccggcccgcacttcggcttcccgctgcagccgggcccgggcaccgcgtccgctgcggcacctgngctgggacccggcggcgaggggtatccgttcatcggaagcaaccc

SEQ ID NO: 66241 - DNA, 450 bp, Zea mays
  Clone ID: LIB3076-023-Q1-K1-C7
cccacgcgtccgcgaaatccccaaggcgaggcgttgaaacccttaacccttttccaacctcaagcggcgcgaagaaggaaagtgtgagtggactcaagaagcggcgggcgaaatgaagcttaacgtcaagaccctcaagggcaccaacttcgagatcgaggcgagccccgatgcgtcggttgctgaagtgaagaggatcatcgaaactactcagggtcagagtacctacccagcagaccagcaaatgctcatataccaagggaaaattctgaaggatgagaccactttggaaagcaacggagttgctgagaacagcttccttgttataatgctgtccaaggctaaggcatcgtcaagtggagcttccactgctactgctgcaaaagctcctgcaactccagcccaacctgcttgccctgccacatcagttgcaagaacacctacacaagc

SEQ ID NO: 66242 - DNA, 311 bp, Zea mays
  Clone ID: LIB3076-023-Q1-K1-C8
atctgcatgcaaaacctttcatctgcaccacctccgaggccaagtgcaaagaacatgcggaggcgaggcatcccaagaacgacctctaccagtgcttcccccacctcaagaactagtaagcagcagaagcatatgctctgctcagctaaaagacaagtactacatatatatatatatacgctgtgtgtcaattaatgggttctaggctgctgctgatgcggctgcttcgttcgtgttgccccgtctgattatgtactgtaacccttggctgtcagcctgctgtgctaaaaaccattggttctgtgtggatt

SEQ ID NO: 66243 - DNA, 329 bp, Zea mays
  unsure at all n locations
  Clone ID: LIB3076-023-Q1-K1-D1
agctatttnctacctctcacattcgattagtttaactctttgatgacgctggaattgagcgggacttttaatagaaagagacaccacctttttatttcaacgagcagcccaaatctatgcacatagaatgtggcaacgtggtatcagctgattgtgcgatgtcaaacccagtggcaagggctgattccagcctttgtattcccgtcaggcaggtcagatctagtatatcccactccttatctggtctgactggtgagagcagcgctggagatcaccacgactgtggggtgttaccaatgctcctcatgagtgagccaccctggcattct

SEQ ID NO: 66244 - DNA, 367 bp, Zea mays
  unsure at all n locations
  Clone ID: LIB3076-023-Q1-K1-D12
taaaaccaatacgaccgttatatttaaaaaatatcttctcacaaacaaaacncacanattctttctcaatatcacatcttcttctatcaacacctactatccttcacacccaccattctacaacaacctatcttatactcttcaataaaacaaaccttaccttctttcacaacatcttcctcctcctatcttatccaatcatcccaatcttaacaccaactttttacccacttcttcccagcatctcctgcttatccttctagtactgctcctttaactaaccctctatcccctacttcattaatactcttacccctacacttacatattaacaaaacaattattctcttttccaactttttcatat

SEQ ID NO: 66245 - DNA, 435 bp, Zea mays
  unsure at all n locations
  Clone ID: LIB3076-023-Q1-K1-D7
gaagtattccaactccaacatcgaaattcatactttcaatcagagccagtatcctcgcattggacggaggacttcttgccacttgccagcaaagggaaatctgggaaggatggctggtatcctcctggtcatggtgatgtgtttccctctttgaataacagcggaaaacttgacatcttattggctcagggcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtatccgatgagcatgtgaatgaatntaaatcaatcgagaagttaagatattcacac

SEQ ID NO: 66246 - DNA, 234 bp, Zea mays
  unsure at all n locations
  Clone ID: LIB3076-023-Q1-K1-D8
aaaatnncatcatatcactcctcatcatactgatctctttccctctttgaataacaccttaaaacttacatctatttctcatccaaccaatatctctttcttacaaactcanacaactctccttctatagcccacatcaatatcctaaaccatctaatcaataaccagaactattacttcattcacttactccaaaacacttgcataccctaaatattacactctcatctctta

SEQ ID NO: 66247 - DNA, 440 bp, Zea mays
  unsure at all n locations
  Clone ID: LIB3076-023-Q1-K1-E1
cccacgcgtccgaccacaaatccaaaccctcttatcgtcctcgtcgccgcgacagagcccctgtctcggccgcccttcgccgcctccgcggagcaggcatcgcaggagaccaaagatccggccagctctgatgtcaggagctagtggctcaaccgggcgcgcggccccgcggtacgccccggatgacctgacgttgctcaagccgtggcgcggcctcgtcgacggcaccaccggctacctgtactactggaacccggagacgaacgtcacgcagtacgagccggctatgccccctgagaatcanctgcccccgcccccgcccccgttgcctcccccgcctccccggagccgcgaccggcgcgacaggtccagatcccgatcccgcacccctcccaggcgcgaccgccgcgaccgcgaccgtgacgacgagcatgcgtcct

SEQ ID NO: 66248 - DNA, 88 bp, Zea mays
  unsure at all n locations
  Clone ID: LIB3076-023-Q1-K1-E10
cgagcccgacgccgtccgtacaagacactgctattcatagcctagaacaatgatgagtgtagtatnntctggagggtnngccaacaaa

SEQ ID NO: 66249 - DNA, 463 bp, Zea mays
  Clone ID: LIB3076-023-Q1-K1-E11
ctgccccccaagtgaattcagcatcatttgtaagccgaaggataggggtgaaggcatcaatcggcccggctaagttagaaataaaccttcgtaaataattcaccttgccgagaaacctctgcacttcgaccttacacgtcggaggccccacattccgaatagacttgattcggtcagggtctatttctataccatgttcatggatgacaaatcctaaaaacttaccagccgacactccaaaagcacatttacgtgggttcatttttaaaccataccgacgcattttatcaaaggctttgcgcaaatcagctatatgagaactaaactcagccgatttgactacaatatcatcaatgtagacttccacagtgtttcctaacaactcatggaagatcagattcatagccctctgataagtagcaccagcatttttaagaccgaatgtcatgacaacccattcaaa

SEQ ID NO: 66250 - DNA, 423 bp, Zea mays
  unsure at all n locations
  Clone ID: LIB3076-023-Q1-K1-E12
acgcgtcgcttccaaccgccgccgcgtccgtctctccaagcgcagcagccgccgcagcacatggcggtcttgatctcagccatggcggacgtnaaccagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagt

SEQ ID NO: 66251 - DNA, 442 bp, Zea mays
  unsure at all n locations
  Clone ID: LIB3076-023-Q1-K1-E2
cggacgcctgggacatcagcgaaaacgcgcttataaagatcactgatacaatggccatcangggcagcatcaacttcgtagtgctctgcgtcgcgctggtgctgcacgccgcgtcgcctccgccgcctattgcctctgccgccgaggcctcgcgggcgacggagacgttggtggtcgacgagagggtcgcctcacacgtggacccgttcctcgtagaggcgctcgacaaccctcgccaccgcctcatggttctacggatggaactggatatacgaaactttatgcagaaccctcagctgcaggagttcgaattccagaactttccgacttcttacctacgctgtgctgctcatcgtgttgcacaacattatggcttagagactatagtggcagatagtttagtagaaggctcagttagcaggatcgttgcaagaaaaacacc

SEQ ID NO: 66252 - DNA, 329 bp, Zea mays
  unsure at all n locations
  Clone ID: LIB3076-023-Q1-K1-E4
gcgcaccccagctcgcgctgcctgctccgcctccgcctccgccgcttnctcctccatcgccaccgaagccgcccatcgtccagccccgcgctccgcctcctccgctgccgcttccggcggccggggcggagccggagccgaagcggcggcggctgaaccggctggggtccagcgtggtgcgcagcgcgacggtgctggcgcgcaccctggtggcgtgcgaggagaagcgggagcggcggcaccgggaggtcctggagctggaggagcggcggctgcggctggaggaggagcgcacggaggtgcggcgccagggcttcgcgggcctcgtc

SEQ ID NO: 66253 - DNA, 285 bp, Zea mays
  unsure at all n locations
  Clone ID: LIB3076-023-Q1-K1-E5
acacactcacctacttactctaccatttgatttctctcctagaggacccaacaatcacggccgtcctttttacacattatctacccctacctcctccacctccaactaccctnttcctccttcatcctcacccaaacctcccatcatccatacccccacttcctctccttctctacctattccctcactccctacagatccataacctaacctacatcatctaaaccctcatatttccaacttcattcacatctctacatttctaaaccacaccctctcatttta

SEQ ID NO: 66254 - DNA, 247 bp, Zea mays
  unsure at all n locations
  Clone ID: LIB3076-023-Q1-K1-C11
taaaattgagctacccctattanaaaccctacctantacatcactatccaatgattantctcaatgtaacttacatgtctaattcttcancttcttaaatggcattctcccggacatttcataatcgcagtatcagacgattataatctatgcatgtataattcccaccataatcccattcttaataccttttctccacatattaacacatagacatttttttattttactccacatagtaccatca

SEQ ID NO: 66255 - DNA, 397 bp, Zea mays
  Clone ID: LIB3076-022-Q1-K1-H6
cggacgcgtgggctctacgaccacctgcaccccaaggcctcggcggcgccgtcgcccgtggcgtcgtcgtggaagctgcgcatcaagatcctgctggacgcgtcccgcggcatcgagtacctgcactcctacgccgtgccgcccatcatccaccgcgacatcaagtcgtccaacatcctgctggacggcgggtggacggcgcgcgtgtcggacttcgggctgtcgctgacggggtccccggagccatcgtcggaggagtcgcggtcgcagcagctggcggtgacgacgaaggccgccggcacggtggggtacatggacccggagtactacgggctgcaccacctgacggtgaagagcgacgtgtacgggttcggtgtggtgatgctggagtcgctga

SEQ ID NO: 66256 - DNA, 351 bp, Zea mays
  Clone ID: LIB3076-022-Q1-K1-H7
cggacgcgtgggctctacgaccacctgcaccccaaggcctcggcggcgccggcgcccgtggcgtcgtcgtggaagctgcgcatcaagatcctgctggacgcgtcccgcggcatcgagtacctgcactcctacgccgtgccgcccatcatccaccgcgacatcaagtcgtccaacatcctgctggacggcgggtggacggcgcgcgtgtcggacttcgggctgtcgctgacggggtccccggagccatcgtcggaggagtcgcggtcgcagcagctggcggtgacgaccaaggcctgcggcacggtggtgtacatggacccggagtactacgggctgcaccaactgacggtg

SEQ ID NO: 66257 - DNA, 359 bp, Zea mays
  Clone ID: LIB3076-022-Q1-K1-H8
caagctcaacacgatctcaattcgattccagttcatccatccaacgcctcccgcctgtacgtatagaagaaagaaggaagaaccgtcaccgtacgtcctcgccagtacaaataatggccctgctcaaagccgcgcgcgtcgccgatgtgcccaccctggacgtggtggtggcccccggcctggtggcggttgccaaggcgaggagcgccgcggcggtgggcggccggttctcggtgatcgggcaccgcggcaaggggatgaacgcgctggcgtcggaggacccgcgtctgcgggaggtccgcgagaacacggtccgctccttcaacgacgccggacgattccccgtcgactacgtcgag

SEQ ID NO: 66258 - DNA, 377 bp, Zea mays
  Clone ID: LIB3076-022-Q1-K1-H9
cgcagctccgtcgaccgtcgtacagacgctgccggcgacgcgcgaagaagaggccgcgaagatggccgactcgccaacgatcgatgccgtctttcacaacgcggtcatcgtcaccatggatgatgcgttccgcgtcctccaggacggcgcggtcgccgtcgccggcgaccgcatcggcgctgtgggcccgtccgctgatgttctcggcgacttcccctgcgccgtgcagaccctcgacctgggtggccgcattgtccttccagggctcgtaaacacacacgtgcacacatcgcagcagctggcgcgagggatcgccgacgacgttgatctgatgacgtggctgcacgggaggatctggccctatgagtcacacatga

SEQ ID NO: 66259 - DNA, 92 bp, Zea mays
  unsure at all n locations
  Clone ID: LIB3076-023-Q1-K1-A11
ccggccggaatcccggtcgagcagcgtccgcnacgcgtccgcccacgcgtccgcccacgcgtccgcccacgcgtccgagttctagatcgcga

SEQ ID NO: 66260 - DNA, 347 bp, Zea mays
  Clone ID: LIB3076-023-Q1-K1-A2
ttctgatcgcgagcgccgccctttttttttttttttttttttatacaaaatgtattattatttgggtggtttcagcgtcaacatcaatccaattctttttcagtggtcaacacacaagcacaaatggcaaaacccaatccttgtttggagcaacaccctatagttggaagtccaaagcttctaaaatgaaggaaagtaatgagagagagagagaaaaaacaaatggtcaaaggcactgcacattgtggatagcagaatggggtgagcattaggtttttttttttgaaattttagaaggcctaatactcccgtgtggacagtggacccaaacgacatctgaaaatcgc

SEQ ID NO: 66261 - DNA, 354 bp, Zea mays
  Clone ID: LIB3076-023-Q1-K1-A3
gtctcttattagctctaggctctagctagccgcgccactccttcgtgtagccatcagccttctgatcgccaccaatggccactgccgaggtagctggatcgatcgaccctagtcttcgattcatatatacatacatgtgcacggatcgtttggatccgaataatacctatatatgaataatggtctctgtctcatcgatgatcggtcggtcgatcgctcatcttcgatgagacgtacagcgatggacgtgcggatcatatatatcctatgttaacaatggaagacgctaagattaagtgtggcgctaagatggaggagtacatgctttgatttttacgcgccgttcacgtgtgc

SEQ ID NO: 66262 - DNA, 379 bp, Zea mays
  Clone ID: LIB3076-023-Q1-K1-A6
cttgtctctgctggcagaaccccatttacttctgggattgggcttgaaactcttggcgttgagacagagaaagctggcaggatccttgttgataagcgcttcatgaccaatgtgaagggagtctatgcaattggggatgcgatccctggtcccatgcttgcccataaagctgaagaggatggtgtcgcttgcgtagagttcattgctggaaaggaaggccatgttgactatgacacagttcctggtgtggtttatacgcatccagaagttgcatctgttggcaagactgaggagcaggtgacggctctaggaattccctatcgtgtgggcaagtttccacttttggctaacagtcgtgcgaaggccattgatgatgctg

SEQ ID NO: 66263 - DNA, 275 bp, Zea mays
  Clone ID: LIB3076-023-Q1-K1-A9
cggacgcgtgggggaggagattgggttggggccaaatggcggtctcatctactgcatggagcaggttgaagacagcttggatgattggtttgatgaacaactagagaactacttagatgatgattatcttgtgtttgattgccctggccagattgaactcttcacacatgttccagttctgcggaactttgtcgagcacctgaaacgaaaaaatttcaacgtttgcgcttgttaccttcttgattcacagtttgtcagcgatgtaacaaaataca

SEQ ID NO: 66264 - DNA, 426 bp, Zea mays
  Clone ID: LIB3076-023-Q1-K1-B11
cggacgcgtgggcgagagtcttgatgatagccaaaagctgtttgctgatgcattggtaaagagagcatatgataactggatatatgtcattgaatatgatggcaaaggtctattgaaccttaaaccaaagaaaaaggctgcatccactggtcaagctgagacgcatgcttctgcgggtggttcgacttcgtatcaacaacacctctcctcaacgagcatgccagggtcatcaccatcaggtggaactgattccgtagggtatggtgccgaccattcagcagcacatctacctcaactccagagttcatccaccaatgtccaggcgccatacgatgacacattttctttcttaccgcctaacatgctgacagggtctgcaaacgatgccatgggtctggaactgggccagttgcaccaagtaatttc

SEQ ID NO: 66265 - DNA, 95 bp, Zea mays
  unsure at all n locations
  Clone ID: LIB3076-023-Q1-K1-B12
gcgtcacacccacgcctccncccacacntccaccctttcgttcacccacgcgtccgcccactcctccgctagttctatatcaaaagcgggcggtg

SEQ ID NO: 66266 - DNA, 400 bp, Zea mays
  unsure at all n locations
  Clone ID: LIB3076-023-Q1-K1-B2
agcggcgcgcgccattcccattcgtgtggttactatactacacacaggaataatangacncggcgcccggccgcctgcgatctcagctctccgttaacacgcaaacgcaagctcccaagcagctaccaaccagccgggagagggagcgcacgcactgcgacaatggccacggccggcggaggggccgggcatctgaagctgctgggcgcgtggccgagccccttcgtgaaccgcgtacgcatggcgctgcacctcaaggggctggagtacgagaacgtggaggaggacctcaccaacaagagcgacctgctcctcgcctccaaccccgtccacaagctcgttcccgtcctcctccacggcgacaagcccatctccgagtcactcgtcatcgtggagtacc

SEQ ID NO: 66267 - DNA, 144 bp, Zea mays
  Clone ID: LIB3076-023-Q1-K1-B3
cccatcccatctcaccatactctgcaccgccgcggagaacgcgcccccgctgctacctagaacactgcttcaggccgggctgatccaaaaagcttctatgtccgggcgcaaactcctggaaatgctcagctgctaacttttcct

SEQ ID NO: 66268 - DNA, 470 bp, Zea mays
  unsure at all n locations
  Clone ID: LIB3076-023-Q1-K1-B5
ctctgcttcgactctcttctccaactccgcctcggcgtcgtcgtgcgcttcgatcttntccatgtcgaccggatgggaggcgtcggcgcaataataggaggcgcctttgtttcgcccatcgccggcatggggaactagcttcgtggctgggccccacgccatgcaaaccagtgagaccaccgggaccgcatcgccgccggctgttgagccggaggccgaggacaaggtggaagagggggcgcgggcgaatgaggaggcggcggcgaaggtgggcggcgacgacgaggatgactgggaatcggagcatgaggggaggagaggcaggcggcagcggtgccggcgaggcggtgcggcgggggacagcgccgtggccatggtgaagcgggagctgctcacgcgctgcttgacgtgcccgctctgcgaccacctgctccggcaggccaccaccatctncgagtgcctncatacat

SEQ ID NO: 66269 - DNA, 451 bp, Zea mays
  Clone ID: LIB3076-023-Q1-K1-B7
gatgagttcccctactgtgtgcaccttgtctcttgggagaaggagaatgtctccagtgaggctggtgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccagactggaatgaggggtgcctttggcaagcctcagggcacctgtgctagggtggacattggtcaggtcctcctttctgttcgatgcaaggacaacaatgctgcacatgccagtgaagctctgcgtcgcgccaagttcaagttccctggccgccaaaagattattgagagcagaaagtggggcttcaccaagttcagccgtgccgactacctgaaatacaagagtgagggtagaaatgttcctgatg

SEQ ID NO: 66270 - DNA, 421 bp, Zea mays
  Clone ID: LIB3076-023-Q1-K1-B8
ggcgcggcctctccattccggtgtgttctccgatttgggggacgtcccttgcccgctccggagtgcggtccagcggagccagctacggcacagatcggcttccgtccgccccttcccatctcaccagactctgcaccgccgcggtgatcgtgcctcggctgcttcctagattactgcttcaggccgtgctgatgcaaaatggttctatgtcagggcgtttctgttggaaatgctcagttgctagcttttcctggtagatcatcaagttttaagagcacccagtttcatgttaaaacggatcatttttctgcaagagctctacgtgctggcactgattccattcatcatggcatgtctacatcattcccaagggagaattctctcaaggcatcccatcactatcagggcagcataatcagca

SEQ ID NO: 66271 - DNA, 473 bp, Zea mays
  Clone ID: LIB3076-023-Q1-K1-B9
gagaaagaacaagaaggatatcactggcaacccgagggctctccggcggctgaggacctcttgtgagagggccaagagaactctgtcttccactgcccagaccaccattgagattgactcgctgtacgagggcattgacttctactccaccatcacccgtgccaggtttgaggagctcaacatggacctgttcaggaagtgcatggagcctgttgagaaatgcctgagggatgccaagatggacaagagcagcgtccatgatgttgtccttgttggtggctccactaggatccccagggtgcagcagctgctccaggacttcttcaacggcaaggagctgtgcaagaacatcaatcctgatgaggccgttgcctatggtgctgctgtccaggccgctatcctcagtggtgagggcaacgagaaggtgcaggacctgcttctgctggacgtcactcctctctctctgggtctgg

SEQ ID NO: 66272 - DNA, 394 bp, Zea mays
  unsure at all n locations
  Clone ID: LIB3076-022-Q1-K1-H5
cggacgcgtgggctctacgaccacctgcaccccaaggcctcggcggcgccgtcgcccgtggcgtcgtcgtggaagctgcgcatcaagatcctgctggacgcgtcccgcggcatcgagtacctgcactcctacgccgtgccgcccatcatccaccgcgacatcaagtcgtccaacatcctgctggacggcgggtggacggcgcgcgtgtcggacttcgggctgtcgctgacggggtccccggagccatcgtcggaggagtcgcggtcgcagcagctggcggtgacgacgaaggccgncggcacggtggggtacatggacccggagtactacgggctgcaccacctgacggtgaaaaacgacgtgtaccggtttcgtgtggtgatgctggagtcgc

SEQ ID NO: 66273 - DNA, 453 bp, Zea mays
  Clone ID: LIB3076-023-Q1-K1-C10
cagctacacgaactctcaagggaacccttgagggttccgggtcaggttttgaggtgagatattgtgatctcattgaattgaacttatttctattgtgaaacccttccttagtacatcactatccaatgattagtctcagtgtaacttacatgtttgattttgtagtggcttaaatggcattctcggggacatttgataatcgcaggatcagaggattgtaatgtatggatgtggaatgccgaccataatgccattctgaatacctttgctggacatagtaacacagtgacatgtggtgattttactccagatggtaccatcacggttccttgattgctacacatctgcctatttataaagttgtggtttggtcgcctatgtaggtgtacctatgaatgctgtgttccttgtgaaggtaaacttatatgcactggatcggatgatgcgtctttg

SEQ ID NO: 66274 - DNA, 276 bp, Zea mays
  Clone ID: LIB3076-022-Q1-K1-F8
catgatcatatggtactacaacgacatctactccagctggcttctgttgcagcatagccggatgccaattaaggctgattgcaactgtgcactaatgaccagtttcaacaatatcttggagcgttttagggataatttctatcggctcttagaggttcgctgtgaacagatgatcaagtacttgaacttcagttatattcgaactattgtgaacgtgcatgatgatgtccatatcttctagaccaggttgttgttagtgcattgatatggctcaaa

SEQ ID NO: 66275 - DNA, 164 bp, Zea mays
  Clone ID: LIB3076-022-Q1-K1-F9
acatacggatactcattggccgacaccttttgatgcttagacgatggcttcacgattcagacccgaggatttatcaatttacgcggtgcgagccgctcactgaggaggacgtcatggcactgtgcctcatcgccatcaagatgctcatagcggagaatcacttg

SEQ ID NO: 66276 - DNA, 352 bp, Zea mays
  Clone ID: LIB3076-022-Q1-K1-G1
acagcgcgtctgctaggcatggtactgatcagtgactgcatgagctgctgtagcaagcgtgtataacgagattacagaccggcatgatgttagactaaatcaacttgtgctaggccgactgtatcggatccacagtggtgtgtgcacgagagatcgaatcacaatgcataggagtttatgcaccaacatgtccgttttctaacggggcgcgatgtttaatcggtccatcataaccactattattgatggcgtactcgtataaacactggtcgaataatgtcgatactgatgcgtgatcatacctaagggactatctatctcgatagtcacttactgcatcatatatttatga

SEQ ID NO: 66277 - DNA, 373 bp, Zea mays
  Clone ID: LIB3076-022-Q1-K1-G10
cggacgcgtgggcgaggaaggagggagagagcacggcggcttgatcgaagatggatgccggagcaaaggtggtgaagaaggccgcggcggggcttcgaggcgggggcggccccaagaagaagccggtctctcgctccgtgaaggccggcctccaattccccgtaggccgtatcggccgctacctcaagcagggtcgctactgccagcgtgtctgcaccggcacacccgtctacctcgctgccgtgctcgagtacctcgccgccgagctgctcgagttggcggggaacgcagtcgcggacaacatgaagaaccggatcatgccgcgacacgtactgctggcgatcccgaacgattaagaactctggaagctact

SEQ ID NO: 66278 - DNA, 388 bp, Zea mays
  Clone ID: LIB3076-022-Q1-K1-G11
cggacgcgtgggcgaggaaggagggagtgtgcacggcggcttgatcgaacatggatgccggatcaatggtggtgaagaaggccgctgcggcgcttcgaggcgggggcggccccaagaagaagcctgtctctcgctccgtgaaggcctgcctccaattccccgtaggccgtataggacgctacctcaagcacggtcgctactgccagcgtgtctgcaccggctcacccgtctaccttgctgccgtgctctagtacctcgccgccgagctccttgagttgtcggggaacgcagcgcgggacaacatgaagaaccggatcatgccgcgacacttactgctgtcgatccgcatcgatgaggatctctggaagctactgtccggcttgaccat

SEQ ID NO: 66279 - DNA, 141 bp, Zea mays
  Clone ID: LIB3076-022-Q1-K1-G12
cagacgcgtgggctatcaaagttggatgttgctccgcgtcttgatgatacatggaagacggggctctggttgtgaagatggcaggagcagcacttcgaatcgaaggccgactctagaacaaccaagacttacgcgcagcaa

SEQ ID NO: 66280 - DNA, 382 bp, Zea mays
  Clone ID: LIB3076-022-Q1-K1-G2
gagaaagaacaagaaggatatcactggcaacccgagggctctccggcggctgaggacctcttgtgagagggccaagagaactctgtcttccactgcccagaccaccattgagattgactcgctgtacgagggcattgacttctactccaccatcacccgtgccaggtttgaggagctcaacatggacctgttcaggaagtgcatggagcctgttgagaaatgcctgagggatgccaagatggacaagagcagcgtccatgatgttgtccttgttggtggctccactaggatccccagggtgcagcagctgctccaggacttcttcaacggcaaggagctgtgcaagaacatcaatcctgatgaggccgttgcctatggtgct

SEQ ID NO: 66281 - DNA, 56 bp, Zea mays
  Clone ID: LIB3076-022-Q1-K1-G3
actacacgactcgaatggtttcagcagatttgtgagttctttaccggcactatcga

SEQ ID NO: 66282 - DNA, 297 bp, Zea mays
  Clone ID: LIB3076-022-Q1-K1-G4
catactcgtacgttaaggtgtcatcagatttctgagttatgtccagagtcctatgagacggtttatgagaagatacatgcgagagagttcgaattaagcaatttgcacgcaaagtgactggctactgactacgctgaactcacaatcctgcgacagaggttcaatttcaaggctaccaccaatgtctagctattataacgaaccaagcactgtcaatgttgaatcctgaaagatccccacaaccagagctaaatcaccaattcttgatctgtcttaagacaagtccatatcatagac

SEQ ID NO: 66283 - DNA, 175 bp, Zea mays
  Clone ID: LIB3076-022-Q1-K1-G5
catactcttgggctctactactatctgcattcttaagcctcaatagagccgggttccggggcattgtataggatgcttctcatctagatactactaaacgctttcctaggcatagtgaacctacacttctactccttgctcaccatcatccaacgtatcattaattcatccaaca

SEQ ID NO: 66284 - DNA, 267 bp, Zea mays
  Clone ID: LIB3076-022-Q1-K1-G6
ctgacgcatgcgctctaggactacctggatggctcggcgtgttctgctccggctctctgtggcgtcagccggagccgttgcctccagatcctactcgacggatccggtgatctggaatgcgggtactactacacattgccaccaattatacatcaacacatagactcactcaaagagcttcttgcaggtgtgtggactgttctagtatgacacttacgaatactcgttacggtgttccgggatccatggtaagtatgagtcgcgcgc

SEQ ID NO: 66285 - DNA, 331 bp, Zea mays
  Clone ID: LIB3076-022-Q1-K1-G7
caagatcatgtggtcctacaacggcatctactcaagctggcttctcttccagcatggccggctaccaaaagtgactgcttggaactgaaaactattgaccagtttgaacactatcttggagcgttctacggataattgctattgattcttaaagggttggtctgaacacagctagaaatacttgaacttcagttatattcgaactttcgtgaactggatgatgatgtccaaatcttctagaaaaggtggtggaaagtacatggatctggcacaaaattgccatcgagaaagtcctattatcatctagctgcaaattggcgtatgaatgcct

SEQ ID NO: 66286 - DNA, 346 bp, Zea mays
  Clone ID: LIB3076-022-Q1-K1-G8
catgatgatatggtcctacaacgacatctactcaggctggcttcgcttccaccatggccggctaccagaagtgacttattggaactgaaaactaatcaccagcttcaacactatcttggagcgttctagggataatttctattgtttcttaaagggttggtctgaacaaagctagaaatacttgaacttcagttatatttgaacttctgtgaagtggatgatgatgtccaaatcttctagaaaaggtggatgaaagtacatggatatgggacaaaattgccatcgagaaagaccgattatcatctagctgcaaattggcgtatgaatgcctgctagctggtaaacg

SEQ ID NO: 66287 - DNA, 437 bp, Zea mays
  Clone ID: LIB3076-022-Q1-K1-G9
gatggcccgcacgaagcagacggcgaggaagtccaccggcggcaaggcgccgaggaagcagttggcgactaaggcggcccgcaagtctgcccctgcgaccggcggagttaagaagccccaccgcttccgccccggtaccgtcgcgctccgggagatccgcaagtaccagaagagcacggagctgctgatccgcaagctgccgttccagcgcctggtgcgggagatcgcgcaggacttcaagaccgacctacgcttccagagctccgctgtctccgcgctgcaggaggcggctgaggcctaccttgtcggtctcttcgaggacaccaacctctgcgccatccacgccaagcgcgtcaccatcatgcccaaggacatccagcttgcccgccgcatccgtggggagagggcctaagcatcgtatattctgtcatcagtgc

SEQ ID NO: 66288 - DNA, 372 bp, Zea mays
  Clone ID: LIB3076-022-Q1-K1-H1
cggacgcgtgggcgttgatggtgtgcgtcttggtttcggttgagctgctgcctgttatatgtattctgagaacagcttccttgtccctggtgtcttcgcaccaccagttctgtggtattccgtctacgaattcttcctgcgtgtaaaaatcttcatgatgtagtgtaatttccaccgtttcacctggttttatcagaccgacggctggttggacctcgagccaaagtgggaagccaaaggatgcccttggaagaagctctgatttagttccatcctccttcttggttgactgcccgtcacataggatctcgaaagctgctttgcttgtttcgcatttattcgtaatttggaatacaatattctcttgatttt

SEQ ID NO: 66289 - DNA, 234 bp, Zea mays
  Clone ID: LIB3076-022-Q1-K1-H10
cgcagctccgtcgaccgtcgtacagacgctgccggcgacgcgcgaagaagaggccgcgaagatggccgactcgccaacgatcgatgccgtctttcacaacgcggtcatcgtcaccatggatgatgcgttccgcgtcctccaggacggcgcggtcgccgacgcctgcgaccgcatcggcgctgtgggccctttcgctgatgtactttgctgcttgccctgctccgttgcagactc

SEQ ID NO: 66290 - DNA, 437 bp, Zea mays
  unsure at all n locations
  Clone ID: LIB3076-022-Q1-K1-H11
cccacgcgtccggtggcgcgtgacggtcggagatgtcccggaagaggcagccgcaggcgagcgccggcccgcggcgcgccggcggtggtggagggggtgagcctagtgggagcacatcgtgcttctccctgccccagcgccccgccgagccgaagcggcagaggatcgcccttcgcgatgtcaacacggaggtgatgcagaacaccattgcgctcgagcccctcgccaggagagtggaagaatttgacaagggcaattggaccgaagaaaatacacagatactatgtgatcttgttgttgaacagattagggaaggaaactatcttcatggccacatgaaaaatacagcttacaaggtcatggctcanaagtattatgaatgcactaaccttttccatgcaccaaagcaacttgaaaatagatacaaccagtgcgag

SEQ ID NO: 66291 - DNA, 312 bp, Zea mays
  Clone ID: LIB3076-022-Q1-K1-F7
cacacgcgtacgcggccacaacatcttcttttagaaccagcacgcgacgccggggtgggggaagaacctgacggcggacgacctccgcgccgtcgtcaacacgcgcatccttagcctcatgacctgctaccgcagcgagttcgcgcactgtgacgtgagcaacgagatgctgcactacaacttctacgagcagctgctggggcccaacgcggcctctgagttctatagcctcaagcacgacgccgagcccttggtcacgctcttcatgaacgagtactacgtcatcgagacctgcgactaccctttatccac

SEQ ID NO: 66292 - DNA, 204 bp, Zea mays
  Clone ID: LIB3076-022-Q1-K1-H12
atctcctcgcattttccttgcaaccgattgcctatccccctcccaaccaaagaccgatggcgcccaaggccgagaagaagcccgcggcgaagaagccggtggaggatgagcccgcggccgagaagacgaccgccgggaagaagcccaaggcggagaagcgggtcctcgctggcaagtccgtcggcatggagggcggcgagggca

SEQ ID NO: 66293 - DNA, 367 bp, Zea mays
  Clone ID: LIB3076-022-Q1-K1-H2
cggacgcgtgggcgttgatggcgtgcgtcttggtttccgttgagctgctgcctgctatatgtattctgagaacagcttgcttgtccctggtgtcttcgcaccaccagttctgtggtattccgtctacgaattcttcctgcgtgtaaaaatcttcatgatgtagtgtaatttccaccgtttcacctggttttatcacaccgaccgctggttggacctcgagccaaagtgggaagccaaaggatgcccttggaagaagctctgattcagttccatcctccttcttggttgactgcccgtcacataggatctcgaaagctgctttgcttgtttcgcatatatacctaattcggaatacaatattcttttg

SEQ ID NO: 66294 - DNA, 369 bp, Zea mays
  Clone ID: LIB3076-022-Q1-K1-H3
cagacgcgtgggcgttcatggcgtgcgtattggtttcggttgagctgctgcctgctatatgtatccggagaacagcttgcttgtccctggcgtctacgcaccaccagctctgtggtattccgactacgaattcttcctgcgtgtaacaatcatcatgatgtagtgcaatttgcaccgttgcacctggttttatcacaccgacagctggttggacctcgagccaaagtgggaagccaaaggatgcccttggaagaagctctgattgagttccatcctccttcttggttgactgcccgacacatatgatctcgaaagctgctttgcctcgttcgcatttatacgggatctggaatacaatattctcttgat

SEQ ID NO: 66295 - DNA, 334 bp, Zea mays
  Clone ID: LIB3076-022-Q1-K1-H4
cagacgcgtgggcattgatggcgcgcgtattggactcgcttgacctgctgcctgctatatgtattcggagaacagctaactggcccctggtgtcttcacaccaccagttctgtggtattccgtctaccaattcttactgcctcgaaaaatcttcatgatgcagagtaatctccaccgtttcacctggttttatcacaccgaccgctgatcggacctagatccatagcgcgaagccaaaggatgcccttggaagaagctctgattcagatccatcctccttcttggttgactgcccgacacataggatcttgatagctgcttttgttgactcgca

SEQ ID NO: 66296 - DNA, 420 bp, Zea mays
  Clone ID: LIB3076-029-Q1-K1-A7
acggctatggaacataatgaggatctaattagaactgaaaatgaagctgatgtatctgcagcacaagatgctggatatcagaaatctttggttgatagattgacattgaagccagaaaagatagcaagccttgcaaattcaatacccactctggcaaatttggaaaaccaatcaaccagattctctaaagaaccaaggttgctgaagacttaatgcttgaaaaaacatcttgccctctgggtgtgctgttgattggttttgagtccaaagcctatgccttagtccagattggcgctttagcaattcgaagtggcaaatgagcttatactgaaaaggggaaaaagaagccatgaagatcgaacacaggtttacataaagttataacctgcggcaatttctgacaacgtgggttaaaaactt

SEQ ID NO: 66297 - DNA, 435 bp, Zea mays
  Clone ID: LIB3076-029-Q1-K1-A9
ggagtcgcatttcgagtggtcgagtccgtccgtgtctgtcctccgctgtccgctggctgctgctctaacccaatccaaggaggatgccgaggagcccgcagctgagcctgagcggctgcagctctctcttctccctgtccagcaccagtacgagccgcgacagcgccgccctgaaggcgccggtgccagcgccaccggcaggcgcggtgcccccacggcgcacccctctcctgtcgctcagcgtcggcgaggaggaagaggacgagggtgaagacgaggaggagtacctgctgggggccggcgccctggatctgcagctgacggggcccggtggcggcagcaacagcagcggcggctacgacgacgagcggaagaacatccggatgatgaagaacagggagtctgcgctgcgcttcagggcaaggaaaaggccta

SEQ ID NO: 66298 - DNA, 314 bp, Zea mays
  Clone ID: LIB3076-029-Q1-K1-B1
cggacgcgtgggcggcacacccgagctcgcgccctccttccacgtcgaggtccgagtcctgctttgatggcgaccgacgtgactgagactcccgcgccgttggtggatgcggccccagaggcgcccgtcgacgccccggcggcgcctgctgccgacgcgaagccggccaaggccaagaaggccaccgcgccgaaaaagcgcgccagcccgacccacccggcgtacgccgagatggtctcggatgcgatcacgtcgcttaaggagaggacggtgtccagcagctacgcgattgccaagttcgtggaggacaagca

SEQ ID NO: 66299 - DNA, 265 bp, Zea mays
  Clone ID: LIB3076-029-Q1-K1-B10
gtggccgcttcgatgtacctgaccgccgtttccttcccccccgcagccgccttctcgtcctcatcccagaagctgctgcctaggtcggccggggtcggccggcgtctggtggtgcgggcagacgtcaaggtcatatcgacgggcgaggcctgccgccgcgggctcgccgccggcattgacaagctcgccgacgccgtcagcgtcaccctcggccccaaagatgttcattgcagggaggaatgttgttattgaccaagatgatgta

SEQ ID NO: 66300 - DNA, 388 bp, Zea mays
  Clone ID: LIB3076-029-Q1-K1-B11
gtggccgcttcgatgtacctgaccgacgtttccttgcccgccgcagccgtcttctcgtcgtcatcccagaagctgctgcctaggtcggccggggtcggccggcgtctggcggtgcgggcagacgtcaaggtcatatcgacgggcgaggcctgccgacgcgggctcgccgtcggcattgacaagctcgccgacgccgtcagcgtcaccctcggacccaaagatgttcattgcagggaggaatgttgttattgaccaagatgatgtacctaaagcaattaatgatggtgtcacaattggcaaggctatagagcttccaaatgcacttgagcatgcaggtgccacgctacttcaagaaatagcattcaagacaaaatggcgctgttggtga

SEQ ID NO: 66301 - DNA, 449 bp, Zea mays
  Clone ID: LIB3076-029-Q1-K1-B12
ggctgctgcagcagccggagctccgattcgccggccagccgcgtgacgcggtggcgctccacagggatcgtggcgctccgagacgccagattgaaggaagtgccaaatgaagttctacaagtgggcaattccttgagaactctggatttgaccaataacaagctagttgagattccccaggaaattggtacacttgcgaacatgcaaaggcttgttttggctggtaatttgattgaaatcatcccagctaacattggatacctgcagaatcttaaaatcctcacacttgaccgaaataggatatctatcttgcctgaagaattgggttcactgtcaaaccttcagcaactttctgttcctcaaaatttttactgtgcctgcctaagagcataggagatttgcgcattatgtcagtactcattgtatctgataacaaactaaaggaactt

SEQ ID NO: 66302 - DNA, 119 bp, Zea mays
  Clone ID: LIB3076-029-Q1-K1-B3
cggacgcgtgggcggcacacccgagctgatgcagtactaccatgtcaacgtggtagtcctgctttgatagcgaccgacttgaatgagactacgagaccgttgatgaatgcagccccaga

SEQ ID NO: 66303 - DNA, 455 bp, Zea mays
  Clone ID: LIB3076-029-Q1-K1-B5
cggacgcctgggccgttctcccgggtcccgaattcccgccctttttccttttgttccttccttcctcggaaaccctagggcttaggctttaagcgccgcgatgtccggcggcggcggcggcggcgggcactacgacggaggcagcggtggcgccgggaacgctaacgcgctcttcggcggcgggggcttcatgccctcacagtccacggtggtcccggagaacagcggcctctctaagggtcggagcgcgcagacgctgctcccgcttaccgtgaaacagaccatggacgcggcgcaaaccagcggtgacaggtctaatttcgccatcaacggcgttgaggtgtctacgattagggctggtggacgcatgctaagtaaggttgaccgtgtcacagatgttgaattcactcttgatgatggtactggcaagatagatgtgaatcgctgggaaaatg

SEQ ID NO: 66304 - DNA, 287 bp, Zea mays
  Clone ID: LIB3076-029-Q1-K1-B6
cccacgcgtccggcagcagaacgatcggatctagcagaattctctcaacctcatcggcggcggcgaagagcgtgcggatcggagatggcgacaagcgggtggaggaggagagcggcagcgcgggcctgctggagccacaccacggtgtacctgtggctcgcgctcgccgcagcagcactgacgctcgcccaggctaagaaggacctaacggaggttacccacaaggtctacttcgatgtcgagattgacggcaagcccgcaggtcggattggcatggggctttttgg

SEQ ID NO: 66305 - DNA, 440 bp, Zea mays
  unsure at all n locations
  Clone ID: LIB3076-029-Q1-K1-B9
gtggccgcttcgatgtacctgaccgccgtttccttcccccccgcagccgccttctcgtcctcatcccagaagctgctgcctaggtcggccggggtcggccggcgtctggtggtgcgggcagacgtcaaggtcatatcgacgggcgaggcctgccgccgcgggctcgccgccggcattgacaagctcgccgacgccgtcagcgtcaccctcggccccaaagatgttcattgcagggaggaatgttgttattgaccaagatgatgtacctaaagtaattaatgatggtgtcacaattgccaaggctatagagctcccaaatgcacttgagcatgcangtgccacgctacttcaagaaatagcatccaagacanataagcgctgtggtgatggaactacaacggcnantggttttggctcgggaaatcatcattcttggggtg

SEQ ID NO: 66306 - DNA, 189 bp, Zea mays
  Clone ID: LIB3076-029-Q1-K1-C1
cccacgcgtccgcccacgcgtccgctgagactgtggaacttcagattggtctgaagaattatgatccacagaaggacaagcgtttcagtggctctgttaagttgccccatatccttcgtcccaagatgaaggtgtgcatgcttggtgatgcccagcatgttgaggaggccaaaaaaatggaactggact

SEQ ID NO: 66307 - DNA, 251 bp, Zea mays
  Clone ID: LIB3076-029-Q1-K1-C10
cccacgcgtccgcccacgcgtccgcccacgcgtccggcttggcactcctgtatacagtatgcttgccaaggtaaaccctgccacgttccgaacatgattcagatgatgtgcggaacgtggcagggtttaccttgggaatgatggaatgatgggcagtgggaaggcttggcataggattgtgtcgcatgttcagactgagttgtatgagaatactgagtatgcttggcactcctgtatacagtatgcttgcc

SEQ ID NO: 66308 - DNA, 343 bp, Zea mays
  Clone ID: LIB3076-029-Q1-K1-C12
cccacgcgtccgctcattgctgcctttggtgcgtgcatcgtctgcagaagaaagaaggcagcaaataaggagtctaggaaacccgatgacggccactggactcctctcactgactacagcaagtcacggtcgaacacctcagcgaagacagcgaccacagggagccgtacatcaacgttgccatccaatctgtgccgccatttctcgtttggcgagatccaggcggccaccaagaacttcgaccaagcctctctcctcggtaaaggcggctttggaaacgtgtaccttggagagatagacagtggcacgatggtggcgatcaagcgcgggaacccgacgtctg

SEQ ID NO: 66309 - DNA, 413 bp, Zea mays
  unsure at all n locations
  Clone ID: LIB3076-029-Q1-K1-C5
ggcccacgcgtccggcgagacgacgagaccgcgatggctagctagctagttcgggcagcgagcggggtgagacggctatggcgtgctgctccgccgtcctgcaccatccgctgggcttctaactcaccccgtgctccgcctcccgagccccaccgngcatccagcgcgtgggcgtggcaactccctcggccgcctccgcccgccctctttctcgcgccaggatctcaccgngctgcacctactccggtggcgccagcgctgcccctgggcctggggagctacccgcggcggcgctccgacgggtccttgagatgccgggtgcgcaccaagcgcccgcctgctacgacgcgctgagcgcacgcctcgtcgagcgcgccgagttcagggcctggtttacgagcggtttctcaatc

SEQ ID NO: 66310 - DNA, 196 bp, Zea mays
  Clone ID: LIB3076-029-Q1-K1-C6
accacgcgtacgaccacgcgtacgctgagactgtggaacttcagattggtctgaagaattgtgatccacagaaggacaagcgtttcagtggctctgttaagttgtcggatatacgttgttccaagatgaatgtgtgcatacttggtgatgcccaggatgttgaagaggacgtgaagaggggacttgactacatgga

SEQ ID NO: 66311 - DNA, 445 bp, Zea mays
  unsure at all n locations
  Clone ID: LIB3076-029-Q1-K1-C7
cccacgcgtccgcccacgcgtccgcacagctgaatcggcagatggcacctcggtttggcaagttgaacaagtgtttagctgaactggttgatgattacagcatggttaatttcattccacttgatttgagaaaggaaagcagcatacaatatgtgctatcttctatcgacacatgtatccagtatggggaagatgcagacgtgaaggtcagggacttcgaagaagacgaagactaaccactggatgctgtgggaggtgcaaactggttgccagcagtcgtgtaaggcggaatgagactttgggactgtatggcgcatgcatgcaaaaacgtcgtaggatgctgatgacagctatgtgggctatgtaagacgaactaaagcagatactccatttggcaagtnctaataaaacgtgtgcgcgccttgatggtnctgttctcctcaat

SEQ ID NO: 66312 - DNA, 142 bp, Zea mays
  Clone ID: LIB3076-029-Q1-K1-A6
ccaacgcgtccgcggacgcgtgggtttaaacgttgatgatcagcacatagagaatggcaacctcggaaatatgaagcggtttcaattcagagagctccaggctgcaacagaaaacttcagcagcaggaacatattaggaaaa

SEQ ID NO: 66313 - DNA, 162 bp, Zea mays
  Clone ID: LIB3076-029-Q1-K1-D1
cacgcggtcgcattcggacgctcgcctcccaaaaccctacgaagagatgcatctgccggcgctgcagcgtgtaccggcgagcgctgctagtgccggcgcgcggactcctcgaggcgcgcgtgccttgggtgcgagaacaggccctcgaccacgtcgtggagc

SEQ ID NO: 66314 - DNA, 370 bp, Zea mays
  Clone ID: LIB3076-029-Q1-K1-D10
acgaagacttgctctttcaccctggtgcatcgagcaatttgcacgtccagaggaatggtcgaagttgcggttagacaaggtaaggtggttgacatgtatagttgagaggagggaagaaggtgcattatccattgtgccactgctatcaaactgcagaaatgtggaagagctctgcgtgtctgttgtgccatcgcagggcaaatggaggcggaatagtggcgatggaggaagtcatggtgtgcttggtggtaagagggtatcggtgaaacatctaaaggtcgttaggatgaagtacattgatgaaagcagaagtggatttaaactggtaaaggtcctgctcaagaacgcctctgcactggagaccatgaca

SEQ ID NO: 66315 - DNA, 145 bp, Zea mays
  Clone ID: LIB3076-029-Q1-K1-D11
accaagacttgctatttcaccctgctgcatttagcaatatgcacatccagaggagtgaggggaggttcggatcgacaaagtggggatgttgacgtgtatagcatagaggagcgaataacgcgcgttatccattgtggcactacta

SEQ ID NO: 66316 - DNA, 456 bp, Zea mays
  Clone ID: LIB3076-028-Q1-K1-F9
cccacgcgtccgcacacgtcggtccaaacacgcgccgtccgctcgcggcttctccaaccaaagccgtgcagccaaatccgaagggtagcgtatcacggggacgacgccatgagccgcgcgctcctctcccacgtgctgcaccgtccgccgtacttcgcgtacacctggagtggcgttggtgcccgaggaggagtgctcgcttctggcatacacccactccgtcgtctcaattgcagcgcggttgaagccgttcccggccccaccgaggaggcgcctgctactcaggcaaggaagaaaagagtagtttctggtgtacagtcaacaggatccggtcaccttggaaattatctaggggcaattaagaattgggttgcacttcaggattcatatgagacattctttttcatcggggatcttcatgcaattactgtaccatatgaggctccactgctttct

SEQ ID NO: 66317 - DNA, 282 bp, Zea mays
  Clone ID: LIB3076-028-Q1-K1-G10
acgcgtacgcgtaagcattacagctcagggacttacgcctaactgcccggcttctagacccatgacagggacgatgaccgaggacgctgactgacgtcgtcgacaaacggctagatggtgcaagacacttcctcatggatgtctgtgacgctgaagctcaaaggcgcgcgcgccgcgtgctatgtgaccggataaccccacgatgcgcctgctagcacgaagcgcacctgtcgcgagaccgatgtgatggccgagaagaaaaagacctattctgacgatgag

SEQ ID NO: 66318 - DNA, 383 bp, Zea mays
  Clone ID: LIB3076-028-Q1-K1-G11
cccacgcgtccgcccacgcgttcgcccactcgtccgcccacgcgtccgcccggcttcacttcggtcgcagccgcgctccgcgttcctggggacgggcttgtgcggcggacccttggggccttgccctggcgaggtttccccttccccggctccagcggggcagacaccgtcgctgacgcctgttcccagtagcggtggcggtaacggtagcggtagtggtagcggcgggaccatcggtggaaatgggggagaaagtggccacaagaacaagaagctctccggtggtgccattgccggaatcgctataggctccgccttgggcgccggacttctcctcttgctcctcgtctgcctctgtcgcaagtcggggggcaccaggacgc

SEQ ID NO: 66319 - DNA, 446 bp, Zea mays
  Clone ID: LIB3076-028-Q1-K1-G12
gacacgcgtgcgtgcacgcgtgcatacactcgtgtaaccacgcgttcgaccggcttcacttcagggcgactctcgctccgtgttcgcggcgacagtcttgacatgctgacccttgaggccttgcactggctaggtttacactaacccggctccaacggggccaacaccgttgttgacgcctgtaccgagtagaccaggcagcaactgatgacgtagcggatgcgtctcgaccctccatggtaattgtcgaaaaagtgtccacagcatcaagaagctatcctgacgtaccattgcccgaatccatacacgctccgccttgggcgtccaacctctcatgatgctcctcgtatgcctctgtatcactgtcagtagtgacactgactcggcctcaagatatgaccgcacttgaagcatctactgatgatcatgctgcattacgcaagaaa

SEQ ID NO: 66320 - DNA, 111 bp, Zea mays
  Clone ID: LIB3076-028-Q1-K1-G2
cgagcggacagtattaggaaagagatgaatgttcttatctatcatatagaggccaatgtcgagttcattaagtcaaaacgagtggggattgcattttcacccaatgaccca

SEQ ID NO: 66321 - DNA, 488 bp, Zea mays
  Clone ID: LIB3076-028-Q1-K1-G5
ctagatcatttacatatactctgacattaatctcattttttaaataactaacgaaagcttaaattcgtattaaatgtgcccacctatttgtcatttacaaagaatagtactttatctatgcttgttggcgtactgattgttgcttcatttgaaatgttgaaatgaaaacattcttattgcttattcctttttttggtgatattactgccttctagacatgctttattaaagtgaaaatatttctctttttgttgaacttctaagtagtgtatttgttttgctgaggtttcttcttttatagtagaattttatttttttattttcttgtatttgttttttcttttcattatttttttgtacttgttttatttagtttttttttctttatttattcttattattttggtttttttttttatttttatgtttttttgttattatctatttatatttttttattgttattttttttattattatgttttttt

SEQ ID NO: 66322 - DNA, 265 bp, Zea mays
  unsure at all n locations
  Clone ID: LIB3076-028-Q1-K1-G6
cgagcggacagatttaggaaagagatgaaggatcttatctatcagatagaggccaatgtcgagttcattaagtcaaaacgagtggggattgcattttcacccaatgacccagctgtagagtcatttctgcagaccgaaaaggaagaacgttgcagccctctctcaaaatttgttgctancttacaccagagagcgcatgacaggatggatgctctggatgagaccagtgtgattgtgggtgccgagtcctcaacctttttacgga

SEQ ID NO: 66323 - DNA, 327 bp, Zea mays
  Clone ID: LIB3076-028-Q1-K1-G7
tcgcggacgcgtgggtgcagatatgagtcaccggcggcatcggaagacatattttccatctttgaagagctgcgttcaagtgaggagcctgtcattaacgagattgagccatgctacacgaatagctctgccaaatgtgaatcggaaattcaacaggttagcccaatgaccgatatattgctcgaaacgaaagccatagtttactcgaacaaaagccctatagatgaaagccacgcccaagatggcaacagctgggagacaatcagccatgaagacatgctggggtcgagcggttcgcctgatggaagcgaaccttgagtcagcaat

SEQ ID NO: 66324 - DNA, 268 bp, Zea mays
  Clone ID: LIB3076-028-Q1-K1-G9
gttgtcctcaagcagtcaagctcctcctcctcctctctgccagtccctcccaggctcccaccccgccttgctcgcagcctgcccaaaaccctagccctagccctagccctagccctagccctagccctagctctcccacacccgcactgggagatggactgcggctgcacgcaccgcacgccggaagacgtgttccgggatttccgcgcgcggttgactggtatgatctaagcgctcatcatcgacttggagaatttctaccatcagt

SEQ ID NO: 66325 - DNA, 452 bp, Zea mays
  Clone ID: LIB3076-028-Q1-K1-H1
cggacgcgtgggttcagatatgagccaccggcggcatcggaagacatattttccatctttgaagagctgcgtccaagtgaggagcctgtcattaaggagattgagccatgctacacgaatagctctgccaaatgtgaatcggaaattcaacaggttagcccaatgaccgatatattcctcgaaacgaaagccaaagtttactcaaacaaaagccctaaagatgaaagcgacgccgaagatggcagcagctgggagacaataagccatgaagacatgcggggttcgagcggttcgcctgatggaagcgaaccttcagtcagcaataagataagcatttcttggaacagcagaaatggtttcgagtacagggagaacgagaagctggaagatgacttagctgatgcctacctggcaagcatgaaccaacccaagaagaaagaatcggccatttc

SEQ ID NO: 66326 - DNA, 414 bp, Zea mays
  Clone ID: LIB3076-028-Q1-K1-H10
ggtggccatcgtgcatccattgtacgtgattaaaccaagttttgtttgcagcaggctcttcaagtcaacaatccaagtcgtggttcgacctgtttgttgtcttgtacagcctcctgtggtttgaaacagctccctgttttattcattcctcagttgcatgatgtttggcttggttctgtgtaacttaaaaaatcacatcatgagaagcctttttctctttgctataactatattatgacttatccttacacagatctagtattcagataatactcatctctgaagggtatctaccttttgcaggttctgcaagcaggattctctgcaccaactcctatccaagctcaatcatggccaattgctctaaagggtcgtgatataatagctgtggcgaagacaggttcaaggaaaaca

SEQ ID NO: 66327 - DNA, 420 bp, Zea mays
  Clone ID: LIB3076-028-Q1-K1-H11
ggtggccatcgtgcatccattgtacgtgattaaaccaagttttgtttgcagcaggctcttcaagtcaacaatccaagtcgtggttcgacctgtttgttgtcttgtacagcctcctgtggattgaaacagctgcctgctttattcattcctcaattgcatgatgtttgacttggttctgtgtaacttaaatgatcacatcatgagaagcctttttctctttgctataactatattatgacttatccttacacagatctagtattcagataatactcatctctgaagggtatctaccttttgcatgttctgcaagcaggattctctgcaccaactgctatccaagctcaatcatggccaattgctctaaggggtcgtgatatagtaactgtggcgaagacaggttcaggaaaaacactaggc

SEQ ID NO: 66328 - DNA, 262 bp, Zea mays
  Clone ID: LIB3076-028-Q1-K1-H12
ggtggccatcgtgcatccattgtacgtgattaaattaagtcttgtttgcagcatgctctgcaagtgaacaatccaagtcgtggttcgacctgtttgttgtcttgtacagcctcctgtggattgaaacagctccctgctttattcattccttaattgcatgatgtttggcttgtttctgagtaacttatataatcatatcatgagaagcctttatctctttgctataactatactattacttatccttacacagatctattat

SEQ ID NO: 66329 - DNA, 378 bp, Zea mays
  Clone ID: LIB3076-028-Q1-K1-H2
tgaacgtagaaagtgacccacttgacagccatactataagcaagtctgagttgcaattaattctagctggaagagctggatctaaagtccaaggcagtaataaattcccatcccttagggaattgttctcaaggactgaattcttggctgtcactttggccaatgtggtcaacaactggggctattttgtcctattgtcgtggatgcctgtgtacttcaaaacggtttataacgtcaatctgaaacaagcagcgtggttcagcgccataccttgggcagtcatggctatgtccggctatgttgcaggagcctctgcagatttcctgatcaaatctggtttccccataggactagttcggaaaattatgcagtccattg

SEQ ID NO: 66330 - DNA, 167 bp, Zea mays
  Clone ID: LIB3076-028-Q1-K1-H3
ctttctcttttgaagagatatttttggtctttggatagactttacccagacaagggcctgtcttttatgacaatgaggcttgctaccctaatagctttgccaaatgtgaatcgtgaaatttgacaggttaattcccatgaacgttatattcctttgaacttaaggcc

SEQ ID NO: 66331 - DNA, 305 bp, Zea mays
  Clone ID: LIB3076-028-Q1-K1-H5
atgcggcagacatatttctgatcttggaagagctgggtccaagtgaggagcctgtcattaaggagattgagccatgctacacgaatagctctgccaaatgtgaatcggaaattcaacaggttagcccaatgaccgatatattcctcgaaacgaaagccaaagtttactcaaacaaaagccctaaagatgaaagcgacgccgaagatggcagcagctgggagacaataagccatgaagacatgcggggttcgagcggttcgcctgatggaagcgaaccttcagtcagcaataagataagcatttct

SEQ ID NO: 66332 - DNA, 210 bp, Zea mays
  Clone ID: LIB3076-028-Q1-K1-F7
cgcggcgcatgccttctgcgaccggcaccttcctatcttttatacctccgtcgcggcgacgcacgcctaccttcgacccccctaacccaaccaaagcccgaactctcgagatcacaggacgcggatccaaaccagaggcccctgcctgccctcctccaccacaccacagcctaccgtcatgtcggcgaccggtactgacgaggccgcggt

SEQ ID NO: 66333 - DNA, 391 bp, Zea mays
  Clone ID: LIB3076-028-Q1-K1-H9
cccacgcgtccgcggacgcgtgggcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggtgaaagacaacaagaagacgcgcatcatcccgcgccacgtgctactggcgatccgtaacga

SEQ ID NO: 66334 - DNA, 451 bp, Zea mays
  Clone ID: LIB3076-029-Q1-K1-A10
ggagtcgcatctcgagtggtcgagtccgtccgtgtctgtcctccgctgtccgctggctgctgctctaacccaatccaaggaggatgccgaggagcccgcagctgagcctgagcggctgcagctctctcttctccctgtccagcaccagtacgagccgcgacagcgccgccctgaaggcgccggtgccagcgccaccggcaggcgcggtgcccccacggcgcacccctctcctgtcgctcagcgtcggcgaggaggaagaggacgagggtgaggacgaggaggagtacctgctgggggccggcgccctggatctgcagctgacggggcccggtggcggcagcaacagcagcggcggctacgacgacgagcggaagaacatccggatgatgaggaacagggagtctgcactgcgctccagtgcaaggaagagggcctattgtgcaggagctgg

SEQ ID NO: 66335 - DNA, 135 bp, Zea mays
  Clone ID: LIB3076-029-Q1-K1-A11
ggggacgcatctagagtgggcgaatccgatcgtgtgcgcgctgcgttgtccattggctggggatctaacaagatgcagcgaggatacaatggagcccgtaggtgagcctgagcgaatgcagatctactatgatat

SEQ ID NO: 66336 - DNA, 454 bp, Zea mays
  unsure at all n locations
  Clone ID: LIB3076-028-Q1-K1-C4
atcctgtgctaaacccggttcagaatctgtcacagtggaaggaagttaagagtctcaaggcccaaccagtgcatggtaaaatgttggataaggagaatgtaaactcagtggcagatgtaggtccaagccatgactgtaattatgcaagccacacaaggatgaaccctagcttgtcaagtaagaaggaaaattctttagacgctagcctctctacctggttggtttcttctgagaactcagcattggacaatgtgcaaagcaaatctccttgttccatctcgtcagtaaacctgaagcaatcatcgactccatctccacaaagatctccaagaactaaccgcgaaggatctccgatgttgggtacagttggaagttactggtattgcacagagtatgacaatgagcactgttcttctagatccaattcangaactactgggattcccaattcaac

SEQ ID NO: 66337 - DNA, 288 bp, Zea mays
  Clone ID: LIB3076-028-Q1-K1-C6
tccgatcctgtgctaaacccggttcagtatctgttacagtggaatgaagttaatagtctcaagggtgaaccagtgcatggtaaaatgtttgataaggagaatgtaaactcagtggcatatgtaggttccaagccatgactgtaattatgcaagccacacatggatgaaccctatcttgtcaagtaagaaggaaaattctttatactgctagcctttttacctggttggtattttcttgataactcagcattggacaatgtgcaaagcatatcttcttgtttcattatg

SEQ ID NO: 66338 - DNA, 352 bp, Zea mays
  Clone ID: LIB3076-028-Q1-K1-C7
ccacgcgtccgcccacgcgtccggttcttgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacacggcgaatgacaacaagaagacgcgca

SEQ ID NO: 66339 - DNA, 389 bp, Zea mays
  Clone ID: LIB3076-028-Q1-K1-C8
ttccagcgtcgaccgacgcgttcgatcctgtgctaaacccggttcattttctgtctcagaggaaggaagttaagagtctcaaggcgctaaccagtgcatggtaaaatgttggataaggagaatgtaaactcattggcagatgtaggtccaagccatgactgtaattatgcaagccacacaaggatgaaccctatcttgtcaagtaagaaggaaaattctttatacgctagcctctctacctggttggtttcttctgagaactcagcattggacaatgtgcaaagcatatcttcttgttccatctcgtcagttaacctgaagcaatcatcgtatccatctacacaataatcttcaagaactaacctctaaggatcttctatgttgggttc

SEQ ID NO: 66340 - DNA, 432 bp, Zea mays
  Clone ID: LIB3076-028-Q1-K1-D12
tcgcccacgcgttcgcccacgcgtccgctgactcgtgggttggcacgctcagaggttgaagaggttcactagacagctgcaggggcactatggaatcttgcattttattctggtaatgctctccgcatagtcgaagaaggcggcgttcctgttcttgtaaaaatttgctcatcatcacggtccaagatggcacgtttcatgtctgcactagcactagcatatatgtttgacggaagaatggatgaagttgctttggttggagcatcctcagatagcagttccaagagtgttaatgttgaaggagctagaagaatagcatttaagcatatagaaacctttgtgctcactttctcagatccacaaatgttctctatggctgctggctcctcagccccagcagcgctgtctcatgttgctgaagcagtgtttata

SEQ ID NO: 66341 - DNA, 454 bp, Zea mays
  Clone ID: LIB3076-028-Q1-K1-D4
tcggcggcggcggctagatggtgcagttcctcacgtaccggaagcgtcacagctacgctacgaagtccaaccagacccgagtcgtcaagaccccaggcgggaagcttgtgtaccagtacaccaagaagagggcgagcgggcccaagtgccccgtcaccgggaagaaaatccaggggatccctcacttgaggcctgctgagtacaaaaggtccaggttgcctaggagccgcaggactgtgaaccgtccttatggtggagtactctctggaattgctgttagggagagaatcattcgtgcctgcttggtcgaggagcagaagattgtcaagaaggtcctgaaaatacaaaaggccaaggacaagacagccgcaaagtaaatctccaggaatggggaagcctagccctgttttgtacactgcgaaaagtaattttggtggatggaaaatctaggtgc

SEQ ID NO: 66342 - DNA, 198 bp, Zea mays
  Clone ID: LIB3076-028-Q1-K1-D6
catcacatatctttattttggtttatttttttttttatatttgatttttgttttttttttctcttttttttttttttgtttttttttttttttttttttgttttttttttatttctttatgtttttttctttttttttttgttttgtttgttttttatttttattttctttttgattttgtttcttatttttctcttt

SEQ ID NO: 66343 - DNA, 228 bp, Zea mays
  Clone ID: LIB3076-028-Q1-K1-D7
cttttgctgaaggtcgttcgagcttttctttggagtatggcatgggttacatacttcagggccgtatcgcctggtatgagcctcgtggagaatcaatggctagaccacggggctcatacttcagcgctgcaacgcttggttctctgacctcggctcgaggcattttctctaccccttcttaccctgaaaaagcaaggtcaccttgtgtccttaaacctattaccatct

SEQ ID NO: 66344 - DNA, 370 bp, Zea mays
  Clone ID: LIB3076-028-Q1-K1-D8
cggacgcgtgggctacactactggatatctttaagcttcagcctcatcagaattttggccttccattttagcaaatactatcggtgtacccattttatttgcagtttgtcttcaaattttatttcatgtaatataaacactgtctataatattttcaatcctttttatgatcaacaatatatccatctcaaatatggaagctaaggcaaaggaatttaatgaggtcatacaagaacagtattatccttggtttgcacaatacatggtcatgaaaagggcaagcattgaaccaaatttccatgatttgtatctgaagttctttgataaagtaaactcaaaatccttgaacaaggaaatactgaaagccaca

SEQ ID NO: 66345 - DNA, 199 bp, Zea mays
  Clone ID: LIB3076-028-Q1-K1-E10
gcacgggcaccggcacggcacgggcaccggttataaataaccacacaccctcaagggctgaaccgaaccaagcagtaacattaatgacccactctactactcgaagttactaccagcagcttgcttcatcagtagaagagagcgagccgaggatggcgtcaccgaatccttatgatgccgccctgctatgtgctggcgg

SEQ ID NO: 66346 - DNA, 204 bp, Zea mays
  Clone ID: LIB3076-028-Q1-K1-E12
cccacgcgtccgtttccgccggctacgagtttcgtgtgacatctgccacggtccgatagggttcgatcaatacctgtagcgggcggacctgcacctctgcgaggtatgctaccgtctagtggcggtctttgggctaagcgcgctcgctgagcacgcgcgctgcgactggctgctccataccgcctgtggcacgccctcgtacgt

SEQ ID NO: 66347 - DNA, 348 bp, Zea mays
  Clone ID: LIB3076-028-Q1-K1-E5
ctctttcctcgcgagcgacgcgcgcttctcacccgcatcgccgatggagacgccgctgtccaccaggaggatcacccgctcgctggccgccgcatccgcccagaagagcgccgccgcagggatggactccgccgccctcttctccctgtccaagaacgccgtcgcaggggagacacacgtacagacgcgcgcggcccttcacgacatcaccaacgactcccccgtcgtcggcctcgccgcgggcagccttcacgccaccgacaccacccccgccaagacccgccgcagggccccgcgctgcacgccaggctccggggaggcgctcctgcgcggccaggtcaaggcgct

SEQ ID NO: 66348 - DNA, 438 bp, Zea mays
  unsure at all n locations
  Clone ID: LIB3076-028-Q1-K1-E7
cggacgcgtgggcggacgcgtgggttttgtgcacataaattggaacaaagctggagcttcggaccaagctggaccgaaatcttttggtggtgatggttggaacaagggtggtgatcagaatagcagttggaacagtcctggaaattttggaggtgggcgtggctttgggcgaggacgagggagaggtaggggtcgggaatctggagatttcaatggcagaaatgatcaaggaaattgaaagaattcatggggtggtgacaatgctgaaaaatcttcttggaggtctgataatcaggtagacaatgaagctggagattctggtggatataggggacggngaagaggaggaagggggcaatatggaggacgaggaagaggcagagacaatggttggagaaatggtgatggaccanaatgggatggtggagataattggac

SEQ ID NO: 66349 - DNA, 421 bp, Zea mays
  Clone ID: LIB3076-028-Q1-K1-E9
gtaagtcatttatagctactgttcatcaccatgccatcttatgtctccaacttctatattcctccagcagcctgtctagcattctctttttgaaacctgggaactcaaataaagcttatatttcctactttaggctctagtgcccaatcaaactttatctggctctttaatcttcctctaggcttatggtaagaacttgaacatgtgttcttttttctttttaagtttggtgttaattgcttttccaagagaaaaaaagatagttgtattgcgctttagtctttaataatcaaatgtggcaggttcatgtcagcctgttctatttaccaccatgatgcagcacatgtgattcaacatagaagtatttacatttacaactccgtttattaaggattcatgagctaacattttattgacattt

SEQ ID NO: 66350 - DNA, 453 bp, Zea mays
  unsure at all n locations
  Clone ID: LIB3076-028-Q1-K1-F1
cccacgcgtccgcacccttggtgctaggcaaatctttcttcaagatctttcgacattctaggtggcctttctcgtcttatggtacccccattatgttattactttatggatccttcagagaggtgttcattgcgatgaatcgactttgtcgacctcatgtatagcttatctatacagatatatctttgttgtttatcttgaatgtgtgcaacgtagatgatcaatctcgggctactttgtttttagatttaacatcaatgcactttatatcagcttggttgttgaagaaagaaaacagatgatggtgaaaaggataatctaactaatccaagtaatccaatgcacatcatgaagctnttggttgtttaactttttggcaaaatttcattgatgctagagaagaaggcatcggcctgagcttctactgacctagtgtatggtctattaattata

SEQ ID NO: 66351 - DNA, 235 bp, Zea mays
  Clone ID: LIB3076-028-Q1-K1-F10
cccacgcgttcgcacacgtcggtccaaactcgctctgtacgctcgcggcttctccaaccaaaggggtgcagccaaatacggagggtagcgaagcacggggacgacgccatgagccgcgcgctcctctcgcacgtactgcaccgtccgccgaacttcgcgtacacctggagtggctttgctgcccgaggaggactgctcggttctggcatacaaccactgggtcgtcaaaattgca

SEQ ID NO: 66352 - DNA, 397 bp, Zea mays
  Clone ID: LIB3076-028-Q1-K1-F11
cccacgcgttcgcacacgttggtccaaacacgcgttttccgctcgcggcttctccaaccaattccgagcagtcaaatacgaatgggagcgtatcacggagacgactccatgagccgagcgctcctctcccacgtcctccaccgtccgccgcacttctcgtacacctggagtggcgatgctgcccgaggcggactgctcgcttctggcatccacccactaagtcgtctcaatagcagcgcggttgaagcctttccaggccccaccgaggatgcgcctgctcctcaagccaggaagagaagactaatttctggtgtacagccaacaagatccggtcaccttagaaattatctaggggcaaatcctaatttggttggactataggattcatatgagacat

SEQ ID NO: 66353 - DNA, 414 bp, Zea mays
  Clone ID: LIB3076-028-Q1-K1-C3
cccacgcgtccgcccacgcgtccggttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacgacgttgagctcggcaagctgctgtc

SEQ ID NO: 66354 - DNA, 390 bp, Zea mays
  Clone ID: LIB3076-028-Q1-K1-F12
atagcctggcgcgcgggccgaccttacagcgtgaagcgcatgcttctgtgcgcggcgcgcatcgcgccgagcgcggtcaacccgatcacagagtggccgagcctgacgcgacatactcctgaccacgtgcacttgtctgggcagcggctgcagcggaggcggaacggctcgtgcgcctcgtgcggcatggctggctcaggtggagagctcgcttgtggcatcgaacgaatctgtcgtgagaatagcagcgcggttgagacaagcaaaagctctatcgcggaggcggctgctccttaggccagggagaatggagtattttctggtgtacagtcaacaggatccggttaccttggaaattatctaggggcaatttataattggggtgcactt

SEQ ID NO: 66355 - DNA, 152 bp, Zea mays
  Clone ID: LIB3076-027-Q1-K1-H4
gccaagccttcggccaagccttcggccaattcttccgttgaccagcggattaccatgggtgggccctatggccttggccaggtccattttcctgaacctaattcctgggaacttgcacccaccttttgaaccataatttggttttccaaagg

SEQ ID NO: 66356 - DNA, 434 bp, Zea mays
  Clone ID: LIB3076-027-Q1-K1-H5
cgctgctaaagacaactcagtctgggtttgaagggtttgtgacggatcgctataggcttcgtcctgatacaagggaaaggatagtagcaacagaagtaactgcttggtggaggtatccctttgaacatgtttcgcagctcccatcgaagccattctgcttcacgcagagataccaggacgtaaagaaagtccttgcagagacgttctttggtcctccggatgttggtgtgtatagtccatccgtacaaaatacgctatacctcatggccaaggaagtccttacaaggtttttcccagatatatcgtcagtccagcttagaatgccgaaccttcactttctgcctgtcaacttggggaccaaagaagctccgctggtgaagtttgctgatgatgtgtacctgccgacggacgaaccacacgggaccattgaagca

SEQ ID NO: 66357 - DNA, 286 bp, Zea mays
  Clone ID: LIB3076-027-Q1-K1-H6
atttatacattgaatctacatgatatatattcggtacatttgcccatggaacttaggttatttgcccatcaaccgaatatatatcctcttgattgaatgcatgaatgatatacgtattactcctttgatagtattaggaacattcctaaaactgtcggtgtatgacagacctatagataggcatgaaagctcattggctgaactatatgggtttgtgattaagattgtgtgcttaatcgatgctaaagcatatagacgctcaatatgttccgatgacacacgatta

SEQ ID NO: 66358 - DNA, 281 bp, Zea mays
  Clone ID: LIB3076-027-Q1-K1-H7
atttatacatcaaatccacacgctttatatttgctacattagccactggatctagggttagttgccaatcaaccgaatatatatcctctacattcaatgcatgaccgataatgaatttctcctttcatactatttggaacattcctaaaactgtctgtgtatgacagacgatatctatacgtctaaacctcactggatgaactatatggctacctcatggtgatggtttacttcatctatgccaactcatttagatctactgatatgactcaattacacat

SEQ ID NO: 66359 - DNA, 446 bp, Zea mays
  Clone ID: LIB3076-027-Q1-K1-H9
ggcccctcccacaacccgagaacatccgcctcccgttgcgcaattcgactagaaaacccggcagcctgcacctcggggacgcctgctcggagggatggagtgccacgccctacagtgatttctcccccgctccgatccccggcgcatgaccgggtcggctggcctatgcatcgcagcaggagttgtcgtcgattgcccctgcctgccccagttaatcccgcccggtcgcaatccagcattagaggcgccgatctcctgccccgtcctgccctgtggattatcgacagcggcgccggataccacggaagagaaggaagacaaggaaggggccgaaactaacttgcttgtgccggggcaaggacgagatcgagggcagccgagccggtacccgaaactctaggcgaggttcccacaatagaagtatacccaatggatcgtggagggtc

SEQ ID NO: 66360 - DNA, 236 bp, Zea mays
  Clone ID: LIB3076-028-Q1-K1-A1
gcatcgtatgtgagcggctggcagtagcgggccgggatgttattggtcttgaccgtaccgtgtccgatggggacgtttgcgaatgacgtgttgtccagcaccgtaaactaggtcgcggtatcgaccctgggtggatgaacggtcgctgagcgcgatcagcgccgtcgtgccgacacctgctacgacccacagactctggctgattgacttggattgcatcattgaactcctgtttg

SEQ ID NO: 66361 - DNA, 215 bp, Zea mays
  Clone ID: LIB3076-028-Q1-K1-A11
tcccgaaccccagttccgacctaggcgtacgcgtccggcagccacactaggagcagtccatccgtttctcgctgtcctccgctgtccgctggctgcggctctaacccaatccaaggaggatgccgacgagcccgcagctgagcctgagcggctgcagctctctctgctccctgtccagcaccagtacgagccgcgacagcgccgccctgaatgcg

SEQ ID NO: 66362 - DNA, 338 bp, Zea mays
  Clone ID: LIB3076-028-Q1-K1-A12
gcgtgactgactgaaactgagcactagggctttgagagtgcagcagaggagggcgaaccatgggcgaggaggagaaggcgaaggaggcggcgtccccggccgacaaaggaaaggaggcggtggagaagaagggcgaggggtgaggaggtgtggagatgattttctatggcttgttttttttaaatttatttatttttgtatgttattattttttgtttttaatttatatttttgtgttattgtttgttttttttatattattttttttttttattttgagttgttttgatttgtttattggtttatatttatttatttttttttattttttatttttt

SEQ ID NO: 66363 - DNA, 466 bp, Zea mays
  unsure at all n locations
  Clone ID: LIB3076-028-Q1-K1-A3
gcatcgtatgtgagcggctggcagtagcgggccgggatgaaattggtcttgaccgcaccgtgtccgatggagacgtcggcgtatgacgtgttgtccagcaccgtaaacgaggtcgcggcatcgaccctgggtggatgaacggccgcgagcgcgatcagcgccgccgtgccgacacctgctacgacccacagacgctggcggattgacgtggattgcatcattgaactcctggttggaaaaaggagaaaagggcgcgtttgagcatgcggcgcacgtgtcgcgccgaccggcggcgcgggctagaacatcgtctcgatgcccgcatagacaccggtttggccgtgacccggcgccgggttcgtgccccagccggcgttcctcggccccagccccgggctctgcggattgacgccgaaattggcattggcgctgntgaacacatgcgccgccatgctgtacaggaacg

SEQ ID NO: 66364 - DNA, 365 bp, Zea mays
  Clone ID: LIB3076-028-Q1-K1-A5
gcatggtatgtgagcggctggcagtagcgggccgggatgaatttggtcttgaccgcaccgtgtccgatggagacgtcggcgtatgacgtgttgtccagcaccgtaaacgaggtcgcggcatcgaccctgggtggatgaacggccgcgagcgcgatcagcgccgccgtgccgacacctgctactacccacagacgctggcggattgacgtggattgcatcattgaactcctggttggaaaaaggagaaaagggcgcgtttgagcatgcggcgcacgtgtcgcgccgaccggctgcgcgggctagaacatcgtctcgatgcccgcatagacaccggtttggccgtgacccggcgccgggttcgtgcc

SEQ ID NO: 66365 - DNA, 387 bp, Zea mays
  Clone ID: LIB3076-028-Q1-K1-A7
gtaccggttcgcaggtcgacgcatgacatgcgcgcgggtggcagtagcgggccgggatggaattggtcttgaccgtaccgtgtccgatggagacgtcgccgtatgacatgttgtccagcaccgtagactaggtctcggcatcgaccctgtgtggatgaacggccgatagcgcgatcagcgccgacatgccgacacctgctacgacccacagacgctggcggattgacgtggattgcatcattgaactgctggttcgaaaaaggagaaaagggcgcgtttgagcatgcggagcacgtgtcgcgccgaccggcggcgcgggctagaacatcgactcgatgcccgcatagacaccggtttggccgtgacccggcgccgggttcgtgcccc

SEQ ID NO: 66366 - DNA, 317 bp, Zea mays
  Clone ID: LIB3076-028-Q1-K1-A8
ctcgtctcatctcatctcaagagtctactagatgagagaggaagagaacaagcgataagctcatctcgcacgcaagatgcgggctccaaggggcggaggcggctgccgcggcggccaggagcatgtggagctgatccctggcatccccgacgacgtggccgtggactgcctggcgcgcgttccccacgcctcccaccgcgcgatgcgccgggtctgccgcggctggcggagcgccgccgtcgtgccggccttcgcgtcttcgcgcgccgagtctggcgccaacgatgacctcgtgtaccttatgcagttcgggaacc

SEQ ID NO: 66367 - DNA, 165 bp, Zea mays
  Clone ID: LIB3076-028-Q1-K1-A9
acgggagtcgcatttcgagtggtcgagtccgtccgtgtctgtccttcgctgtccgctggctgctgctctaacccaatccaaggaggatgccgaggagcccgcagctgaacctgagcggctgcagctctcttttctccctgtccagcaccagtactagccaggaca

SEQ ID NO: 66368 - DNA, 316 bp, Zea mays
  Clone ID: LIB3076-028-Q1-K1-B1
gctttggaacaaaatgaggatctaattagaactgaaaatgaagctgatgtatctgcagcacaagatgctggatatcagaaatctttggttgatagattgacattgaagccagataagatagcaagccttgcgaaatccatacgcactcttgcaaatatggaagacccaatcaaccagatactcaaaagaacagaggttgctgaagacttagtgcttgaaaaaacatcttgccctctgggtgtgctgttgattgtttttgagtccaggcctgatgccttagtccagattgcgtctttagcagttcgaagtggcaatg

SEQ ID NO: 66369 - DNA, 281 bp, Zea mays
  Clone ID: LIB3076-028-Q1-K1-B11
gtggccgcttcgatgtacctgaccgccgtttccttcccccccgcagccgccttctcgtgggcatcccagaagctgctgcctaggtcggccggggtcggccggcgtctggtggtgcgggcagacgtcaaggtcatatcgacgggcgaggcctgccgccgcgggctcgccgccggcattgacaagctcgccgacgccgtcagcgtcaccctcggccccaaaaatgttcattgcagggaggaaggtggtattgaccaagatgatgtccctaaagtattaatgat

SEQ ID NO: 66370 - DNA, 128 bp, Zea mays
  Clone ID: LIB3076-028-Q1-K1-B2
gctttggaacaaaatgaggatctaattatttctgattatgaagccgatgtatctgcagcaggagatgcttgatatcatatatgcttggttgatagattgactttgattccagaatatgatagcttgcc

SEQ ID NO: 66371 - DNA, 432 bp, Zea mays
  unsure at all n locations
  Clone ID: LIB3076-027-Q1-K1-H3
cttccttgtttgaccaggttctggagctcgtcggtaatgctgccagggacaacaagaagacgtcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatcctttgatgtttagcagtaccttgttaccagtatgcggtgatgcgtangctgcagatgggacgaatgtgcttgtatgtgtatgtgtcctgctgcaagttgtcctttgctatttagaatggaagaagaaatgccttgtttc

SEQ ID NO: 66372 - DNA, 266 bp, Zea mays
  Clone ID: LIB3076-028-Q1-K1-B5
tcgaacacacgtgggctgcaatgagttccgaaaatgaagctgatgtatctgcagcacgagatgctggatatcagaaatccctgggtgatagattgacattgaagccagaaaagatagcaagccttgcgaaatccatacgcactcttgcaaatatggaagacccaatcaaccagatactcaaaagaacagaggttgctgaaaacttagtgcttgaaaaaacatcttgccctctgggtgtgcttgtgaatgtttttgagtccaggcct

SEQ ID NO: 66373 - DNA, 240 bp, Zea mays
  unsure at all n locations
  Clone ID: LIB3076-028-Q1-K1-B9
gnggccgctacgacgcacctgaccgccgtttccttcccccccgcagccgccttctcgtcgggatcccagaagctgctgcctaggtcggccggggtcggccggcgtctggtggagcgggcagacgtcaaggacatatcgacgggcgaggcctgccgccgcgggctcgccgccggcattgacaagctcgccgacgccgacagcgtcaccctcggccccaaagatgttcattgcaggggagga

SEQ ID NO: 66374 - DNA, 313 bp, Zea mays
  Clone ID: LIB3076-028-Q1-K1-C1
cccacgcgttcgcccacgcgtccggttctttcgcccacagccaaatttttctccactcaatggcggcataagctgcactgcagccatggacgccagcggagccggtagcaaggcgaagaagggggcggctgggcgcaaggctggcggccccaggaagaagtcggtgtcgcggtccgacaaggccgggctgcagttccccgtcggccggatcgggcgctacctcaagaaggggcggtacgcgcagcgcgtgggcaccggcgcccccgtctatctcgccgccgggcttgagtacctcgccgtcgaagtgctggaa

SEQ ID NO: 66375 - DNA, 387 bp, Zea mays
  Clone ID: LIB3076-028-Q1-K1-C12
ctcactccacccctgcggccattggtgcctttggttcatgcatagtgtgcacaagaaataaggcggcgtctctcgagtctaggaaagcccatgacagccactggacttctgtcactgactacagtatgtcacggtctaacaccttaccaaaaacagcgaccacaggtagccgctcattaacgttgccatgcaatctgtgccgtcatttatcgttaggcgagatccatgctggctccaataacttagaccaagcctctctactcggaaaaggctgcattgtaaacatgtgccttgtaaagatatacagtggcacgatggtggcgatcaatcgcgggaacccgacgtcttaacaaggcgttcactagtttcagactgagatcgatatgc

SEQ ID NO: 66376 - DNA, 401 bp, Zea mays
  Clone ID: LIB3076-027-Q1-K1-E2
cggacgcgtgggaaaaattcggaggagaattcaagaactccaggaatgccgatctgctggatgccgcacactggctgaagcaaagatacacatagagcaaaagaggaaaaaagaatacgagctgaatgcgcaaaaagctaaggatagcagtcaacttaatgcaaataataaatcagtacaaaagatgaatcgacctatgaaaattgagtccgatgggaatttggatccaaagaaaggtggcactggcttggattctactaagacaacaggacctacaagtgttaagcactggggggatgactgggatatagtcggtcttactggggcagagctattaagtgctagcgaaaagcttctatgctgtcagaacagattgctacccaaccattacctgagaatgc

SEQ ID NO: 66377 - DNA, 304 bp, Zea mays
  Clone ID: LIB3076-027-Q1-K1-E4
acctgttgtgcagccagagccttctatcaaaggacctaatatggtttagggtccattttggaaaccattgccccggggcccttaatttaaaaacccagccttgcaaatagcagtattccgccatgtggtctctggaatataattccccattaccatatataactttgttcccctttctagcaggttaacagttttggacactcagcttcctgttaaacaagcatttaaaataatgcatgatgagggtcttgctctggttcctctttgggatgaccgtcagggaaccataacaggcatgctcact

SEQ ID NO: 66378 - DNA, 183 bp, Zea mays
  Clone ID: LIB3076-027-Q1-K1-E6
gagatctctcagtcatggatatgtttgcttttacactatgccaagaaaacaacagggccggtgtcttttataacttgcaagagcctggaaacattgcaaaggctattgtcggtgagaaggttggtacattcattatatgcacaagagatcatgtgctacatggaaacacactggttcaagaaa

SEQ ID NO: 66379 - DNA, 183 bp, Zea mays
  Clone ID: LIB3076-027-Q1-K1-E7
cacacgcgtccgcccactcgacctttaatgtgacagtatcatcagataacgccagagcacagtgtctttttgaacgggcacgagcctgaaaacattaccaacgctattgtccctgagaaagatcttaccctcatcttatgcacaacagatcagcagctaaatgtaatcacacaggttcaataa

SEQ ID NO: 66380 - DNA, 174 bp, Zea mays
  Clone ID: LIB3076-027-Q1-K1-E8
tctggaatattattacacaataccatatattaacattaatcccctttctaacaagttaacacatttagacactcagcttcctgttaaacaagcatttaaaataatgcatgatgaggatcttgctctggttcccctttgggattaccgtcaaggaaccattacaggcattctcac

SEQ ID NO: 66381 - DNA, 346 bp, Zea mays
  Clone ID: LIB3076-027-Q1-K1-F11
ttactctttctactctttattgttatacttttaccccaaatcttctaatggccttcgttattttcttcgtcattatgttaataccaatattttctcaccaccactacttacatttcttcctattccatctatgattctttgtatcttttttcaataattcttacatattatcctaaatcaagaatcatttctcatcattctctatatcacaattacttttcatcgttaccttctccaacaataccatcacatcttctaatgtcactttctaaattatatcaacataataacaatattccctatcttaaccttcatcatatccctcttattctctattcttcaataa

SEQ ID NO: 66382 - DNA, 469 bp, Zea mays
  Clone ID: LIB3076-027-Q1-K1-F9
cggactcgtgggcggactcgtgggtttcgtatgcacttgggaccccaaaatcttctcaatggcctgacgtggtgtatcttcgggattatgttgaataccaatatgttgctgcaccaccgctacgtacattgcttccgatggccagcgatgatgctttggatcttttgtcaagaatgcttacgtatgatccgaaagcaagaatcagtgctcagcaggctctagagcacaggtacttttcatcgttacctgctccaacaagaccatcacagcttctaaggtcacggtggaaaggagatcaagggaataacaagatgcccgatctgaacctgcagcatggccctctggtgctctctccgccaagaaagttacgtagggtgatagcgcatgaatggatggaaagtatgcacagagcagattaagtggacgagcattcttctgggatgaggcacaccgatgacatgcccaatca

SEQ ID NO: 66383 - DNA, 466 bp, Zea mays
  Clone ID: LIB3076-027-Q1-K1-G11
cccacgcgtccgcggacgcgtgggcgcacattccaggaggcaaaccttctccatcaggggtggaagggcctacactgctcgagaaatcgcctgagctcaagcggaggtcctcttgaactgtgacatcgaattctgaggttggtgatgatggctgtctctgtggagtgtctgaatatggtggtgacaagggaaatggtggcccagtcttgtggtagctgactctctctccaggtagcaggacgtgctgtgtttgttgatcaatccaagtatcaaacggacctactatgttcatgtgaacttcctcaagtgctagttaaaaagttttcatgcttctgtcatgagattatgatcctagtagcatccttagcacacttgaaacgttgactcgtgtcctagtgtcgtttgtgttagtccatatgtgaacaatgattcatgttggaacatgctagctaacaccagatgattc

SEQ ID NO: 66384 - DNA, 424 bp, Zea mays
  Clone ID: LIB3076-027-Q1-K1-G12
cccacgcgtccgcaccacacctcccgaactccgaactacaagtttcgcttctcgtctcggcgactgggcgagaccgtcggcgccgcctgagttctttagaaatggctgatggtgaggacatccagcctcttgtctgcgacaatggcactggaatggtcaaggctggttttgctggcgacgatgcaccaagggctgttttccctagtattgttggccgtcctcgccacactggtgttatggtagggatgggacagaaggatgcgtatgttggcgacgaggcacagtccaagagaggtattctcacgctcaagtatccgatcgagcatggtattgtgagcaactgggatgacatggagaaaatctggcatcacactttctacaacgagcttcgtgttgccccagaggagcaccctgtgttgctcac

SEQ ID NO: 66385 - DNA, 294 bp, Zea mays
  unsure at all n locations
  Clone ID: LIB3076-027-Q1-K1-G4
ctccaattccctcgtagcaaccagcaccaccttaagtttccttcttttccgccggcaatttctggccgcggcaaggccggcaagggcctgggcaagggtgcccccaaccggaaccgaagggtgctccgcgacaacatccaaggaatcacgaagccggcgatccggaggcttgcgaggaggggcggcgtgaagcgcatcttcgggctcatctacgangagacccgcggcgtgctcaagatcttcctcgagaacgtcatncgcgacgccgtcacctacactgagcacgcccgtccg

SEQ ID NO: 66386 - DNA, 437 bp, Zea mays
  Clone ID: LIB3076-027-Q1-K1-G5
ctgacgcttggggtcttcgcttgcctcttattaagggaaatcagttctagaacttgtggcgtgaatctgacactgtactggagatctggcaaaagaagctgcgcacgttctggctctagacttcattgaaagtgtgattaagaacaaccaaagcataaatgggcatcacaagaacataaccttcatgtgtgccgatgtgacatctaacgacttgaagattgaagataactctgttgatctgatattttcaaactggctattaatgtatctttcagatgacgaggtccaaaaaagcttgtggcgaaaatggttaaatggttaaaggtctgaagccatattttctttagagaatcatgtattcaccaatctggagattccaaaaggaatgtgaacccaacacactatcgagaaccaaggttttataccaaggtatttaa

SEQ ID NO: 66387 - DNA, 433 bp, Zea mays
  Clone ID: LIB3076-027-Q1-K1-G8
cccacgcgtccgcgctcgtgctcctcctggccctgctcgccggaggccagtgccgagagggccagctcgacgccgcggacgccggcaccggcacggagaactacaccgccagcgacgccgccgtgtactggggcccctggcagagggcccgggccacctggtacggccagcccaacggcgccggccccgacgacaacggtggcgcgtgcggattcaagcacaccaaccagtaccccttcatgtccatgggctcctgcggcaaccagccattgttcaaggacggcaaggggagctgcggctcctgctacaagattcggtgcaggaaggacccgtcctgctccgggcggacggagacggtgatcatcaccgacatgaactactacccggtgtccaagtaccacttcgacctcagcggcactgcgttcggcaggct

SEQ ID NO: 66388 - DNA, 420 bp, Zea mays
  Clone ID: LIB3076-027-Q1-K1-G9
gaataatctcttcttcacctcactaacaccagctagcaactctttctctcctgcaataatgtccgctcgctcctcctcctggcagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgtcaacatccccggcaagtgcggcgtctccgtcggcgtgcccatcagccc

SEQ ID NO: 66389 - DNA, 444 bp, Zea mays
  unsure at all n locations
  Clone ID: LIB3076-027-Q1-K1-H1
gcctcagcaaacagtgaaggcatttactcctgcgaacccagttggtctaaaaaatccgggagaatagcagcaacctaataccctaggttcccagctttacacgggcactgcaaatcaacagtatccttctggaccatctgcttcttatccaagcggacctccaacaacatttcatcagcctgtatcacctgttcaatatcagcctgttgctccaccagtatcttcttttggtccgagcgctcctgtaccagcaacagtccctaaccagatgtttccccattctgctgctgctaaaaactcaacttcaaggttcatgccatcgaacaatcaaagctttgctccgaggccaggtctaagtcccgcacagccctcaagtccaacacaggtgcaagcacagccagctnctccttgcaccgccccgactgtgcagacagctgatacgac

SEQ ID NO: 66390 - DNA, 463 bp, Zea mays
  Clone ID: LIB3076-027-Q1-K1-E12
caccagtctccctcgcacctccttcaccacctctccaaatctcgcccatctggagccagggggcgcggagggccgcgtacaggagaagagggggtatggagcccgccgagcgaatcgagtccgggacggcgctggggaagcggccgaggagcagggcgctgccgcggacgcccagcatggtgacggtgccgtcggcggcgaatcaggggcgccaggagcggcgcgccgtctcgctgccggctgccggcactgggacgggagccgctgccgccatgccggtgggttactgttactactacggcggctcattcgccgcggtggagactgcggccttcttgaaggcgtgcggccgatgcatccgtcgtctcgggcccggccacgacaccttcatctacaggggcgaagtggcgttctgcagccaggagtgccgggagaagcggatccagtacgacgagcgcatgga

SEQ ID NO: 66391 - DNA, 85 bp, Zea mays
  Clone ID: LIB3076-027-Q1-K1-H10
aataacctcttccgacgcactctatcctacacacctcctctccacctcactaacactatctactacctctatctcttctattata

SEQ ID NO: 66392 - DNA, 124 bp, Zea mays
  Clone ID: LIB3076-027-Q1-K1-H12
cccactcgacctaacccacaactcaaccctacaacatcccttttccactttacacctccacaattaaaccagacatccgtaaaattttaaacgccctcccacctctcaaaatcaccacactcat

SEQ ID NO: 66393 - DNA, 283 bp, Zea mays
  Clone ID: LIB3076-027-Q1-K1-H2
atacctcaaactcatatatctacatcttcaaccaccttctctaacactatttccctttccaaaatttcccatccatctattacatccatatcaatctcaccaaccttcactacaacttgtaatacattcttattcaatcacaacaactattaccctttcatttacattaacttctactccaactatccattatttcaatacttcaataaacactacttctcttcctactatattcacttcatcaattacccataatactcctatcttacttacacaattaaca

SEQ ID NO: 66394 - DNA, 296 bp, Zea mays
  Clone ID: LIB3076-027-Q1-K1-B5
gacccacgcgtgcactcataccccactacactaaccacactaccagtttccgttacacgaacctaccgaaacactgttgagatgactgcattgcactagccgcggcccatacaaaacatcctccccctcatcccctcctccatccccaactcttcaccaccatcaaccgtcctacaaatctatctacttatcttattgaataaaccacgaaataaatacccttgaatatattcatgcccttcttttcaaaatattctacttctacccttcaaacatcttcatcatattcatctttt

SEQ ID NO: 66395 - DNA, 452 bp, Zea mays
  Clone ID: LIB3076-027-Q1-K1-B8
tacatgatccgtgctattccaagcaatgcatcagacaatgtctattgcaccctgctcgcacatagtgccatgtcatggtgcaatggcgggatacagctgtacagtcggaatggttaatggcaggcatgcatatataccatttcatagggtaacatctacaaggaacaaggtgaggataactgacaggatgtgggcgaggctgctgtcttcaaccaaccaaccgagtttcctgagccagaaggacatcgacgcggccagagaagccgacaaggcggccaaccgcatgaagagcagagaggacgtttcgaagaagcaatctacaccagtgttggcaaatggtgagaaatagtgtgcttttgacggttctttgttgtatgcagtagctgctgcaagctggctgagatcagtaggccaaaactgctaggtcgatgagttttacttccaattgcatg

SEQ ID NO: 66396 - DNA, 267 bp, Zea mays
  Clone ID: LIB3076-027-Q1-K1-B9
tagccagcaccccagggtgctttataaattttaattaacttcaatctaactggaccaacgccaatttttaaaggcagctggatctacataactacaccatgctttactagatgatcatcaaccacaacttacatactaatcatgcaactcattattacattccctcagctcaatacaactcactgatcttcttatacaatctatctttcaaaactatatactaccggacctaatcatctactattcatattcccattacaactaatc

SEQ ID NO: 66397 - DNA, 457 bp, Zea mays
  Clone ID: LIB3076-027-Q1-K1-C10
gaccgcactcgtgcggtggaactatggaagctcttaatgttcgctttatcagatacacctgttgtgactttctgggatttttgtataatggattctggaaattgcacttttttcactggaaagtgcgaggcatcaccatatgatgatataagacattggtccaagttcccatcatttactcctcttctgcctcatattgagacacatggtggcaagtctctggactttagcaactatccttatatatttatgagatggaaagagcaatattttctcaactttggagtctactgtggcttaaccatcactggattctactacatacgcttttcttgtaactatggctccattaatggattttattatgatccaaatagcaaaccatttcataagcttttaacttaagagtactcaatgagaaaaaattccagattcaccttttcattcttacaacttt

SEQ ID NO: 66398 - DNA, 389 bp, Zea mays
  unsure at all n locations
  Clone ID: LIB3076-027-Q1-K1-C2
ttccctatcgaccgacgcgtacggttctagatcgcgagctgccgccctttgttttgttttttntgcntttttttttttttttagatttgttttaaatggaaggttgcctgccttttttttttacaacccaaccattattttaaaaaaccctccaattacattatccatcccctcaaatccattgccattctttaatactttaaaacacacccacccttttaatttatttataacattgtcattccaaaacccccaacccatattcatacatatttatttaaatatatatttcaccgataaactttcaaagccacacaccaagtccaaattccttcaaaatcttttattccctaaacccttcttttgtaaaaaacttaccccattctttt

SEQ ID NO: 66399 - DNA, 360 bp, Zea mays
  unsure at all n locations
  Clone ID: LIB3076-027-Q1-K1-C3
gggatgttggaggtcaggacaagatcaggccattgtggggcactatttcagacacccgggccttatctttgttgttgatagcaatgacagagatcgtgttgttgaagcanaggatgagctccacaggatgctgaacgaggatgaattgagggatgctgtcttgctcgttttcgcaaacaagcaagatctaccaaatgcaatgaacgctgctgagatcaccgataagcttggtctccattccctgcgccaacgccactggtatatccagagcacttgtgctaccacanggnnagaaagtttgtacgagggtcttgattggctctncaacaacattgcanacaaggcctgaatggacaattc

SEQ ID NO: 66400 - DNA, 408 bp, Zea mays
  Clone ID: LIB3076-027-Q1-K1-C4
gctttcaaaacttttttggcccttcaaatgtgttctacgcataatgaagtcaagattccagtaggcgtatattaggagaggagtgcgcatcttgattcaatccatgtcaagtcagaggctgattccagattatcccatgcaagtataattagatggtactgtcttgctcgtttcgcatacaatcacgatctaccaaatgcaatgaacgctgctgagatcaccgatatgcttggtctgcattccattctccaactccactggtatatccagagcacttgtgctaccacaaaattagaaggtttgtacgatggtcttgattggctctccaacaacatttgctacaatgcctgaatggacaattctgctgtttcacggaacacatcttcacatggcgagtcatggtcattt

SEQ ID NO: 66401 - DNA, 342 bp, Zea mays
  Clone ID: LIB3076-027-Q1-K1-C5
gcactcgatgttggaggtcatgacaagatcaggctatagttgaggcactatttccagaacacccagtgccgtatctttggtgctgatagcagggacagagatcgtgttgttgaagcaaacgatgagctccacaggatgctgaacgaggatgaattgagggatgctgtcttgctcgttttcgcaaacaagcaagatctaccaaatgcaatgaacgctgctgagatcacctataagcttggtctccattccctgcgccaacgccactggtatatccagagcacttgtgctaccacaggaaattaatgtttgtacgaaggtcttgattggctctacaacaacatt

SEQ ID NO: 66402 - DNA, 431 bp, Zea mays
  Clone ID: LIB3076-027-Q1-K1-C7
ctcatcgcttcgcagatccgtacttctatatgcctcaacaatcgtcagtgacggttgaatgaagcacaaggacacaaacagcaaacaatgacttgtgtttctggggtgaccagaatgctatgtacggcaatccaagtgaccaacaacagggtttcaactttggacaaaacccatcaagttggttgaaccagccatttccccaggttgaacagccacgagtggtcaggcctcatgcaacggttgctccatttgatctggagaagactagagaaggaagtggcttcaagaaaatttttgggttccaagttgatacaaccagtccatctcctgtccaattgagctctccattgcccgctatccaggagcatgtgttacaaactcgaccatcggcaccggtgaatgaattgcaacctgtgcaaattgagtgcttg

SEQ ID NO: 66403 - DNA, 389 bp, Zea mays
  Clone ID: LIB3076-027-Q1-K1-C8
gactcgtacgctcatcgcttcgcagattcgtacttctatatgcctcaacaatcgtcagtgacagtgaaatgtatcacttggacagagacagcagacaatgacttgtgtttctggggtgaccagaatgctatgtacggcaatccaagtgaccaacaacagggtttcaactttgtacaaatcccatcaagttggttgaaccagccatttccccaggttgaacagccactagtggtcatgcctcatgcaacggttgctccatttgatctggataagactagataaggaagtggcttcaaaagatttttgggttccaagtttatacaaccagtccatctcctgtccaattgagctctccattgcccgctatccatgatcatgtgttacaaact

SEQ ID NO: 66404 - DNA, 308 bp, Zea mays
  Clone ID: LIB3076-027-Q1-K1-C9
tacacctattttgactttctcgaaaatttataagggcattcgaaaaattacacttttttcactataaaattttactcatcaccatattattatataacacattgttccaagttcccatcatttactcctcttcttaatcatattgatacatataattcaaatctctatactttatcaactatccttatatatttattatatttaaatatcaatattttatcaactttctattcaacttttctttaaccatcacttctttctactacttcttcttctcttataactataactccattaattaattttat

SEQ ID NO: 66405 - DNA, 410 bp, Zea mays
  unsure at all n locations
  Clone ID: LIB3076-027-Q1-K1-D1
gtcgctcacaagtgaagaaagggagctgaagcggaatcaagcccgcgtcagagccacgttcgtgcaggacctgctgctctctactctattcggcgactgatgacgaaccagagcgagcctaagctattatcactggaagggtggaggtccacgaagaccagcgcggcggtccagaacacctctagtaaggtgcaaagttgatgtgggcgtaatgtatctttctaagttattgtaagccggtctcttgtcttcacaactgacgatctgtgtgtggtacgctacgcacgcaagtcccgcggttgtgcgtgtacgtctgaactctggagcattggtttgttgtacccaaaaaaaaagccgntatccaagaacatgtgttacaaaactgaccatcggcaccggtgaatgaattg

SEQ ID NO: 66406 - DNA, 413 bp, Zea mays
  Clone ID: LIB3076-027-Q1-K1-D11
tggagttgaaatcaaatatggggggtttgttcaaagaatctttggccgcaatgactgccggtgaaggcgaacaggaaatacggacactgcatcgtcttattgcattggttgaatcatagagaaactaccaccaaaaggtcctacaaattcttgatcaacttgagagagagatggtatctgagcgccaaagaattgaaggggcacctcctccggtggttgagagttccatgccttcaccgcctgcatatgaagaagtcaatggtatattcatgaggaatactgtcgcagagttggtcgagaccgtggagtatttcctggctgaggcaatccaatcatatcgagcatagagcgacactgagctcaacctttcagctggtgactacatagtggtccgaaaggtgtcgaacaatgga

SEQ ID NO: 66407 - DNA, 358 bp, Zea mays
  Clone ID: LIB3076-027-Q1-K1-D3
cggacgcgtgggcggacgcgtgggtttcgctgcacttgggaccccaaaatcttctcaatggcctgacatggtgtatcttcctgattatgttgaataccaatatgttgctgcaccaccgctacgtacattgcttccgatggccagcgatgatgctttggatcttttgtcaagaatgcttacgtatgatccgaaagcaagaatcagtgctcagcaggctctagagcacaggtacttttcatcgttacctgctccaacaagaccatcacagcttctaaggtcacggtggaaagggaaagatcaagggaataacaagatgcccgatctgaacctgcagcatggccctctggtgctctcttcg

SEQ ID NO: 66408 - DNA, 180 bp, Zea mays
  Clone ID: LIB3076-027-Q1-K1-D7
acccccactcttacgcctatttttcgcttcacatgttaccccaaaatcttctcaatgagctgagattgtttatcaacctgattatgccaaataccaatatgttacttcaccacctctactcacattgcttcctatttccaactaatatacttcctatcttatatcaataatacttactta

SEQ ID NO: 66409 - DNA, 109 bp, Zea mays
  Clone ID: LIB3076-027-Q1-K1-D9
cccactcgtgctcctatgtcctcgtcagccccttcgccgttctactagcactccttcatgtcctttgtcttatccgtacttttgttaacttatgtatacagaggttttg

SEQ ID NO: 66410 - DNA, 417 bp, Zea mays
  unsure at all n locations
  Clone ID: LIB3076-027-Q1-K1-E11
gcgcccacgcgtccgaaactatacacctaagcatagcgcctgcagtggcaccgagcacgagagtaacagggctctagaacctagcagaggcccgcgccgccgccgccaaccgcgacgaggaaggaagcaggaacgcgatgccgaagtcgaagcgcaaccgcccagtgaccttatcgaagaccaagaagaagccaggtttagagcgcaagggcaaagtagtcgccgagataaaagatgctgtcgacaaatacagcagcgcctatgtttttacctacgataacatgaggaatcagaagctcaaggacctcagggagcagctcaagtcttctagcatgatttttctcgctggaaagaaggttatgcagatagcgctggggcgttcgcctgctgatgaagctaaaacaggcctncacaaac

SEQ ID NO: 66411 - DNA, 405 bp, Zea mays
  Clone ID: LIB3076-026-Q1-K1-G6
gcgcaggacccgcctgcctcgccgccttaatgtctcgccgccgcctccgctgcgagaggcttcggtcggtccagcggctcatcgtctctccgcagcgcggcggccagagccgcctcgcgtgcgggaccgggaccggctccgctgccgaggcggatgcccacctctgccccccgtgtactcctaaggtcgtcggtggaaatgagcagcgtgtgtctggagtccttgatgcccatgcacagcgccactgcttcggcgctcatgacatcgcttctcgccgacccggcttgcaagggattctgttggctatcagaaggtcaagctgaaactagatgaactttatgggactccaaaggtgaacaatttttatagatcccaccaataatgactggtgatagctagattcca

SEQ ID NO: 66412 - DNA, 224 bp, Zea mays
  Clone ID: LIB3076-026-Q1-K1-G7
ggaacagattaggcagctgatgagatcaatttcactgcttccgttctttgacagtgcctagcaaggctttgcaagtggaagtcttgacaaagatgctcagtcagtgcgtatgtttgttgctgatggtggtgaacttctcatggctcagagctactctaagaacatgggattgtatggagagtgtgttggcgctttgagcattgtatgtaaaagtgccgatgtaa

SEQ ID NO: 66413 - DNA, 273 bp, Zea mays
  Clone ID: LIB3076-026-Q1-K1-G8
acggactatgaaaggccacatagtcattttggaacctgtgtctggtcaagctgaaaaggatgagtggagtgcaattaggggcgtacaggagatatataaagatagccgaaacaacagatgacgggactggaagaacaacagaggcgtaaagcagtttggcggtaggaagcggggtcggcacttctactgccgttacagggactgcaataaagctgataaagtgtagatgctggatatacacagaatcaccatatataatgaggagaacattat

SEQ ID NO: 66414 - DNA, 324 bp, Zea mays
  Clone ID: LIB3076-026-Q1-K1-G9
cccagcccctacactcccggcggcggcgcattagcagcagcaccagcacccgaggatggggaagttcctcaagcccggcagggccgtaatcctcctgcagggccggttcgccggcagaaagccggtaatctgccccttgttcaagaaggcaacccgcaaccgcccttacggccactgcttcgtggccggcctggccagtaccccaagaaggtggtccgcaaggacttggccaagaagacacggaagaagtcgcgcgttaagtgcttcatcaagctcgtcaacttcacccacctcatgcccacccgctacaccctcgacgtcgac

SEQ ID NO: 66415 - DNA, 266 bp, Zea mays
  Clone ID: LIB3076-026-Q1-K1-H1
cacgcgtacgctgcggaagcaccgaggcccgcgggattgttaaaagattcctcgcccaaccctaccccatgcgatgtcgcatcgcatggccaccggaccgcggtctctccacgcccttctcggctgcggtgcagttgccgacttgctgctgtggcgaccgaggaatgcctcggcggcagccgtggtgggcgccaccacggtctggttcgtcttccagcgcgcggagtacagctggccctccgtcctctgcaacgccctgctcgtac

SEQ ID NO: 66416 - DNA, 392 bp, Zea mays
  Clone ID: LIB3076-026-Q1-K1-H10
gcgcccacgcgtccgcccacgcgtcctttgacgcttgggcaagaccgcagctatctggataatgttctacgttgttggcctgctcataattaccacctctgccgtcataccgtccctacggcctgcctcgtgtgaaggcggttcatgtccacctgcaacagggtttcagtattttgtgctctttggttcattgtacctaatctccattggtacggggggcgtcaagtcagttttacttcctttggaagcaaatcattccattgatccaacccctaataaagttaaagcaagcaactggtcttcagatggttcttcatggctgtcaaccttggagtgttcatattccgcactgttcttggctggatacagcaaaatgtgccttggtctcttgg

SEQ ID NO: 66417 - DNA, 203 bp, Zea mays
  Clone ID: LIB3076-026-Q1-K1-H3
tcgcactctataggcggtctcaaaacttagcttatccagtgaacacgcaacccttccgggtctgcggcatcagcttcggaccgatgctcaatatgacactgctactttgcgctacttgactgtcgtcaaggctctgttcatgagcacgatgccaaaaaaggattcggcggtccatacgccgtccttagacaagatcaaggtga

SEQ ID NO: 66418 - DNA, 226 bp, Zea mays
  Clone ID: LIB3076-026-Q1-K1-H5
cactctagaggcggtctcagaactcagcttatccagtgaacacgcaacccttacgggtcggcggcaacagcttcgaacagatgttcaatatgacactgctactttgcgctacttgactgtcgtcaaggctctgttcatgagcacgatgccaaaaaaggattcggcggtccagactccgacgttagacaagagcaaggggacagtgttcgagattccatggtttttc

SEQ ID NO: 66419 - DNA, 234 bp, Zea mays
  Clone ID: LIB3076-026-Q1-K1-H7
ggcgatcgacgtgagtctcatcatcactgtctactgcatgcccggcatgacaggatacgaggtgcttatagcgagtgaaggggtcctcatcgctcaaggacattccggtggtgatcatgtcgtctgagaacgtgcctgtcctgatcagcacgtgcttgcaagatggcgcggaggagttcttcctgaagcccgtgaagccggccgacatgaagaagctcaagtcacacctgctga

SEQ ID NO: 66420 - DNA, 320 bp, Zea mays
  Clone ID: LIB3076-026-Q1-K1-H8
ctgaaattttatttggtctgggttttgacaaacaaatgcaagcaaagaaaaactaaagatgtctctggaaggtggcgtatgaggattgctttagcaggacccctgttaatgaatccaccatccctttgcttgattaagccaacaaccatctagatctttgagcttgtgtctggttggaagagacactgaagaaatttgaccgcatacttgttgtcatatcacactcccaagattttctaaatggagtgtgtactaacattattcatatgcaaaacatgaagctcaagttatacacccgtaactacgatcagtatgttcaa

SEQ ID NO: 66421 - DNA, 175 bp, Zea mays
  Clone ID: LIB3076-026-Q1-K1-H9
acgcccacgcctacgcctacgccaccttttactcttaggaaacaacgcatatatctagataagagtttaacgtaaaagagggctaataattactacatatacccaaataccgccactacagactacctcatattaacgataataatgttcacctccaacaaggttttaaaatttt

SEQ ID NO: 66422 - DNA, 405 bp, Zea mays
  Clone ID: LIB3076-027-Q1-K1-A10
cccactcgtgcgcttctatagaaatgtcattcgatgcatcggaagatacggtattcctgcgtatcagtgaggttgacactgcagaaaacgcattcactaacggccttcatgagaagctaaccatgtatgatgcagtaccattgctgcggggcgttcctccagcatcagagaccctccatgtcgcggagcgaaccgatgaaggtattgacgatgagatctattgacagcggtacttattctagatgtacagcattaaccaagtaggctccatgatgtatatgactgtctaattatctgcacacctttggcataaactgtgaactcaatctcatacctatgcaaaccctgctaacctacgtcatatatattagataactttcagatcaccatagatcggtgtactag

SEQ ID NO: 66423 - DNA, 453 bp, Zea mays
  unsure at all n locations
  Clone ID: LIB3076-027-Q1-K1-A12
cccacgcgtccggcttggagcggtccaagcgccctgcgaagcaaactacgccgatggctgcngcggcggcgtgggagggtccgacggccgcggagctgaagacagcgggggcggaggtgattcccggcggcgtgcgagtgaaggggtgggtcatccagtcccacaaaggccctatcctcaacgccgcctctctgcaacgctttgaagatgaacttcaaacaacacatttacctgagatggtttttggagagagtttcttgtcacttcaacatacacaaactggcatcaaatttcattttaatgcgcttgatgcactcaaggcatggaagaaagaggcactgccacctgttgaggttcctgctgcagcaaaatggaagttcagaagtaagccttctgaccaggttatacttgactacgactatacatttacgacaccatattgtgggagtgatg

SEQ ID NO: 66424 - DNA, 342 bp, Zea mays
  Clone ID: LIB3076-027-Q1-K1-A2
cccacgcgtccggatacagcaccccccagatgggttcaccttgctcatggactgcttctctgtctttatcagacttttgatgctgtggatggaaaacaagcaaggcgtaccaactcatcaagtcctctatgcgagctttttgaccacggatgtgatgcgcttgcgtgtgcttttgaatccttggcttttggaagcacggcgatgtgtggaaaggctaccttctggttttggttcatttcagctgtcccattttacttcgcaacctgggaacacttttttacaaatacacttttaattcttcctatagtcaacggaccaactgaaggccttatgctgatctac

SEQ ID NO: 66425 - DNA, 296 bp, Zea mays
  Clone ID: LIB3076-027-Q1-K1-A3
aaaaaacatacgaatacagcacccaacaaaataggattatccttctcatagactacttctcggacttggtcaaacttttagaatggctaaggatagaaaacaaaccagggcgtaccaactcatcaagtcctgtatgcgagcctttttaaccaaggatgtaatcccttacatgtgcttctaaatccattgcttttggaagcactgcaaagtgtggaaaagctaccttctgggtctggctcatttcaactgtcccattttactttgcaacctgggaacacttttttacaaatacactt

SEQ ID NO: 66426 - DNA, 435 bp, Zea mays
  unsure at all n locations
  Clone ID: LIB3076-027-Q1-K1-A4
cccacgcgtccggatacagcaccccccagattggtttaccttgctcatggactgcttctcgttcttgatcagactgttgatgctgtggatggaaaacaagcaaggcgtaccaactcatcaagtcctctatgcgagctttttgaccacggatgtgatgcgcttgcgtgtgcttttgaatccttggcttttggaagcacggcgatgtgtggaaaggctaccttctggttttggttcatttcagctgtcccattttacttcgcaacctgngaacacttttttacaaatacacgttttattcttcctatagtcaacggaccaactgaaggccttatgctgatctacttgtgccattttttcacctttttcacaggagccgagtggtgggcacaggattttcagaagtcaatgcccctgctgggttgggttcctcttatc

SEQ ID NO: 66427 - DNA, 106 bp, Zea mays
  Clone ID: LIB3076-027-Q1-K1-A5
acgtccgaaaaaaaaaaaaaaaaaaaaaaaattaaaatttaaaaaaaaaaaaaaaaaaaaaagggaaaagtaaaaataaaaaaaaaaaaagggcgaccaataaaaa

SEQ ID NO: 66428 - DNA, 402 bp, Zea mays
  Clone ID: LIB3076-027-Q1-K1-A6
acccatacaaatacaacaccctacaaatttagattctttactcataaactacattctatgtctgtgtcaaactttaaaggcgtaagggtcaaaaacaaacaaggcctaccaactcatcaactactctaagcgacctttcttaccactgatgtgatgcactttcatgtccttttaaatcactttactttccaagcactgccaatatctgtaaatgctacaaccttatttttacctcatttcaactgccccattctacttcccaatcttggaacacttttttacaaatacacttaattttcttcctatagccaacgcaccaacttaaaaccttatactgatctacttgacccattttttcaccttttttacatgatcccaatcatggtcacaacatccttagaa

SEQ ID NO: 66429 - DNA, 221 bp, Zea mays
  Clone ID: LIB3076-026-Q1-K1-G5
ataacatgaacatcacagttcattagagcgcggcgtgcgctagctgcggtttatttgcatggcgtccagtgcataggccagccggagccggcgctgtacaacggaggcattctcaagttcggcagcatcggcagcgacccggactggtaccgtacgacggaaaccggcttcttcttcccggcgttcgtggtgtacaacctcaacaagaccaccatgtacac

SEQ ID NO: 66430 - DNA, 421 bp, Zea mays
  unsure at all n locations
  Clone ID: LIB3076-027-Q1-K1-A9
cccacgcgtccgcccacgcgtccggagatcccgcgctcaaccaccgcttctcggccgcggcccccttcggccctcctttcctccggtggccgccggggacggggagcgaagaagcctccatccctcctttcctccgttggtcgccggggacggggagcgaagaagcctccctccctccttccctccggtggttgccggggacggggagcgaatcctccattcctcattccctccggtggtcgccggggaccgggatcgaagatgttctatggggccatggtttgggatccgtggctgatcgtgtcgcagatcgtgtgcctgcagtgcctctactacctgtcgctgggcgtcgccatggcgctcctcgtcggcacccgcgtcccgcgactcacccttctctacttcttcgacttcgncacgc

SEQ ID NO: 66431 - DNA, 265 bp, Zea mays
  Clone ID: LIB3076-027-Q1-K1-B10
tctatctctgttactcttcactaagtgtgattgtaacagtggtacctcttgtattctgtgttccacgatgttgcaattggttgcttgatctaatgatgtttcaacctcccatcttctaactatcatacatattctcccctgataataatgattacatattctgttaaaaataatttctacatacacatatcttcttataaatttaatttttatatctcataataaactccttcctttctatataaaccaaccttacttactcttt

SEQ ID NO: 66432 - DNA, 311 bp, Zea mays
  Clone ID: LIB3076-026-Q1-K1-C8
ccagagcagctcccccgccggcttcctcactaacgggtacggcggcatgctccgggcggggatgggcttggccggcggcttcaggaacggcgtcagcgacgcgcggctcaaggggcagctgagcttcccgtcccggcaggggtcggtgatgtcgcagatctcggaggtgggcagcgaggagctcgacggcggaggcggcggcagccccgaggcggccggcagcaacgccagcggcgcgccgcgcggctacgtcggcattccggggtacccgatgggcggcggcacgtgcggcgcctggtcggacgagccgt

SEQ ID NO: 66433 - DNA, 255 bp, Zea mays
  Clone ID: LIB3076-026-Q1-K1-C9
cccacacgtcctcaatcgcatctttctggttctcctttttagcgacaaactcagggctatgcaacaattagtccagtccatgcacaaagctctcatacctaatttcaaatcaatgcttccagaaagtaaacatataacttcaactatccgatcggcaaaagttaaagaaaatctccatactgatccaacgtacaaacccatgaagcatgactacaacgacactatatttaatcaatacatactgcaactaacatc

SEQ ID NO: 66434 - DNA, 277 bp, Zea mays
  Clone ID: LIB3076-026-Q1-K1-D11
cagaaggtctgaactgttcagagttccttgtttgttcactaaccattctttgtcaatcttctttgaaaatgagcttgcctcataggcttccatttgttagtaaatctgcgcacttttaggagaactcgagttcgtcctagatgcaaaagtacctggctggtattgaaaagtcaacttaaagcttgaaggttgactttggttttgatatggcaatcacttgtgggtgaagattggcacccgattaatttgaagcttgaatcgccttaattagaaaaat

SEQ ID NO: 66435 - DNA, 236 bp, Zea mays
  Clone ID: LIB3076-026-Q1-K1-D12
ctatgacaatgactcaccgggatttcgcatctagtcaggaagcaaagccattagaacactgcttcaaactcatgctcctgcacttgccaataatgattcagcctatcattgtgataagagcctgttcacacttgtagcacttcctcacgttaaaaaccagtttactatcgtggtacacaaattttcacctgaaacaactcctgaaaacggctcatcacgaaatgacagccctcccg

SEQ ID NO: 66436 - DNA, 265 bp, Zea mays
  Clone ID: LIB3076-026-Q1-K1-D4
gtacaccctacagaccacgcgtgatgcaaacagtgttgacatcagtgcatacatataaaggtatcggttgccacatgatgagacacggcttgcgtgacggtatacatggcgcttgatactgcgattgagagtggccttgtgagtgctcttgcgtactgtctagcgcgctctccgtatgcacttatatatgctcgaacatgtaaaggatcatgcatagcttataccgactctatcaccgtcttcttaatctactacgatcatgact

SEQ ID NO: 66437 - DNA, 224 bp, Zea mays
  Clone ID: LIB3076-026-Q1-K1-D8
cggacgcgtgggggcccggaagattaggttccctaccacaggcaccgaggggctgctcatgggcattcttgatgaaggaactattgactcaccataactattgcgtgctaatgtaaccacgctactcaaattgcgagaggagtcatctaatgttcttgggaaattacaaatgctctactatattcccatgcatgcaccatttacagaatcatctcaacgagccc

SEQ ID NO: 66438 - DNA, 236 bp, Zea mays
  Clone ID: LIB3076-026-Q1-K1-E1
atagagccaagtacatgttctgcctagtctttgctacagcacgtcttcacctgcttacacgcctggttcctaatacttgctgcttttcttaaatcaagaaaaggtattgtcattatatctattcactctggatgtcctttagtcctagttttctgctttgtgcagagctatgcatacaagttgtggatgtctgtttgtcaattgtatatcaagatcgctagagcagtttaatttac

SEQ ID NO: 66439 - DNA, 349 bp, Zea mays
  Clone ID: LIB3076-026-Q1-K1-E11
cactctcttccctccctctcggagtgtaggagtgagaagagagggagccagtccagcgtccaggcagccggacgcccggaccaacaccaccccgactcccccttcccccgacttaccggccctacctctaactctgccttacccacggtcccacgcacgttcacaagtctcgtcgtcgccgcaatggaatccgtcggtgacggtgactaccagctgcaccgcctcaagttcggcaagatgatctacttcgaggactccggcggctccagcagctgacccatccactgttgtggcagctcgcccgcgctttcagcgactcattagccgtctctcgtcggccgcttcgcct

SEQ ID NO: 66440 - DNA, 254 bp, Zea mays
  Clone ID: LIB3076-026-Q1-K1-E12
ctgacgcgtgggctgacgcgtggtctgacttcttgtctcctatccttcgcccgccaacctgcgcaggtgaaggcttgtttcgcgcgactgctgtgacacgaggagcagcagcaacagcgcgccatggacccgtgccacttcgtgcgagtgctgttcgacaacctctcgctcagaatgcctgtggctccgaccgccgccgtggacggcgcggacgttcacacgtccacgtctgcgtgctactgcaatatccagct

SEQ ID NO: 66441 - DNA, 210 bp, Zea mays
  Clone ID: LIB3076-026-Q1-K1-E3
cttatcattccccatcccaacctctctccatttcctctctcctccgcctcctccttgatccgcccagtccagtaatcgccatttcttactcggaggagcaccacttcgaatcgaatgccgacgcctgatcttccaagacctacccgcatcatgctggcaccgtccgtaagaacggcttcatcgtcattaagaaccgcccctgcaaggttg

SEQ ID NO: 66442 - DNA, 119 bp, Zea mays
  Clone ID: LIB3076-026-Q1-K1-E4
tcactgttccactatatgaaatgttccttgttaagctaatagatcccaagaacttccacagatatagatgcattgtacagtattcctacaattacattcacaataattattataacttc

SEQ ID NO: 66443 - DNA, 264 bp, Zea mays
  Clone ID: LIB3076-026-Q1-K1-E5
aaaaaaaataaaaaaaaaataaacaacaaaaaaaaaaaaccaaaataaaaaaaaacaaaaaaaaaaaaaaaataaaaaaaaaaataaaaaaaaagaaaaaaaaaaaaaaaaaaaaaaaaacaaaaaaaataaaaaataaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaa

SEQ ID NO: 66444 - DNA, 214 bp, Zea mays
  Clone ID: LIB3076-026-Q1-K1-E6
ttcgtctaaaagtttacaacttcttctcctttattttttggagcacctaatgaggtactggtccaattttcctagagctagagctattccaaacaaggtccaaatcaatgctcatctcatttctaaataggtatttcacatgcccaccaacgatcttcattgatcttactgctcttttgcgattatcgttcagctatttatcacagatccttta

SEQ ID NO: 66445 - DNA, 432 bp, Zea mays
  Clone ID: LIB3076-026-Q1-K1-E9
cccacgcgtccgcggacgcgcagtgtgcgctcactccttagctgtttttatctggccgtgaccttgcgtgcgcgacatctagggcgaccgccgcctccgacgacaccctacgcccagcaccccaagtattcatcgcgccctttgccggatacgagcacccaccacaccagatcactgtaatccacgctgaattgaggctgaacctggtggcatattaatctcggatacttgttcaactgcaaacttcaagattcattctcatgcaatcaatggagagcctagcgcaattaaaggtgatgtgtgaaaagctttataattctagagactcggatcagcgagcgcatgcagaaagcaccctcaagtgcttatcagagaacagccagtacatttcgcaatgccaatacatattggacaatgcctcaactacatatg

SEQ ID NO: 66446 - DNA, 434 bp, Zea mays
  Clone ID: LIB3076-026-Q1-K1-F11
cggacgcgtggggattagtgctgcaaatgatatctcttaacgtagtgcattagtgtcagggtccacactacttagagtttgtagataaactacatgttgtatctcggagtcaatgaattgatgggaaggatcttccctgacaaagggaacttctggtgaaggcggtagagactagagaatcttaaccgatatgcttacatctgggctcgaaaatcaatgaaagtgtgaactttgtgtgcctgctgttaattaggatagctctatgttggttgtctgggttctcacatcctatgataaccagttgtccatcagcccctcacaaacgtgcagctgtgcaagtatattaatatcgtccttttctggcgctcatatatgcccaagtaattcataaatagtacacacatatctcttacagattgtttagtttttcattg

SEQ ID NO: 66447 - DNA, 227 bp, Zea mays
  Clone ID: LIB3076-026-Q1-K1-F7
acgtatattctgctcattacatcaactttacattccacacaatcacaggtcatactagagctcgtaggattcacgcaagaataaccactgagacaagtactcacaaaaagctcacaactaccgcgatactaaagtcaggatgaacgaaccgctagagcaacttatccaaaacaacgacgaccgtcattacttatggtacattacaagcttacaatctcaacaagacc

SEQ ID NO: 66448 - DNA, 435 bp, Zea mays
  unsure at all n locations
  Clone ID: LIB3076-026-Q1-K1-F9
ccgatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaagacaagatcagacctctttggaggcattacttncagaacacccagggtcttatttttgttgtggacagcaatgaccgtgaccgtgttgttgaagccagagatgagctccacaggatgctgaacgaggatgagctacgtgatgctgtgc

SEQ ID NO: 66449 - DNA, 449 bp, Zea mays
  unsure at all n locations
  Clone ID: LIB3076-026-Q1-K1-G1
agaaactatgcgcggcgcagaacatgaacatcacagtacagtagagcgcggcgtgcgctaactgcaggtttatttgcgtggcgtccagtgcagaggccagccggagccggcgctgtacaacggaggcattctcaagttcggcagcagcggcggcgacccggacgggtaccgcacgacggagaccggcgtcttctccccggcgttcgtggtgtacaacctcaacaagaccaccatgtacaccttctcatgctgggtgaagctggaaggcgcgtactcggctctgatcaccgcgaggctggcgccggacaacaccggcgccaggggcatcgccaccgtggttgccaggagcgactgctggggcttcgtcaagggcggattcgtnctggactggccgacgcaaaccttggtcatcttctttcaaaatgctgacaagacgcccatgaagatca

SEQ ID NO: 66450 - DNA, 388 bp, Zea mays
  Clone ID: LIB3076-026-Q1-K1-C5
gcgggagaagcatgcaggaagtttatttgagggtttttatcagactcaagttagtgggttgggagtcaatgacaatttactggtagctggtgggtttcaaggagagctgatctgtaaacaccttgatcgggaaggtattagtttttgctgtcgaacaacttatgatgataatgctattacaaatgcggttgagatatttaatacctctagtggcgctgttcacttcatcgcatcaaataacgattctggtgtgagatactatgacatggagagattccagctattcaagcatttgcagtttgaatggccagtgaatcattcttctttgaatccttacagaaaagtcgttgttattgtccgtgatgatcctgatggtctacttattgat

SEQ ID NO: 66451 - DNA, 197 bp, Zea mays
  Clone ID: LIB3076-026-Q1-K1-G11
tcatacgaccaatccatacactcaccatgttttatcatttacacaagcaccactaccacaggggataggtgcaattcaaccgagggtatgccctcaacattcaatacactcactacataatctttatcctcatatactatcacgtacattcctaacacactctctaccttccctacatactctaactgataaaacac

SEQ ID NO: 66452 - DNA, 356 bp, Zea mays
  Clone ID: LIB3076-026-Q1-K1-G12
cggacgcgtggggtctttgcttccctcttacttaaggttgatcagcttctagaacttgctgcgggaatgggacgctttactggagatctggcaaaagaagctgggcacgttctggctctagacttcattgaaagtgtgattaacaagaaccaaggcataaatgggcatcacacgaacataacctgtaagtgtgccgatgtgacatctaacgacttgaagattgaagataactctgttgatctgatattttcaaactggctattaatgtatctttcagatgacgaagtccaaaagcttgtggggaaaatggttaaatggttaaaggtctgaagccatattttctttacagaatcatg

SEQ ID NO: 66453 - DNA, 424 bp, Zea mays
  Clone ID: LIB3076-026-Q1-K1-G4
cagcacccgcctgcctcgccgccgcaatggccgccgccgcctccgctgcgagatgcttcgtccggtccagcggctcatcgtctctccgcagcgcggcggccagagccgcctcgcgtgcgggaccgggaccggctccgctgccgaggcggatgcccacctctgccccccgtgtactcctaaggtcgccggtggaaatgagcagcgtgtgtctggagtccttgatgcccatgcacagcgccacggcttcggcgctcatgacgtcgcttctcgccgccccggcttgcaagggattcggttggctatcagaaggtcaagctgaaactagatgaacttcatgggacccaaagggggacaattttatagatcccaccaataatgactgttgatgggctagatccatcactatttcacgcgtcggaatgga

SEQ ID NO: 66454 - DNA, 455 bp, Zea mays
  Clone ID: LIB3076-026-Q1-K1-A11
accgacgcgtccgcccacgcgtacgtgtggcatgttcgagcggtttgatctggaggtgaagcccaaggcagatggcacaattgggctcacagtctcctttgtggagagtgtgtggagtgctgcaaagcagttcaagtgcatcaatgtggcgcttatgtcacagtcagggcaggttgacttcgaccaggacatgacagagagggagaaaatggattacctccgcaagcaggaacgcgattaccagcagcgtgtaaggggtgccaagccctgcatcttgccagaaaatgtacgtggagaggtgctgggaatgatgaagaagcaggagaaggtgagcgccaggatgctgcagaagatcagggaccatgtccagaaatggtaccacaacgagggtttcgtatgcgcacaggttgttaactatggaaaccttaacaccaatgaggttgtctgtgacgtgg

SEQ ID NO: 66455 - DNA, 434 bp, Zea mays
  Clone ID: LIB3076-026-Q1-K1-A12
cccacgcgtccgtgtggcatgttttagcggtttgatctggaggtgaagcccaagcgacatggcacaattgggctcacagtctcctttgtggagagtgtgtggagtgctgcaaagcagttcaagtgcatcaatgtggcgcttatgtcacactcagggcaggttgacttcgaccaggacatgacagagagggagaaaatggattacctccgcaagcaggaacgcgattaccagcagcgtgtaaggggtgccaagccctgcatcttgccagaaaatgtacgtggagaggtgctgggaatgatgaagaagcaggagaaggtgagcgccaggatgctgcagaagatcagggaccatgtccagaaatggtaccacaacgagggtttcgtatgcgcacaggttgttaactttggaaaccttaacaccaatgaggttgtctg

SEQ ID NO: 66456 - DNA, 159 bp, Zea mays
  Clone ID: LIB3076-026-Q1-K1-A2
acgatctgcctcatctccgacctgaaattgcctaagttttatctcctgtcaaacgctaagcctgcactggtcgatttccccaatccagtgacccagcataccacagccacttcagtcaaggttctctcttccatcctttctacctataccaagttcaaa

SEQ ID NO: 66457 - DNA, 203 bp, Zea mays
  Clone ID: LIB3076-026-Q1-K1-A4
accacgcgtacgcccacgcgtgcgcccacgcgtccgtccacgcgtccgcggacgcgtggtgtagaagaaggttctcgaccccaagaaatcacaaaacatcgcgataatgctgagggcgctcaatgcgaccaaggaagaagtgtgcatagcactcctagatgggcaggcagagagccttggatctgaattcttggagatgctgc

SEQ ID NO: 66458 - DNA, 396 bp, Zea mays
  Clone ID: LIB3076-026-Q1-K1-A6
acgcggacgcgtgggcggacgcgtgggatgacatggaggatgaagagtcggatgatgagaccggagaagagggaggacccgcggaggaagcatccagtactggcagtgacaagaagcctccaagttactcagggaagaagggcaaaagatccaagaggaagcgcatggtgcagtgatcgtcacagttcaatcggatgcgatttttgccacaactggttgattcaattgaccagttaggtgcctcagttgatcacggaagcagttttggcggtctgctggagccctatatttggggtgcagacaaatgaacagctttccgtgtcacaggtatttgctgctaagcttatgcaaatggaggtagctgaatatatgctaggcctgagggtgagtgatgga

SEQ ID NO: 66459 - DNA, 448 bp, Zea mays
  Clone ID: LIB3076-026-Q1-K1-A9
acgcgtccgatcgccgggagcccgggacccctctgctccgcgccgctgccaccaacagcgacggccgagagggcgagccgcctgtcgcggggccgcgacacgaccggcaaccggccgaggggcgaagcaacaggccagcgtggacgccgatcgtgccaagcgcccagtcccgattccgccctgacctgtttaacagtacgagactctaaaagtccgccctggtgagtgtgcttcactgcttctccggttcttcccctcgcactggtcccgatggaatccgatgccgaggaggcggcggcggcggtggacccaggcgctggacggctgaaggggagcccggagctgactgtggacgcggacatgcgggaggtggcgaagagggccgcgtggagcgtcagttccttcaaggacggcaacggcgtcgcatccctgcgcgacgacaacctcg

SEQ ID NO: 66460 - DNA, 336 bp, Zea mays
  Clone ID: LIB3076-026-Q1-K1-B1
agcaccttcccaaaaaaatcccccattttcttcgaggcgaggagagcgtgaaagacaggggaccggcggcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcatgactggtaccgccatggacgtcg

SEQ ID NO: 66461 - DNA, 451 bp, Zea mays
  Clone ID: LIB3076-026-Q1-K1-B10
aatcaccgggccgaccgactcgtacgattagcaaaggcaaacattaatgttcgagctttagctcaaggttgcagagaatagaatatcgctgatatattgaagcaagaagatcgtctaagggctctgagagctgctcactcaacgttcttcctctccaaaacgacacttgcagatagcatcattgcacctgtcttaattactacaacactccttacaccagataaggatcagatacctgctataaacgaaaatattaacattgatctgcctgtcattgcaataactcgctcaactacaatgcttttgagcgacacgggaatagacttaacccagtggaaacaacttctaaaaaaagaatcacaaccagctgatattgatagctaagttcatcatttatccgataatcacgtattcccaaacaaagtttttgcggactgcacagcatatacaa

SEQ ID NO: 66462 - DNA, 439 bp, Zea mays
  Clone ID: LIB3076-026-Q1-K1-B11
gtttgaagccttggatcgaaaggaaagggagattctttttagtgagaaagtcaaggctgtggaagaaaaagtccaatcaatgcgcaaagctgtcatagctaatttcaaatcaatgcttcgagaaagtaaagatataacttcaactagccgatgggcaaaagttaaagaaaatttccgtagtgatccaaggtacaaagccatgaagcatgaagaaagggagactatatttaatgaatacatagtggaactaaaatctgctgaacaggaagcagagcaagctgccaaggccaaagtggatgagcaagccaagttaaaggagagggaacgtgaaacacgtaaaaggaaagaaagagaggagcaggagatggaaagagtaaaaatgaagatacgtagaaaagaggctgtgtcatcataccaagctttacttgttgaaatgatt

SEQ ID NO: 66463 - DNA, 382 bp, Zea mays
  Clone ID: LIB3076-026-Q1-K1-B12
cccacgcgtccgcggacgcgtggggctagctctcatttttagcgagaaagtcaaggctgtgggagaaaaagaccaatcaatgcacaaagctatcataactaattacaaatcaatgcttccataaagtaaaatatataactccaactagccgatgggcacaagttaaagaaaatttccgtagtgatccaatgtacaaagccataaagcatgaagaaagggagactatatttaatgaatacatactgtaactaaaatctgctgaacaggaatcagagcaagctgccaacgtcaaagtggattaccaagccaagttaaaagataggtaacgtgaaacacgtaaaatgaaagaaatagaataccaggacatggaacgagtaaaaat

SEQ ID NO: 66464 - DNA, 437 bp, Zea mays
  Clone ID: LIB3076-026-Q1-K1-B2
ctctaattagctaccacataaagatcttaatttttagaggtatttttatcttccatagcgggttgaaatagaaaatcttggcattattaataagagcattatacatcgaacggacgtaaaaagcctcgaggttaacaaattccatttgaactcatctcttccagtggatagatgagtatgagcaaatctcaagaccaatctattccaacataaaagattaccacccaccagcgctctacgaaaagaaatgtttagaggaatcctattaaaaacattcgccactgtatcgctttttttatgagctatattatataaggacggaaatttcagcattagaggtttgttacccgtccacgtgtcctcccaaaatctaatctgcttttcatctttaagaataaaggaattgaaagggaaatatggtctaacctttttctaaa

SEQ ID NO: 66465 - DNA, 252 bp, Zea mays
  Clone ID: LIB3076-026-Q1-K1-B5
gacgcactcgtccgaaagtcatcaccacatccagatatttgatgttgctattatttgctggatgctgcgtccctgtagaacattcatgctatggacacaaactcaagtggacgtggtgttcgacaattcaaaacatacctattgcatacattggaaaaggttcagtttctcaactttgttctttgcccacaataagtgaaatccatcatgattgatcttgagacaagtgcctggatgcagttagtcttacta

SEQ ID NO: 66466 - DNA, 349 bp, Zea mays
  Clone ID: LIB3076-026-Q1-K1-B6
cggacgcgtggggtaagaacgaagagcatgtgaaccttatcaaggaataccgtgcgaagagcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaagacattgcgctggctgaactggcacctacccatccgataaggcttgggcttgctcttaacttctcaagtgtctattatgagattct

SEQ ID NO: 66467 - DNA, 272 bp, Zea mays
  Clone ID: LIB3076-026-Q1-K1-B8
tttaaccttatcaatgaataccatgcgaagggcgaatctgaactgagcaatatctctgatggcatcctgaatctgcttgactcccacctagtgccttcttctactgctgcttaatcaaaagtcttctaccttaagattaatggtgactatcataggtatcttgctgaatttaatactgttcctgaaattaaggaatcttcttataactctattatttattactttgcttctcatgacattacccttacttatctattacctacccatcctat

SEQ ID NO: 66468 - DNA, 442 bp, Zea mays
  Clone ID: LIB3076-026-Q1-K1-B9
attagcaaaggcaaacattaatgttcgagctatagctcaaggttgcagtgaatgcaatatggctgatgtattgaagcaagaagattgtgtaagggctctgagagctgctcactcaaggttcttcctctccaaaacgacacttgcagttggcatcattggacctggtttaattggtagaacactccttaaccagctcaaggatcaggttgctgctctcaaggaaaatatgaacattgatctgcgtgtcattggaataactggctcaagtacaatgcttttgagcgacacgggaatagacttaacccagtggaaacaacttctaaaaaaggaagcagaaccagctgatattgatagttatgttcatcatttatccgataatcacgtatttccaaacaaagttttggtggactgcacagcagatacaagtgttgcatcccactat

SEQ ID NO: 66469 - DNA, 128 bp, Zea mays
  Clone ID: LIB3076-026-Q1-K1-C1
aagagagctgatctgtaaacacctggatcgggaaggtattagtttttgctgtctaacaacttattatgataatgctattacaaatgctgttgatatatttaatacctctagtggcgcttttcacttta

SEQ ID NO: 66470 - DNA, 187 bp, Zea mays
  Clone ID: LIB3076-026-Q1-K1-C12
cccacgcgtccgcccacgcgtccgcccacgcgtccgggggcggcctgcactgggagaggcagatccgcgcgtccgccgtgccgaggcggccccccgggtcagccgccggggccggaatgtcggtgctcgtcacgggcgccgcgggcttcgtggccaccaactgttccttggccttccgaaggcccgg

SEQ ID NO: 66471 - DNA, 425 bp, Zea mays
  Clone ID: LIB3076-026-Q1-K1-A10
accacgcgtaccgcaacaggcccttgaagctcgacactcggactgagactgacagtctaggggcgaatggtgctgggtgtggaacttatcctctcattcccttgctttgaagggtaaggggctagggcgggccgaactgcacaacgagcgggcgccaggcggacgacgaagcgacgaggcagacactccggagagaatgtcgtcggcactaggaagtggcttgtactgagcctccccgtgtcgaggtcggattcgctcggaaaacttggccctgccttcagcatccgcgccggctgcagcgtgggtcttgacttctgactcataggacgtgcactcatcggagctggattccttggtttacaattgaagattggagcttgaactggatgtggaataagaataggttctggttacggcttttgaaa

SEQ ID NO: 66472 - DNA, 201 bp, Zea mays
  Clone ID: LIB3076-026-Q1-K1-C3
atcatactcaagttagtacggttgcgttcaattacaatttactcgtagctggtgggtttcaaggagagctgatctgtaaacaccttgatcgggaatgtattagtttttgctttctaacaacttatgatgataatgctattacaaattatgttgaaatatttaatacctctaatggctcttttcacttcattctattaaata

SEQ ID NO: 66473 - DNA, 156 bp, Zea mays
  Clone ID: LIB3076-031-Q1-K1-H7
ctttcgatcaatcatgcatccacgcgatctcaatctatcggtgaaccctgccagaccaacaaaagtctaacgggatcctctacatactattcacgctatccccacacagtgtactccgggccctaacgagggcggcaccgaaagacccccatcgat

SEQ ID NO: 66474 - DNA, 448 bp, Zea mays
  Clone ID: LIB3076-031-Q1-K1-H9
cccacgcgtccgggctggtcggcatgatgcttgagggcggcttgaagcccagcctggtgactttcaattcaatggtgaatgggatgtgcaaggctgggaagatggaggacgcacgcaaggtgttcgatgaaatgatgagggagggtttggcgccggatggggtcagttacaacaccttagtgggtgggtattgcaaggcagggtgctcgcatgaggcattgtctgtgtttgcagagatgacacagaaagggatcatgccagacgtcgtgacatttacgtcattgatccatgtaatgtgcaaggctgggaacttggagcgggcagtgacattggtgaggcagatgagggagaggggccttcagatgaatgaggtcacttttacagccttgatagatgggttctgcaagaaaggattcttggatgatgcattggttgcaataagggggga

SEQ ID NO: 66475 - DNA, 428 bp, Zea mays
  Clone ID: LIB3076-032-Q1-K1-A1
atctggtggagtaaccccgatggcccgtcagaactctggccctctgcctcctgtacttccgacaactgggctaatcacatcaggtcctatcacctctggtcagttaaattcatctggtgctcaacgcaaagtatcagggcctcttgattctagtgtatcaatgaagatgcgtaccacatcttttgcacacaacccagctgtcacaaatctcaatgtgggagatggttactcgattaagggcagcattccgaccacaataatctggttggtcgcgttgctctttttggttgggtttgtagctggtggcttcattctcgctgctattcataatcctatcttgcttatagtcgtggtggtgatatttggctttgttgctgcacttgtgacctggaacatctgctggggaacaagaggtgtgattgatttta

SEQ ID NO: 66476 - DNA, 400 bp, Zea mays
  Clone ID: LIB3076-032-Q1-K1-A3
cccacgcgtccgggaagaagaagaaaatcttttcctacgtaagggtccacttctgaggaagctagcagaaatcgctcggaaatgtgatctgaaaaatattagtgacgatgtggaatattgtttatcaatgtgtgtggaggagcgattgcgacgactcataagtactctcatacgagtctcaaaacagagaatcgatactgaaaagaccggacatcgactagttattacttcagatgttggtcgtcaaattttacagatgaaccagagagctaaggaagaatgggataagaaacaagcagaagaagctgacaagaacaagaaacaaactgaggctgatggcagtggtgctacagaattggaaaaagaaaaagaagaaagtctgccaaagaacgttaagccc

SEQ ID NO: 66477 - DNA, 422 bp, Zea mays
  Clone ID: LIB3076-032-Q1-K1-A4
gggaagtctcgggaacatacggcgcatttgaaggtgccactacgctgacctcgctcaggctcgtcaccagcagcagaacctgtggcccctggggggtcgagaacgggacgcgtttctccgtcacggcgcccatcggcagcagcatcgtgggattctatgcgcgggcgggaacaaggctcgtcgacgctatcggtgtttacttgcgtcagatttaatttgaataatagcaggggagctactgctagctacgtacctgctccatcctccattatcctttatttcaattcgctcatcatcgtcgtgtgtaaattaaataaataaagctcttgtgcccatattatatatagttgtcatggtcgtgccgtgtcaaaaaaaaaaaattttattctaatataatatataaaaaatttataatgtttact

SEQ ID NO: 66478 - DNA, 411 bp, Zea mays
  Clone ID: LIB3076-032-Q1-K1-A6
cccacgcgtccgggcgacgacgctcatcttcctcctcgccggcgttgccgcatccctcttcacgctcctctgctgcaaccgcgggccctccacaaacctgttccatttgaccttggtgactacagctgtaatttgttgctggatgatgtatgcaatcgtctaccttgctcagatgaagccattgatcaaccccattctgagcggagagtgagcgcagcatctgtattgaacagaacgaaagctagacctgctgtaccattgttcaatccgtgaactttctattcattttggccccacctgatgaaataaataaattaactggcctgatttttttggtgctactcttcacccgtgattaggggatgcaattggatgatatacgcagtaattacatctaaatatctatgtggc

SEQ ID NO: 66479 - DNA, 342 bp, Zea mays
  Clone ID: LIB3076-032-Q1-K1-B1
cccacgcgtccgcggacgcgtgggaatctgcccttgccgccgccactgcccgatccaggtgtgcagactgctccctcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatcccgaagcttcccttccagcgcctcggccgcgagatcgcgcaggactttaagacggacctg

SEQ ID NO: 66480 - DNA, 401 bp, Zea mays
  Clone ID: LIB3076-032-Q1-K1-B10
cggacgcgtgggtgcctcagtattccatgataggactctcaagctctggaaatgacttgtatgaaacccatgttggacttctgtattctggctgttagatgatagacaaacaagactttgccaaaaatgaccacatgacgaaaaggttgctgacaagatactctggagccgcgtgggctcaagaactaacagtgttttgttttgtggtcgttgtatgctgttcagtatgccactgaagcttgtaacttgtaactcgtaatagaaactttggttgaagaaagattgtacctcggacaagtggcaaatatttattctctaaaatattctgcattttgttttttgaaaaaaaaaaaaaaatactaataaatatatataataaaaaaaaaaaaaaaagggcggcc

SEQ ID NO: 66481 - DNA, 414 bp, Zea mays
  Clone ID: LIB3076-032-Q1-K1-B11
cccacgcgtccgcgccgccgcccacgccgtcgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgttggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggattgggg

SEQ ID NO: 66482 - DNA, 119 bp, Zea mays
  Clone ID: LIB3076-032-Q1-K1-B12
tcggcaagacattgtcgccgcgctttttcgccttgtcgcggagctccgctctcggcgcaccgtttacactagggccaaggagaaggttacatcaattttcgcgtcctacgatacaacgg

SEQ ID NO: 66483 - DNA, 340 bp, Zea mays
  Clone ID: LIB3076-032-Q1-K1-B2
agaaaaattcccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaagagacccgcggcgtgctcaagatctttctcgagaacgtcatccgggacgccgtcaactacaccgaacacgcgcgcccgaagaccgtgaacggcatggacctcgtctacgcgcttaagcgccagggacgcacccttt

SEQ ID NO: 66484 - DNA, 184 bp, Zea mays
  Clone ID: LIB3076-032-Q1-K1-B3
agaaaacttcccagtactctggtccgcgtcagagaggcggcggcgatgtctgggcgcggggagggcggtaagggtctgggcaagggcggcgcgaagcgccaccggaaggtgctccgtgacaacatccacggcatcaccaagccggcgatccggatgctggctatgaggggtggcgtgaagcgca

SEQ ID NO: 66485 - DNA, 278 bp, Zea mays
  Clone ID: LIB3076-032-Q1-K1-B4
agaaaaattcccagttctttggtccgcgtcagagaggcggcggcgatgtctgggcgcggggagggcagcaagggtctgggcaagggcggctcgaagcgccacccgaaggagcttcgtcacaacatttatggcatcaccaagccggcgattcggatgctggctatgacgggtggcatgaagcgcatctccgcgctcatctaccaggagacccaccgcttgctcaagatcatcttcgagcacctcatgctccaccccttcatctacacctagcacgtgct

SEQ ID NO: 66486 - DNA, 292 bp, Zea mays
  Clone ID: LIB3076-032-Q1-K1-B6
tccaacttctggactaccttcagtttctgcgcactacggtgcctataacttgggcaagcagatggtcccatgctattacttccataaagggaactgcttgaagggtgatagatgccctttctatcatggaccacaaacagctagtaatgatcttgcagagcatgcggcgaaggattcttcctttcctttggaaccgtcccatgctcaaaataacgaaaaggctgtagctccaaataattcaacgcatcatgaggcccgaatgactgaatacaggacttctattcatgttttt

SEQ ID NO: 66487 - DNA, 365 bp, Zea mays
  Clone ID: LIB3076-032-Q1-K1-B7
cggacgcgtgggcggacgcgtggggtggtcgttcagagcgatcccggccttggcgtcgaggatgctcgacctgctgtcaccaaggaagtcggtagaaaccagatcctcttccacataacccatgatacccttgagtggaccctcggaagcagccttaatagctttcttgatatcctcataggaggcccccttctcgattctgacggtgaggtcaacaaccgagacatccacagtaggaacacggaaggacataccagtgagcttgccattcagatcaagaagaaacttaccaacagccttggcagcaccggtgctgctaggaatgatgttaaagctggcagccctggcacctttcaagccttggc

SEQ ID NO: 66488 - DNA, 376 bp, Zea mays
  Clone ID: LIB3076-032-Q1-K1-B9
attcatatctgtccaccagtgattaagccatctaaactcggtgaaagtctcaggggtttgtctgcaatagtggagaatgaacataagaggctgcttgcaaggaagtccatcattgaaaaacgtaaagaagagcttgagcgtcaaatattggagaaggaaaaagaagaagaaaaaaagagaatgagcagtcaaaagaaaactgcagatgatgaaagggtgaggcttctcaatgaacagaggcagatggagcaggaccggattcgtagagagatagaggaaaaaaattaagcagaagcataaaagttgctagaagatttgaataatgcatggaaaaaacatgtctatgttgaatgggagcttactaaagaggccatta

SEQ ID NO: 66489 - DNA, 411 bp, Zea mays
  Clone ID: LIB3076-032-Q1-K1-C10
cggacgcgtgggcggacgcgtggtgcggacgcgtggggacgcggggctcctacgggttcggccacttcagcatgcacatgaagctcgtcggcggcgactccgcgggcaccgtcacggccttctacctgtcgtcgcagaactcggagcacgacgagatcgacttcgagttcctgggcaaccggacggggcagccctacatcctgcagaccaacgtgttcaccggcggcaagggcgaccgcgagcagcggatctacctctggttcgaccccaccaaggagtaccactcctactgcgtcctctggaacctctacatgatcgcgttcttcgtggacgacgtgccgatccgggtgttcaagaacacgagcgccgacctgggcgtgcggtacccgttcagccagccgatgaagctct

SEQ ID NO: 66490 - DNA, 359 bp, Zea mays
  Clone ID: LIB3076-032-Q1-K1-C11
cggacgcgtgggcggacgcgtgtgcggactcgtggggacgcggggctcctagctcttcggccacttcagcatgcacatgaagctcgtcggcggcgactccgcgggcaccgtcacggccttctacctgtcgtcgcagaactcggagcacgacgagatcgacttcgagttcctgggcaaccggacggggcagccctacatcctgcagaccaacgtgttcaccggcggcaagggcgaccgcgagcagcggatctacctctggttcgaccccaccaaggagtaccactcctactccgtcctctggaacctctacatgatcgcgttcttcgtggacgacttgccgatccgggtgttcaagaaca

SEQ ID NO: 66491 - DNA, 392 bp, Zea mays
  unsure at all n locations
  Clone ID: LIB3076-031-Q1-K1-H5
gcggccacgcgtccgcccacgcgtccgcaatttaccgctgacaccctccacaaaccgcgaatgtcctccccgggtcctctccctcctccccagtcaatccccacacagtctcggccgggccctcgcgaggccgccgtggaaggacccccagcgatgggctccggcgaggaggacacaggaggcggaggaggggcggtgcggggcgcggtgctgaaggcgctcgtggttgtcggcggcgtcctgctgctccgccgcctgcgccgctccactacccgatgggaccacgcgcgagccgtcgccgacgcgctctncggagaaaagttctcgagggagcacgcgaggaaggatcctgacaacttcttcaatttgagaatgctcacatgtcctgcaac

SEQ ID NO: 66492 - DNA, 398 bp, Zea mays
  unsure at all n locations
  Clone ID: LIB3076-031-Q1-K1-F4
agggagtccctgttatttataattccagcatttggagggactgtttcatgggaaggagaaggagctccatttaaagaaatagacgaagatatcactcaccagattgttgataggccgacacaaagccatgttttcctctccagggagtatgttcaaccacagtgggtctttgattgtgtaaatgctcgtatcatattgccgacagaaggttatcttgttggaagagtacctncaccacatttgtctccttttgtggacaatgatgccgagggatacatgcctgagtatgcagagacaataaagagactgcaagctgctgctcgcaatgaggtgttgcctcttccaggtattggtgatgaagatctagacaattcacttgtagcagcaatgatggatcg

SEQ ID NO: 66493 - DNA, 426 bp, Zea mays
  unsure at all n locations
  Clone ID: LIB3076-031-Q1-K1-F5
ctgccatgtttgatgctgttctcagaaactttacaccagatgtgccggctggaataactgctcggcctaggcaggaagatgctcaagagtttttaagttttgccatggatagaatgcatgatgaactgctgaaacttaatggagatggtttgaattcaaaggaggggatggttgtttcatccgctgatgatgatgcttgggagacagttggacgaaagaacaaatctgcaatagttagaactcagagttttgtcccctctgagcttagtgctatttttggagggcagctacagagcgttgtgaaagctgcaagtaacaaagcatcagctactgttcagcccttcctactgctccatctngatatattcccagatgcttgtcagacgcttaatgatgcanctcggctggtctctactcctgaatctt

SEQ ID NO: 66494 - DNA, 228 bp, Zea mays
  Clone ID: LIB3076-031-Q1-K1-F6
ctagacccgccgtcgcctgctgatgctctccgaaccctatccctcctcatctgccgggtggaactacggcacccattacgctcaaacatgctgaatagctgacgcaacatgcactggctcggacacatcatgaacatccgatacttcatctacaccaagtgctttcccaaggataaagctatcaaacatcccttggtgatgaacattggtaaacaggctgacgaaaga

SEQ ID NO: 66495 - DNA, 289 bp, Zea mays
  Clone ID: LIB3076-031-Q1-K1-F8
gtgacttcgccgcggctcctcactagctatgctgcgcgtggtggaccgggctaccgaagtaaccactaatgcaatgcgcaagcaggtgagagcctgaacatgagctacctgagcccgaacctggaggcctgaggctccgacttcacgggcggcgccaacttcaccatctccagctcctacacgctgccccgcaacgtccccttcgcgctccacgaccaggtccagcagttcctccacctgaagcagagctcgctcgacctcgacgcacacggtgggacggatcccgtct

SEQ ID NO: 66496 - DNA, 463 bp, Zea mays
  Clone ID: LIB3076-031-Q1-K1-F9
cgcaattttctcccacgtctctcttctgcccacttgcctccgtctcggcctgcccctccgctccccgcccccgagacatccggcgccatccgcacccccgcaccccaactcccctcgtccttcacggtcgcgatggtggtgtccatggcgtcgccttaggggcgatcgatctaggagaaagtgctggagcacgtggcgtcgtaccaccagcaacaacggaggcagaagctacgcaagagcctcacctacaccggcggcgagctctcgttcgctgttcggggccatggggacgacctcgcctccacgtccgtcggggcatagaaggaggacatgcctcttgagcacgtcttcaaaatcattagatccgatggcaaaagtgtgtgtttatggttcctgagtcagatgatctttcttcagttttagatgtgatagatattagtatgaaagattaaaactagaatgc

SEQ ID NO: 66497 - DNA, 236 bp, Zea mays
  Clone ID: LIB3076-031-Q1-K1-G1
aaggcacctgatagtttatctctcatttctgaaatcagcatctaaagcaactttacgacattatcacaacctccatctgctaactcttccaacatgatctaattcaaatcaaataccacaaatacctctttatactaacatcacatatgaacatcataatcaaattcaatcattattctataactctctactcatttaaaataactctatacaaactctatccttctaatacccct

SEQ ID NO: 66498 - DNA, 409 bp, Zea mays
  Clone ID: LIB3076-031-Q1-K1-G11
ggggaggcatcgtcctctccgtgctttctcagaggtgggttggcttctcctgccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgat

SEQ ID NO: 66499 - DNA, 366 bp, Zea mays
  Clone ID: LIB3076-031-Q1-K1-G3
gagacgaacaacaaggacatggacgcaactgcttgccttgcgatgttcggtggcctcgagctgaagcacgaatattctgaggtggccagaaaaatgctggataggcttcaagaattaagcaagaagtcagatgggaaggtcttggcgatcgatttgcggaccgacttgctggaaaagaagagttgcaagacaacccgcggcgctcgaagaaaaggctgttatagccctgatgaggtcctggctttcctgaggagtgttggcttctctgctaacacaaccatctacttgacagagacgtcgtggtacaaaggcctggatgttctgaaggaagaattcccaaacacttggtataaaggtgacattatg

SEQ ID NO: 66500 - DNA, 336 bp, Zea mays
  Clone ID: LIB3076-031-Q1-K1-G4
cttctcctccccttccggttcgggttcggtttcgtgaggttctccggggttcgtttgggggtgagcggatcgagatggcggcgtcggatgttgagtaccgctgcttcgtcggcggcctcgcctgggccacggacgaccactccctccacaacgccttcagcacctacggcgaagtcctcgagtccaagatcatcctcgatcgggagacgcagaggtcccgcggcttcggcttcgtcaccttctccacggaggaggcgatgcggaacgccatcgaaggcatgaacggcaaggagcttgacggccgcaacatcaccgtcaacgaggcccagtcccgcg

SEQ ID NO: 66501 - DNA, 412 bp, Zea mays
  Clone ID: LIB3076-031-Q1-K1-G7
ctggagaagctctacgcatgggagaagaagctgtttcttgaggtcatgagttacgaggggtataagcaggagcatggtaagaaggtcagtctgttgaggaagcaagaggtgaagggtgtggattacttgaagatggagaagaaccagatggagattgagagcctggagtccaagatgctggttgccaaccagtccatcgagaccaccacttctgagataatcaggctcagagaatccgagctatttccccagcttcttgagctgattgctggcttgatgagcatgtggaggggtatgtacgagtgccatcaagttcagacccacatcgtgcagcagctggagtacctgaacaatgctcggaataccaacccgacttccaatgtccaccggcaagcaactctttaactcgaga

SEQ ID NO: 66502 - DNA, 288 bp, Zea mays
  Clone ID: LIB3076-031-Q1-K1-G8
cacacaagtcacacgcacacccgctagcccccgtcccccgtcccgcccgtaccttcctgcgccgcctccgtcctcgttccaaccgtgggcagcaggcaggcccaagtatctgcagtagattggtggagaggaagaagacggcaggcacccacgcagatcaaacgtgctccgccacccttggtttcagcgaatcggcgccgtacgccgtaaatcgagccgtctccgagcagatcgacgcgctgcatagcaattcgacccgtctacggccaaatcgacgtccagagctgc

SEQ ID NO: 66503 - DNA, 133 bp, Zea mays
  Clone ID: LIB3076-031-Q1-K1-G9
acccactcatcctcacacacctcctctccacctctctaacactttctaccatctctatctctcccagaatacgcgaaattcccaacgcctcttcccatcctcaactctccacaactgcctcactcctaacacc

SEQ ID NO: 66504 - DNA, 447 bp, Zea mays
  Clone ID: LIB3076-031-Q1-K1-H1
gcgcccacgcgtccgaagtggcacagtttaaatatcttgctaaccgtgtgacttctgagatgggaaatgcaggagacaagatcacctttaaccggcagcatgtacttgaaacctgaagtcagtcaagaatccagtgtagacacctgtacaagtgagataagaagttcatcatctggcaagcaaagaaggttccgttcaccgttgtcagtgagagagctagacgataagtcacctgtcatcagcagggaactgtacctgagtgcgcgaaagtacaagactccctctcctccggttagaagctcactctctgtcgagagaggcagctttgccaaaatcgtggagaacactggaagcatcgactgcacaccgattttcaaggtccaaatgccttcaaaagtgtggtccagcttcagcaactcgaagaccacaccttgatctgtcctgaca

SEQ ID NO: 66505 - DNA, 357 bp, Zea mays
  Clone ID: LIB3076-031-Q1-K1-H10
cggacgcgtgggcggacgcgtgggttttttttttttttttttttttgtcagggacagaggacgtagcaccagtaacgactacgtataagatttgctaaatttaaacacgcaacgccagtgcacactacgcatgcagacaatggatcgaacgagaagcaagcagcaagcttgaaactatgcatagtccacgaggtaagctgcctctgcctacttgcagctggtcgcttagccgagcagcttcttgacggcctggaacctggcgtccttgtcgccgaacttggtgccctggtagtagtctagatagtccccgaacctgtaaggaccggggtacgcggcggcgccggcgtactgatccct

SEQ ID NO: 66506 - DNA, 332 bp, Zea mays
  Clone ID: LIB3076-031-Q1-K1-H11
tttactctttctttcttttctttttgattttttatgtcttttttaattctaagctttttgcttttaattcaatggtgaatgttattttcaatttttttaagatagaagacacacgcaaggtgttcgatgaaatgataattaagggtctcgcgcaccgatattgtcatttacaacaccttagtgcctgaatattagaaggcatgatgctcacataaaacattgtaagtgtaaaaacacatgacacacaaaagtatcattccatacgttatgacatttacttcattgatccatgtaatgtgcaaagctcctaacttttagcccttactaacatt

SEQ ID NO: 66507 - DNA, 449 bp, Zea mays
  Clone ID: LIB3076-031-Q1-K1-F3
cccacgcgtccgaaaggcacctgatggtacatctctcaaaactgaagtcagcagcaagggcagctccacggacagcaccacctcctccagctgctgactcttccagcatgagcgaattcaaggcgattgccgcagatgcctcggtgttctcgttcggagatgaagatgattatgaaagtgagtaatgattctatgggtgggtacggtgttgagtttccgctgtacagtttggtgcttctaggacccctcatcatagaatgccaaagtccagagatgttaattcattcttgcatttcgtctccactgtagcagtgtcatcggtctgatgttgtacccagatgatgaaacttgttgtaactcaaccaggtcttgaacctctcctgtttgtttacagaaatgccttgtacacgaactcacttaaacagcgcaactactttttattattgata

SEQ ID NO: 66508 - DNA, 330 bp, Zea mays
  Clone ID: LIB3076-031-Q1-K1-H3
cgaccacgcgtgcgccacgcgtgcgcccacgcgttcgcaatttaccgctgacaccctccacaaaccgcgaatggcctccccgggtcctctccctcctccccaggcaatccccacacagtctcggccgggccctcacgaggccgccgtggaaagacccccagcgatgggctccggcgaggaggacacacgatgcggaggaagggccgtgcggggcgcggtgcttaatgcgctcgtgggtgtcggcggcgtcctgctgctccgccgcctgcgccgcttcactacccgatgggaccacgcgcgagccgtcgccgacacgctcttccgagaaaa

SEQ ID NO: 66509 - DNA, 413 bp, Zea mays
  Clone ID: LIB3076-031-Q1-K1-H4
cgtccgccgacgcgtacgcaatttaccgctgacaccctccacaaaccgcgaaggtccttctcgaatcctctccatcctccccagtcaatccccacacagtctcggccgggccctcgcgaggccgccgtggaaggacccccagcgatgggctccggcgaggaggacacaggaggcggaggaggggcggtgcggggcgcggtgctgaaggcgctcgtggttgtcggcggcgtcctgctgctccgccgcctgcgccgctccactacccgatgggaccacgcgcgagccgtcgccgactcgctctccggaaaaaagttctcgagggaacaggctaggaaggaacctgacaacttcttcaatttgagaatgctcacatgttctgcaaccgagatggtggaatgttcaagggtgcttta

SEQ ID NO: 66510 - DNA, 365 bp, Zea mays
  unsure at all n locations
  Clone ID: LIB3076-031-Q1-K1-C9
aactatggaagctcttaatgttccattagcagttacacctgttgtgactttctgggatntttgtatagtgtatactgaaaattacacttttttcactggaaagtgttatgcatcaccagatgatgatataatacattggtccaagttcccatcatttactcctcttctgtgtcagattgatacatatggtggcaagtctctggactttatcaactatccttatatatttatgagatggaaagagcaatattttgtcaacgttggagtctactgtgggttaaccatctctggtttctactacgtctgcttttcttgtatctatagctccattaatggaatttattatgatccaaatagcattccat

SEQ ID NO: 66511 - DNA, 296 bp, Zea mays
  Clone ID: LIB3076-031-Q1-K1-D1
gcgcggacgcgtgggcgacgacctcttcttccccttccctacccctgcctcgtcctgcccctacatcaccgcgtcctccgcccaccaccgcttcctcctcgacgaccaccccttctacccaacctcctgcccgctcggcatcacctcccgctccccgatcgacgacaccttcgacctcgacctcctcctccccctccccctccacgccgccgtctccgcgcccccgtgcgcggccttcaacttcgaccccttcctcctcgacaccctcggccaccgtatttccgtcctcgagcgcg

SEQ ID NO: 66512 - DNA, 406 bp, Zea mays
  Clone ID: LIB3076-031-Q1-K1-D11
acgcactcgttcggactgctcttagtgtgaccggtttaacagtgagcggtcgattgggtttcggggagagggggtcctctatgtcagcgactacggatgctgcaaagagcggctcagcctcaccggtgctgtgccagcggatcggctgcgacgccgtattcaccgacgatgacaacctctagggctcctgccaataccaccccttcgcacctatgtttcatgactgcatgaaagaatggatctgctgcaagcaaagaatccatgatttcagcttatttttgcagatacctggatgcacaacatgaaagcatacaaccgaaaaaccaatcacaaaagctgtttcatctaaccgtacaaaggcaacaccgatccaatcctttaatcatggtgtgggagttgatgtgtg

SEQ ID NO: 66513 - DNA, 373 bp, Zea mays
  Clone ID: LIB3076-031-Q1-K1-D2
gcgcgtaccccgcctcccggttcaaccaaatccctctcgcctcatccccaccagcgcaaaggcgccctatcgggctgtcgtgagaagcaatggcgggccgtggcaaggcgattggcgctggtgccgcgaagaaggcgacgtcaaggagctccaaggctgggctgcagtttcccgtcggcaggatcgctcggttcctcaaggccggcaagtacgccgagcgcgtgggcgccggcgcccctgtctacctcgccgctgtcctcgagtacctcgccgctgaggtcctggagcttgctgggaacgcagcgagggataacaagaagacccgcatcgtgccgcgtcacatccagctcgccgtgcgcaacgacgaggagct

SEQ ID NO: 66514 - DNA, 333 bp, Zea mays
  Clone ID: LIB3076-031-Q1-K1-D7
ggaagctgccccaacaacaaatgtcagcatcttccctgtggcagcaggcgggagggtgggggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctgggg

SEQ ID NO: 66515 - DNA, 148 bp, Zea mays
  Clone ID: LIB3076-031-Q1-K1-D9
atcaaatatggtttaaagattttaaaaaccgaaactctcttcggctttccgtaaatttaacatgacatacgcacactacatcatcttattacattctcataatcacatacaaactaccaccaaaaaatcctacaaattcttaatcaac

SEQ ID NO: 66516 - DNA, 453 bp, Zea mays
  Clone ID: LIB3076-031-Q1-K1-E10
cggacgcgtgggcggacgcgtgggtccaatcgcagcatagcccctagcgccgccggtctgttcagggtcgcagcacaccgccgccagcccgagtgaccgctgcagcctagggtttccggcggcgatggcgggtaagggagggaagggtctgctggcggccaagacgacggcggccaagagcaccgacaaggacaaggacaggaagaaggcccccgtgtcgcgctcctcccgcgccggcctccagttcccggtgggtcgcatccaccgccagctcaagtcgcgtgcctccgcgcacggccgcgtcggcgccaccgtcgccgtctattccgccgccatcctcgagtacctcaccgccgaggtcctcgagctggccggcaacgccagcaaggacctcaaggtcaagcgcatcaccccgcgccacctgcagctcgccatccgcggggacgaggagct

SEQ ID NO: 66517 - DNA, 263 bp, Zea mays
  Clone ID: LIB3076-031-Q1-K1-E11
acgcactcgtcctcaccagtctccctcgcacgtttttcagcttctctccaaatctcgcccatctggagccacgtgtctctgtaatacggcgtacaggataagaggcgctatggagccctcctagcgaatcgagtcccggactgctctggagaatctgcctaggagcatggcgctgcctctgacgcccatcatggtgactgtgccgtctgctgcgaatcatggtctccaggagctgctctcctcctcgctgccagctgccggca

SEQ ID NO: 66518 - DNA, 373 bp, Zea mays
  Clone ID: LIB3076-031-Q1-K1-E4
gctgcctctacatcccacggccgctaccaccttccccctacctcacacggccgccggcgtctccaaggtgtgcacacgcaggaaaaaccttgccacgagtcgccgacactccatcccggaagagctaacgaggtgactccccaccgcgcccatgggtgacagccagtactccttctccctcaccaccttcagtccgtcggggaagctcgtgcagattgagcacgcgctcacggctgtcggatccgggcagacctcgctcgggatcaaagctgccaatggtgtagtcattgccactgagaagaagctgccttctattttagtggatgaaacatctgtgcaaaagattcaggcactaacacctaatattggagtt

SEQ ID NO: 66519 - DNA, 291 bp, Zea mays
  Clone ID: LIB3076-031-Q1-K1-E6
cgacacactcctgcggctgcctctacatcccactgccgctaccatcttccccgtttctcacacggacgccgaccgctccaatgtgtgcactctcaggaaaaaccttgccacgagtcgccgacactccatcccggaagagctaacgaggtgactccccacctcgcccatggctgacagccattactccttctccctcaccaccttcagtccgtcagggaagctcatgcatattgatcacacactcacagctatctgatccggtcatacctcgctcttgatcaaagctgccaa

SEQ ID NO: 66520 - DNA, 335 bp, Zea mays
  Clone ID: LIB3076-031-Q1-K1-E7
cccacgcgtccgcccacgcgtccgccgactcgtccgcctcggcctcgccgccgcatctagatctgtagccgccggccgccgggtagcttcctctccgatcgcttccgcaggctactccgccgccgcgtccaggggctccgtctccagcaccaggcccttctccacggctcttaactaccaccttgattccccggagaacaagccggacatgaaatgggagttctcacaggcgaatatgaagaaggtcaatgagattctgtctcactatccaagcaactacaagcaatctggtattattccgctgcttgatcttgcacagcatcagcatggtggat

SEQ ID NO: 66521 - DNA, 299 bp, Zea mays
  Clone ID: LIB3076-031-Q1-K1-E8
gcgcgtagagccgccgtcgccgccgtttcgcgcaccgtaccctagccctcgtcagcggcggcgtcgagctcagccagccatgacgttcaagcggaggaatggcggacgcaacaagcacgggcgcggacacgtcaagtacatccgctgctccaactgcgccaagagctgtcccaaggataacgctatcaagcggatcttggtgaggaacattgttgcacatgctgccgtcacagatgtgcatgaggcctgtgtacatgatggatatgttctacccaaattgtttgcaaaggtttatcact

SEQ ID NO: 66522 - DNA, 433 bp, Zea mays
  Clone ID: LIB3076-031-Q1-K1-E9
gtgccatgaagctgaagctcctctctccctgccttctcctcctcgccttctgtgccacgggggcgtacgcggcgtcggcgtcggcgtcgcgcgcggcggccgtcgtcaggggcgcgggcgccccgtcgcagtcggagttggagtcggacccggagaaccagtgcgtgtacacggtgtacgtgcggacggggtccatctggaagggcggcacggactcgaccatcggcgtgacgctgctgggccccgacggcacgggcatccggatccgggacctggcggggtggggcggcctcatgggcgccggccacgactactacgagcgcggcaacctggacatcttcagcggccggggcccctgcatgagccaggcgccctgcgccatgaacctcaccttcgacggcaccggcgcgcaccacggctggtactgcaacta

SEQ ID NO: 66523 - DNA, 369 bp, Zea mays
  Clone ID: LIB3076-031-Q1-K1-F11
ctcaattttctcccacttctctcttctctttactttcctccgtctcttcctgcccctccgctaactttccacgagcatccggctccatcctcacccccacaccccaactcccctcgtccttcacactctccattattatgtccatatcgtctccttattttctatctatctatgataaaattctttatcacttctcttcataccaccatcaacaacttattcataatctactcaagatcctcacctacactctctgctatctctcattctctattctttgccatatttactacctctcctccactttcatcttttcatataatgactacatgcctctttatcacgtcttcaaaatcattatatcctatc

SEQ ID NO: 66524 - DNA, 434 bp, Zea mays
  Clone ID: LIB3076-031-Q1-K1-F12
acgcactcgacctctcaattttctcccacgtctctcttctgtttacttgcctccgtctcttcctgcccctccgctcccttcccacggacatccggctccatcctcaccccctcaccccaactcccctcgtccttcactgtctcgatggtggtgtccatggcgtctccttatggtctatctatctatgataaagtgctggatcacgtgtcgtcataccaccagcaacaacttatgcagaatctactcaagatcctcacctacaccgtctgctagctctcgttcgctgttcggagccatggggactacctctcctccacgtccgtctgtgcatataatgacgacatgcctcttgaacacgtcttcaaaatcattatatcctatggcaaaagtgtgtgtctatgattccctgagtcaaattatctttcttcaatatt

SEQ ID NO: 66525 - DNA, 296 bp, Zea mays
  unsure at all n locations
  Clone ID: LIB3076-031-Q1-K1-C7
cctacttcttcctcnttcttcccctacatcacctaagactctttccaaccacctttcctcctccactaccaccccttctacccaacctcctacccactctacatcacctacctctcccccatctactacaccttctacctctacctcctactccccctcccacttcactccaccatctccacacccccatactcatccttcaacttctaccccttcctcctctacaccctctaccaccacatctccatcctcaaactctctctctccctcaccccaccccctcacaaatacaccta

SEQ ID NO: 66526 - DNA, 375 bp, Zea mays
  unsure at all n locations
  Clone ID: LIB3076-031-Q1-K1-F2
acgcgtccggtagagccgccgccgccgccgtttcgcgcaccgtaccctagccctcgtcagcggcggcgtcnanctcggccagccatgacgttcaagcggaggaatggcggacgcaacaagcacgggcgcggccacgtcaagtacatccgctgctccaactgcgccaagtgctgtcccaaggataaggctatcaagcggttcttggtgaggaacattgttgagcaggctgccgtgagagatgtgcaggaggcctgtgtacatgatggatatgttctacccaaattgtatgcaaaggttcatcactgtgtctcatgcgcaatccatgcgcacattgtccgtgtccgctctcgtgagaacaggantgaaccgtgagcc

SEQ ID NO: 66527 - DNA, 276 bp, Zea mays
  Clone ID: LIB3076-031-Q1-K1-A8
ctccgatttaccatcggttatgacatccgaaaaaaccaggacgtctccaaccccttttaaaacgatatacggcttttaaactctacggaagaactaaacaacataatccaacatgcaaaacatcaccatcatttgactgaccactatctgatcaatcaataaaacctaccacataacctgtgaacaaacgatctacttaactctgacttactgaaaaaattctacacaatcaattactccacatctacttcacaaatttacaacaatctattatac

SEQ ID NO: 66528 - DNA, 327 bp, Zea mays
  Clone ID: LIB3076-031-Q1-K1-A9
actcgtgcggggcattcatccaggctaggtccattccttcctttgctcgttctcttctccatctcgggagctccagcctagttgactccagaagagaatcggtgccctagggtgttctcgcataattattttccagaagatttgcagatcgagtcgaaccctatgccccacgttaagcctgcctccgtcctgccctcttaccaccaccgggcgctccctggccccggtcagggtccagttcccacgggacatgggatgatgcaccgggaggtccgtgatcagtacgggccgcctggtccgaggatgcacctaccaccgctggggcac

SEQ ID NO: 66529 - DNA, 405 bp, Zea mays
  unsure at all n locations
  Clone ID: LIB3076-031-Q1-K1-B11
gtggaacgatggaagcgcttaatgttccattagcagatacacctgttgtgactttctgggagggggagatagtggatgctaaaaattacacttttttcactggaaagtgggaggcatcaccagatgatgatataagacattggtccaagttcccatcatttacgcctcttctgggtcagattgagacagatggtggcaagtctctggactttagcaactatccttatatatttatgagatggaaagagcaatattttgtcaacgttggagtcgactgtgggttaaccatcgctggtttctactacgtctgcttttcttgtagcgatggctccattaatggattntattatgatccaaatagcagtccatttcagaagctcgagctgaaatgtaccaatggggaaa

SEQ ID NO: 66530 - DNA, 461 bp, Zea mays
  Clone ID: LIB3076-031-Q1-K1-B12
gttcgacaaagtccgttactctagagatacaaagctcagtatagtgcttgtccttgtaggtgttgctgtatgcacagtcactgatgttagtgtgaactctcaagggttactagctgcagtaatagctgtttggagcacagcactacagcagcattatgttcaccaccttcaatggaagtactcgcttggctcattcaacctcttaggccatactgctccagcccaggcagcatcgttgttagtattgggtccttttgtggacttctggctgaccaacaaaagagtcgatgcttttaactacacatcaatagttacgttctttatcgtgttgtcgtgcataattgctgtcgggaccaacctaagccagttcatatgcatcggaagattcacggccgtctcgttccaagtcctaggtcacatgaagacggttctcgtgttgacccctgggttctttttctttg

SEQ ID NO: 66531 - DNA, 412 bp, Zea mays
  Clone ID: LIB3076-031-Q1-K1-B2
taccaggtttgctctgcggttttatcctataccatcttgggaagtttagagggtttttaccgcacatgaataggggtggttctgctcctgaagctcaagctcagaatgtctatccattgattggtcgtaaagtgatgagtctgtggcctgaatacaatagtttctatgaagcagtcatatacgaatattatgcttaaactggccttcatacacttgtttatgacatctattctgcatattaaaaccttctattctttgatcttaaataaatggtacctgaatacataatatcgcaatatgatgactcttggatagtcctctttacatatcttctcaatctttgttgcccaacttgttgccttattaaaccagcatttctctgtgttcccattcccatttcttttatatgaaa

SEQ ID NO: 66532 - DNA, 253 bp, Zea mays
  Clone ID: LIB3076-031-Q1-K1-B3
acctatccatcttcaggagtttagtaattttacccacataatagggtattctctcctaaactcaactcataattcaaccattattgtctaaaattataatctttgcctgaatacaatattctataatcttcatatctaatattattctaaacgtccttcattcactatttatacatctatctcatatgaaacctttaattttttatcttaaataaatgttacccgaatacataatatttcaatatgatgactc

SEQ ID NO: 66533 - DNA, 326 bp, Zea mays
  unsure at all n locations
  Clone ID: LIB3076-031-Q1-K1-B4
atctcgtcgagaggaagcccaatcccgaatccgtcgccgtattccaatggcgcccaagggcgagaagaggcccgccgccaagaagcctgcggaggaggagccggcggcggagaaggccacggcggggaagaagcccaaggccgagaagcggctccccgcgggcaagtccgcaggcaaggagggtggcgagaagaaggggaagaagaatgcatagaagtcggtggagacgtacaagatctacatctntaaggtgctgaagcangtgcacccggacattggcatctcgttcaaggccatgtncatcatgaactccttatcaacgacat

SEQ ID NO: 66534 - DNA, 342 bp, Zea mays
  Clone ID: LIB3076-031-Q1-K1-B5
ggtgagaatgtaccaggtttctctgcggttaagcctataccatcttcagcgggtcttagtggaatttgaccgcacatgaataggggtggttctgctcctgaagctcaagctcagaatgtcgatccattgattggtcgtaaagtgatgagtctgtggcctgaatacaataatttctatgaagcagtcatatacgaatatgatgcttaaacgggccttcatgcactggtttatgacatccatactgcagatgaaacctgggagtgggttgatcttaaagagattggacctgaaaacataatatggcaagaggattactctgggatagaccctgttacatatctt

SEQ ID NO: 66535 - DNA, 395 bp, Zea mays
  unsure at all n locations
  Clone ID: LIB3076-031-Q1-K1-B6
cccacgcgtccggttgaggtgtaccacaacctgaagagcataatcaagaggaagtacggtgaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcanacaaaatttcaggcgacagcctgaaagacctgtacaagtcctttgtttctgagtaccctatcgagtcgatcgaagatccatttgatcaggatgactggagcacttatgccaaactcactgatga

SEQ ID NO: 66536 - DNA, 299 bp, Zea mays
  Clone ID: LIB3076-031-Q1-K1-B9
cccactcgtgcgatctagctattcatgttactataatcttacctctaactataccaagggacaacgggccgagacagatagaggtacggtctacacaatgcttgactagctgatcatcttcaccaatggacagcctattctagcttcactatgacggccgctcggcgctcgagacgacacagactgacatatccacggcctgatgcactgctgactactagaggacctatccggatactcaagcttgtctcaggacaattacggtgttaaatctaccttacacaacgacctccgccttg

SEQ ID NO: 66537 - DNA, 391 bp, Zea mays
  unsure at all n locations
  Clone ID: LIB3076-031-Q1-K1-C1
gtcagttggttagggcttccatatacattcacaatcttcaactntggtgtgcagaagacggtgtataacgggcaattattcctatgcgtggcagttggtctgtgggcaggactagttattggatttgttacggagtattacacaagcaatgcatacagtcctgtacaggatgttgctgattcctgcagaactggagctgctacgaatgtcatctttggccttgctctgggatataaatccgtcattatccctatttttgctattgcttttagtatttttctcagcttcagccttgctgccatgtacggtgttgctgtggctgctcttggaatgctcagcacaatcgctactggccttgccattgatgcctatggtcctatcagtgacaatg

SEQ ID NO: 66538 - DNA, 289 bp, Zea mays
  Clone ID: LIB3076-031-Q1-K1-C10
ctataaaaactccgatttttcgtttaacaaattcaccttttattacgctttccgcaaatttttataatgcctactcaatatcacacttttaacacctataaaattcaatcatcaccacataataattttatacatacttccaatttcccatcatttactcctctccttattcatattcacacaaattacttcaacactcttatactttaacaactatccatatatatccattatcatttaaattacaatattcattcaactttttactcaactataaattaaccatcac

SEQ ID NO: 66539 - DNA, 364 bp, Zea mays
  Clone ID: LIB3076-031-Q1-K1-C2
gcggccatttcgaagctgctcctcgcgattccaatccacgcacgccatctccgactccgcgggcgcctcgcggaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaagacctgcaattgctgcaactgtacgtgtggcagttcctcaagtcgaggagaagactatcgtcgtgcaacctatgcatg

SEQ ID NO: 66540 - DNA, 323 bp, Zea mays
  Clone ID: LIB3076-031-Q1-K1-C3
attcccgttcgacccactcatccggtcatttcgaaactgcttccatatacatctatacactcacactatcttctactccacacgctgctttacgaacacatatatccattcatggcacacaatctagccgcatgactacacactgaattcccaaccctatacatcactaacctatgcatacattccaagcacatgacaccatcaacatcctctacaactgccacaactacaaaattcataatcagcatcactcccagatatcaatcccccacaatccttacattttctattgctcttataattttaaacaaccttcaacttct

SEQ ID NO: 66541 - DNA, 322 bp, Zea mays
  Clone ID: LIB3076-031-Q1-K1-C4
gggctccatgatggtgcctgatggacctgagacccaccttgttctctgggatctccgcgcccttgccgggactggaaacaaggttgaaaagctatgtgatctttgccacatcacattgaacaagaatgctgtcttcggtgacagcagtgcattgtctccgggtggtgtccgcattggcgcgccagcaatgacctcgaggggtctactggagaaggatttcgagcagattggggagttcctccaccaggcagtgaccatctgcctgaacatccagaaggagtacggcaagctcctcaaggacttcaacaagggcctggtgaac

SEQ ID NO: 66542 - DNA, 343 bp, Zea mays
  Clone ID: LIB3076-031-Q1-K1-C5
aattcccgcctcgacgcacgcctcctaacgctcacatctacattctctatctgcgtttccgccgttaccgatcacgttctctaacgcacccttatacccatacctggcctccgatctctatccacaactagctacagaataatctacagatcattacacacacaatgcatacagtcctgtccatgatgttactgatacactgcacaacttaaactgatacaaatgtcatcactagccttgcaatatgatctaaattctacattatccctattcttgctattgctacacttactcttcttaactttaaccttacttccatgtacgacattgcttgagctcctct

SEQ ID NO: 66543 - DNA, 438 bp, Zea mays
  Clone ID: LIB3076-031-Q1-K1-C6
gggcgacgatgttccgtgactcttcgatttgcggtccgttgggggagggctggccaaggacggctacgtggaagcgagaaattacctgtcggcgcctctgaaccttctcaccgactactgggattcaagccacgggatggagtcctcccctgtgggcgttctgcagaagacgaccgccttcggatcggtctccagcagtacagggagcagccctagggttgagaaccacggcgcctacgacggtttcggcaacctgcgggatgatctcggctcaattgtagtgcgccatccaagcatccgcctcgtgtgagctttctgagtttctgaccatggaaaactgcaacaagactgcggcccgcatccatagaagtgggcatatgggctactatgctaatcctcaaagcgtgaggggggcatttaccttctagtttgtcattt

SEQ ID NO: 66544 - DNA, 299 bp, Zea mays
  Clone ID: LIB3076-031-Q1-K1-A7
acgcgtccgcggacgcgtgggcagacgcgtgggttgctacaccaccacacccactgaggcacaccccagcccagcatacaacaagcagcctggtttacggtagctgctagcaaaacaatggagaaccctgctccgagcatcgtagtggccatcgccgcacccgtggcggcggagttcgtgaagctcaccttccgtgccctgtatatgcgccgggctggtccaggcagcagggacatgactgtgccgggaaggccatccgaccaactgggcaggagagtcgtcactgacagtcccgtgta

SEQ ID NO: 66545 - DNA, 235 bp, Zea mays
  Clone ID: LIB3076-030-Q1-K1-G8
caccccataacatacccaaagctacgttcattttaaaacatcgcaagcccttccactactactcaactatatccacctctcattcacctctctctctctaaataaccaacaatcaaacttataatccatacttatctaaaattactccaatactacaatcactttacacttctctccaatcctctaaataacatataatccttacaacatctattctccatccatcactacccct

SEQ ID NO: 66546 - DNA, 327 bp, Zea mays
  Clone ID: LIB3076-030-Q1-K1-H1
caggatcaggggtgctcaatttaagacctgtgagtacaacatcatcaggcccattagctgagatggtctcttccatgagcggagatgtggcacgtgaatatcttgagaaagtagcagatcttcttttggagtttgcacaggcagacaccgtggtaaaatctctgatggccagccaaagccttcttacaagggtttttccaatgtttaacaagatagagcctcctattcttcttaagattcttaggtgcattaatcatttgtcgggtgatcctaattgtcttgagacacttcaacgcacagatgcaatcaaacatctgataccgattc

SEQ ID NO: 66547 - DNA, 305 bp, Zea mays
  Clone ID: LIB3076-030-Q1-K1-H10
tatcattaaaatatctatatacctcaaaataaattccattcttttaataaaatttcccattccatcccttatctttacaatcatatatccttactatcttttcactcaatctccaaaccttactacctatactatataaaaaaaatatcttatatttaattaactctatttctatcttatttcattcatcaaatatacaaactttcatctttcaatctattttccaacatctccaatcaaattctttccattcttttcatcattccaccaaaaccttatatattaatcctatcaatcaatacatt

SEQ ID NO: 66548 - DNA, 332 bp, Zea mays
  Clone ID: LIB3076-030-Q1-K1-H2
cacgcgtccgaaagctcagggaaaccctaattaagaccttgcagtactacataaatattcacctccacaagaaggttatactttaccatcagcattttgaccctttaatacataatgcatcacacatatcttttctacaaaaatcccatatttcacacaggtgattaatatctcatcaacatctaacatctttttacatcgcaattcaaaacttaaacctagatataaaattccatctaacttaaaaaaaattacactatcaatccaaaatccacaaaaccttactcgctatatactctacaccgattcaactcgcttaaacataccttaac

SEQ ID NO: 66549 - DNA, 367 bp, Zea mays
  unsure at all n locations
  Clone ID: LIB3076-030-Q1-K1-H3
ggccgcaccaggggtcgtcggcgccgccaaggctgcagagaaggccacggatctccaggggnggttaaatgctgatgaccagtgtcgtaaaggatcgactggacaagagaatggccaactgggagaaattctgccttcgacattgcttcgatgtacctgaaggttttgtggccgatgaaaatgatagttcttgtgcaaaagaatcacacaaaaatgggacttcagattcagatttggatttggaacttgactccttaaggagaaagctcgaaagtgctaacaaggagtctgaaaatcttgaaagagagatgtcgtcattggaaaggcaaagtatgcacaaaagaaaactttgattcttcaatctctg

SEQ ID NO: 66550 - DNA, 349 bp, Zea mays
  unsure at all n locations
  Clone ID: LIB3076-030-Q1-K1-H4
gtggcgcctgctgcgaaggctgcccatcctgcggcgaccaccaagttcccgaccaggcccggtcctccctccggacgggtcgggatgcacgcggcggtggctcatcagctcgtggaggctttggccgtggtgaacgtggccgtggcagaggtggacggggatatggccagaaccgtggcttcagtggtgacaatggcaatgagttccagggaggttatggtggcggaggctatggggatggtgctgtaactggtggatctgaaggagaaagggagagagacactcgtcccccgtaccgtggcggangcatacgtgggggttacaggaatgtttagtttggtgatgactc

SEQ ID NO: 66551 - DNA, 146 bp, Zea mays
  Clone ID: LIB3076-030-Q1-K1-H5
tctcaatttaacacctttgatttcaacatcatcacacccattacccgacaagatctttttcaagatcacgtatcctacccaccactatcctactaaatcaacaaatcctatttaatattcctcacaaattaacaccatttaccaca

SEQ ID NO: 66552 - DNA, 409 bp, Zea mays
  unsure at all n locations
  Clone ID: LIB3076-030-Q1-K1-H6
gcatttgtgttgcctagtcgagattctttaagcttgggagagaggacaatggcgtanccgtcctcgttgtgctgatggagacacggaagttaggaaagttgcaattcagatcattgcacttttcttcgacatttcattgtcacttccaaagcagaaggcatatcctaatgatattgatctggaatcctcgtatagtgctttgtcctcccttgaggagttagtctctattgtcagaagggaggcatctgttgatcaaactgaactatttcagagggttgtatcctcagtgtgtattctattatcaaaggatgagctggtcgtcttgctacactcttgtacgttggcaacatgtgataagataaaacagtcagcagatgcttcaattcaagctattatcatgtttattatc

SEQ ID NO: 66553 - DNA, 377 bp, Zea mays
  Clone ID: LIB3076-030-Q1-K1-H7
gatcaagctacagaaaaaagtatgatttgtctgacaccattaacttctaaccatgatttgacaacatagtttgggacgaaacctttagctcaatattgtcacacttagccacttaggctttaaagccaccatatgtgtgatatatcttatcagtctagtatatgataccatgcttgtttgtgtggataatttttactaaatgataacttggccaagaatttacctttatataaaaaaaaactcggccggggagggaaaagaccaccctcccggtattccatataagaagagaccgaaacaatggtcccggccgagaaaatccccgaaccctggcccctcatcactaacgggccgacgtcaactgtccactctgcaac

SEQ ID NO: 66554 - DNA, 296 bp, Zea mays
  Clone ID: LIB3076-030-Q1-K1-H8
gacaactgcgtgaagaacaagattgtgacggtgcagaacctgtgcaggcgactggttgactctgacgctggagccgctggccaacagcccgccgctgttcgcgggcacctacacgttgcacccgcgcagccacgccgagttccccgtgtgctggtggacggggcgcctgcgcgcgcccgacgccgcccaggtggagttccacgtcggcgtcgacggcggctccttctacctggcccccaacgcgcagccgggccagcgcgtcccggtctccgtcaccccgcacggctcgccgctgc

SEQ ID NO: 66555 - DNA, 365 bp, Zea mays
  Clone ID: LIB3076-031-Q1-K1-A1
gtagccatgtcgtctgcctcctcccctgcccccgcctttggctcctccctcttctcctcgtcctccgccgccgcttcttctgctccaacttttgggtcctccctgttcagggcctcatcggccgcgtccgcgccatcccttttcggtgcaacgcccgcatcctccgctggaacaacccttagcttattcggcgctgctacctccgccgcaagcagccctgggttcttcggcgccaccttcactgccgcaagcagccccggcctcttcggtgcgtccgccactggctctgcggcaacctccccgagtctgttcggtggcacctcgggcctattcggcgggacttcctccgcagcgaccaccccgag

SEQ ID NO: 66556 - DNA, 380 bp, Zea mays
  Clone ID: LIB3076-031-Q1-K1-A10
cccacgcttacgaccacgcgtctaaagatctcgatataaaccacaagtcttggggctctgtcgcacttcctacctgcttacattcattgcgcacttataaactctaacgtagaaaaattcatacattgcttcctccgacatatggcttgtacctgtgaactaataatccttcatcactacattgttaacttgcttgtattgtacgggacactaatgatggacttctgattgactctaattgacgaaagacaccacactcactcaatttccattaggacaactcctttgatacgtcattgaacccatactgcatcacattcgtcacggggaaccaatacatgacgttcagggtctgcatactcctcattatcttcacatca

SEQ ID NO: 66557 - DNA, 254 bp, Zea mays
  Clone ID: LIB3076-031-Q1-K1-A11
cggactcgtgggctgactcgtgggagaaaagtggaaagaaatgagactggtcacccgtcggcaatacgtataggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtg

SEQ ID NO: 66558 - DNA, 168 bp, Zea mays
  Clone ID: LIB3076-031-Q1-K1-A12
gacccactcatcctcccactcttactaccacacgttttaagatttcactctaaaccaccgtttttcgatctctgtccacttcaaacctcctttcctcctataaccaccacttacacactagctaataaaactccatacctcctttcctccaacagacacccatgacca

SEQ ID NO: 66559 - DNA, 363 bp, Zea mays
  Clone ID: LIB3076-030-Q1-K1-G5
ccgcaacctatagacccaatctcgtccgacccggcgcgtcgtcccctccagatcgccgtgtccctctccaggtggcagaaactgttctgcttcagtctgacaaagtggagggcttaggagtttctgcttcttttatgtctgaacaatctttgctttatttgggattgttgggagagtactctcgtgcaacgaggaaaaggcacaaggttccgttccactgcatgcgtcaagagcctgtctggttttcttgttctgatttgtcatttgctggtgctcaaagccggcttggtttcctcgaaggatcagcatctactcttgattgtggactttttcgcatctgatatcaacttcataaatctttat

SEQ ID NO: 66560 - DNA, 267 bp, Zea mays
  Clone ID: LIB3076-031-Q1-K1-A2
atttccgttcgaccgcacgcgtacggccactactttctctacccgttcgcatgttaccgcctacaccttctacatattgtcaatgtcctccttcgatgctttttctgctccaaattctatctcctcactgtctatggcctgatctatcgagtccgccccataactactccctgcaactccctcctgctacgatgacacaacacttagattatatcccgctcctacctccgtcctaaacactcttgtgttcttcggctccaccttcac

SEQ ID NO: 66561 - DNA, 362 bp, Zea mays
  unsure at all n locations
  Clone ID: LIB3076-031-Q1-K1-A4
gttctagatcgcgagggccgccctttgtttttttttgttttttttttttacaaaacgggggggggtgagaagcccctactggatacatttgacatgaatcaattcaagaagagtctctttctcacactcacacacatcaaacgagacattcgaaaaggcggcctcacacgaggtggctgcaaagctacaatgcacctcgtgaaatgcttcaacatcgagcacattggggcgacaaacatagccatcatcttctttgccacgctgcccttcatgccattgccaggcgccttcgactaagatccctaccttgcaagattaaaaacactagcctatatgggtacttngcaacccttctgatatgt

SEQ ID NO: 66562 - DNA, 409 bp, Zea mays
  unsure at all n locations
  Clone ID: LIB3076-031-Q1-K1-A5
gccctctcagctccgctcgaccatcgctaaggagatccgtaaaaaccagagcgtcaccgagcccaaggtggttgatatgcttctgttcaacgcgacggaggagctgaacaacatagtcgaacatgcaaagcagcgccatcatgtgattgggcagtatgtgatcggccaagagggcctggtgcatgagctggggtcgaaggatctagggaactctgacttcctgaagaaattctacacaagcaattacttctgatctgtgttgcagatttacaacatctggtatactccgggtggtgctctgaataagacgacactgaggacctatcaggaccgattgtttcgcaccggaggttntgatctatttggcccttgaatcctctgttcaatgtgatactgctgtcagctgttt

SEQ ID NO: 66563 - DNA, 313 bp, Zea mays
  Clone ID: LIB3076-031-Q1-K1-A6
cggccgtctcagctccgctctactcatcgctattgagatccgtaaaaaccaagacgtcatcggccccattttcaaggatatgcttctgttcaacgcgacggatgagctgaacaacatagtcgaacatgcaaagcagcgccatcatgtgattgcgcagtatgtgatctgccaataaggcctggtgcatgatctggggtcgaaggatctaaggaactctgacttactgaagaaattctacacaagcaattacttctgatctgtgttgcagatttacaacatctggcatactccaattggtgctctgaataagact

SEQ ID NO: 66564 - DNA, 307 bp, Zea mays
  Clone ID: LIB3076-030-Q1-K1-D4
gggaagtatggaaagtgctgttgagagatatacattaagccagttgcatgatttgctgggacaggaagttctgtcgaggtcaagcattgcagataatgagaataatgccaatgatgcatttttctctcctctgtcccctgctgctgttcaagctgatgctcctgcccttgatgataatgacttcattgacgccaaggacaaaaagaacaaagccaggtcagccaaaacaaaagcttctactgtgaatgctccatcacctgttgtttcctttgatccaccagctatttcgatgccttctgaaaaggga

SEQ ID NO: 66565 - DNA, 309 bp, Zea mays
  unsure at all n locations
  Clone ID: LIB3076-030-Q1-K1-D6
ccacgcgtccggctcangcacttcccgttgatcagctccacctctacctgttcgctcggcccttcttcatgagctgggaccatgcctcctccatcagctcccgctccttgcgctccatctcgtatctctgcgcctgctgcttgaccttcaccctctcctccttcagatcgcgcataatcctgtcatctacctgctccatctgcctccagtgcctccgctctgcacctatctcaacctggacggctgccacatcgttgcttgccttgtcccggacccgttactttcacgccgtcttctcctaagccatcc

SEQ ID NO: 66566 - DNA, 389 bp, Zea mays
  unsure at all n locations
  Clone ID: LIB3076-030-Q1-K1-D8
aattccctgctcgacgcactcaacctnctattgtcatcgaatatccctctttcatttatcttattaagactatatttaaggacacgacnatttattaaagatgaggctcactacttcttccaccatcttatttcatcaataatctacttccattcaatacaagtatcccaccacaatttgaatttgtaaaacacacttctacattccacttactctactcactttaatattttcaatttcaattattccaaatcatctattcttcattcccatccaaaatccactcttcaaacacctacttatatttcacctaaaatcttatttacaaactaatattatggcaacatatctaactttatttcatgtaatttaaccctctattttactac

SEQ ID NO: 66567 - DNA, 347 bp, Zea mays
  Clone ID: LIB3076-030-Q1-K1-D9
tcttccagcttcctcctcttatcctctagcgttccccttcacggctgatcaatatactctctggtaggtattatactgcaagggacgcttacccttatccatatccctcttccgctcaagagctgaaggatgaatcagcatctcccgctgtcaatacagaagcagaaccagcaacctctgatccctaagcttctgctgctgcttaataccccgcctcggcttatccgtcctctgatgatccctataaggcctatcctgtcgctgatgtggcccataaagccatctaatgacgccgttctccttactctcactgctgcacctaacatcagctctagagatctattttc

SEQ ID NO: 66568 - DNA, 320 bp, Zea mays
  Clone ID: LIB3076-030-Q1-K1-E1
gacagcgtccagatgcagaacgtgctgtccatcaggaatcctaaacctcctgatagagaggcctgcggcagcgtcagtcccggtgctgcgacagctacttgtggctcatcaagattcgaccgtccaccagattatgattaccccatggtcgggatgaacagccccaggcaccagagcgcggccgtcaggctgcagaaggtgtacaagagcttcaggacgaggcggcagcttgcggattgcgctgttcttgtggaacaacgatggtggaagttgcttgattttgcactgctcaagcggaactcggtgtcattttttgacat

SEQ ID NO: 66569 - DNA, 292 bp, Zea mays
  unsure at all n locations
  Clone ID: LIB3076-030-Q1-K1-E10
actacattcatcacttttaccaatttacatctatactttacacatttatttttcaactctcttccaaatttatccaatttaaactaatccatcttttcaacaccttccactacataaactcttcatcacacaacttctcaacatcaccaataaccaacattacataaacctcttcaattcttatccctatttcttataaaatcaatanctacaacatattttaacaatnccaaatcaacaattttccttcttcactatannccttttctttatactattacttttcccttac

SEQ ID NO: 66570 - DNA, 365 bp, Zea mays
  unsure at all n locations
  Clone ID: LIB3076-030-Q1-K1-E11
acggtgagcctcgtctactgatagtcctgtcctgtttcactctcgccagccaaaaactaccaggccgcttctgctccaggcattccccatgatttcgccgacgaatctcctcccggcgcggaagatcacccctgtctcaaatggcggcgcatcgactgcgagcccctcttctccctcggtggccgcacggccacggcgactcccttcangcctccaatctgtgactggtagagggaaggtttccttggcagccatcactctagatgattaccttccaatgcgaagcactgaagtgaagaaccggacatcaacagatgacatcacaaagctgagactaatcacagcagttaaaaccccctattttc

SEQ ID NO: 66571 - DNA, 319 bp, Zea mays
  unsure at all n locations
  Clone ID: LIB3076-030-Q1-K1-E2
aattcccgnctctacgccacgcatcctgacagcgtgcatattcanaacgtgctgtccatcattaatcctaaacctcctgatataaaggcctgcttcattttcagtcccggtgctcctacagctacttgtggctcatcaatattcgaccgtccaccatattatgattaccccatggtcactatgaacagccccagtcaccatatctcgtccgtcatgctgcacaaggtgtacaatatcttcacgactattcttcatcttgctgattgcactgttcttgtggaacaacgatcgtggaatttacttgattttgcactgctca

SEQ ID NO: 66572 - DNA, 152 bp, Zea mays
  Clone ID: LIB3076-030-Q1-K1-E3
ttcataactttctgtctatcattaatcctaaacctccttatatatagccctgcttcaatttcaagcccccctctcctacaactactttttactcatcaacattctacctttcaccatattatcattaccccattttctatattaacatcccc

SEQ ID NO: 66573 - DNA, 382 bp, Zea mays
  Clone ID: LIB3076-030-Q1-K1-E4
gaaggaacaattattagaggagggttttgcgtcatggacaaggagagacttcaacacaggtattgttgcatgtgagaaatacggtcgcaatgatattaaaagtatatcatctgaaatggagggtaagacagaagaggaagttcaacgttatgctagagttttcaaggagagatacaaggaactgagtgattatgatagaattataaaaaatattgaaaggggggaagcaaggatatcccgcaaggatgagattatgaaggccattgggaagaagctagaccgctacaagaacccatggttagagttgaaaattcagtacggccaaaataaaggggaagtctataacgaggaatgtgaccgctttatgctttgcatggtgcac

SEQ ID NO: 66574 - DNA, 456 bp, Zea mays
  unsure at all n locations
  Clone ID: LIB3076-030-Q1-K1-E6
ccgggagtagtcgacgcgccgtcactgaatcctcagatcacggctagccgtaatgacagcactctgctgactcccggcgagcagtgtaacattttccttcagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctttgtggaagttcgagaccaccaagtactactgcactgtcattgatgcccctggacaccgtgacttcatcaagaatatgattactggcacttnccaagctgactgcgcttgtcttatcattgact

SEQ ID NO: 66575 - DNA, 399 bp, Zea mays
  unsure at all n locations
  Clone ID: LIB3076-030-Q1-K1-E9
tgatcagattaaatcaaatattctgatttatcatattgtgaagacacctatatctcgttacgttttctttcccaagctgtcagcctttccatcctctccaaatgtcacctatctaatgtttctatctatctcttaattacacaaatcataaatacctatcttctattaaacgttcactcctatccttcaatcttttctcccattccatatttcaacattatatcacactctcactcaatatccataaaatcctacaatcaatataacttcccttcccatcttacttttacatacctttatctatcatcatccccacttaattctatcttatctcctattttaataacaacccacccaattttcattttttatacaacaccctttattntcctttaacca

SEQ ID NO: 66576 - DNA, 297 bp, Zea mays
  Clone ID: LIB3076-030-Q1-K1-F1
cccacgcgtccgcccacgcgtccgaagatttagatttggagagacacagaggcctcactgcacacgctgtcttgtctctcaggcccagagctttcttggatcgcgaggaatccactggaaattttgcaattgtagtagagaactgtatcgtccgacgaaggtgcatggtgttggccatgggtcacggcagggaacagagacgagcaggtcggcgctctccccccagctcattgatcctgtcctcgctataaggtagtcctgcggtggcctacgaatttcactcgatcgaacacgaca

SEQ ID NO: 66577 - DNA, 339 bp, Zea mays
  unsure at all n locations
  Clone ID: LIB3076-030-Q1-K1-F11
actgtcgcacatggctgttctgtactacatggttgttacgtatgcatattccatgaactcttgccagantgctttgccgggttgcgggccattgctgaaaggaactcggcatttttcggcgttctgctgaaccagatggggctagcttgcgtgcagctattcaagatagaccatgctgcacagttgtttgaacaggcatgggcggttcttgaacacgagtcttgcgcttctcattctgatactcttggtgtgtacagcaaccttgctgcaatctatgatgctattggaaaagttgaagatgcaatcgagatcctgcagcacgtgctgaaagttacggaa

SEQ ID NO: 66578 - DNA, 366 bp, Zea mays
  Clone ID: LIB3076-030-Q1-K1-F2
cgacaagcttggcggagcttttgctcgctagccatcttctggacctcacaagtccagggggtaggttcctctgatcctcatgatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaccaagggccgcttccgtcttcacccaatcagggatgacgatgccaagttcaagctctgcaaggtgaaggccgttcagtttggccagaagggcatcccctacctgaacaccta

SEQ ID NO: 66579 - DNA, 334 bp, Zea mays
  Clone ID: LIB3076-030-Q1-K1-F4
gcattgcagaaggagctgggtttacctataaggcctgatgttcctctgattggctttagtggaggtgtggattatcggaaaggcattgatctcattcaacttatcataccagatctcatgcgggaagatgttcaatttgtcatgcttggatctggtgacccagagcttgaagattggatgagatctacagagtcgatcttcaaggataaatttcgtggatgggttggatttagtgttccagtttcccaccgaataactgccggctgcgatatattgttaatgccatccagattcgaaccttgtggtctcaatcagctatatgctatgcagtatg

SEQ ID NO: 66580 - DNA, 175 bp, Zea mays
  Clone ID: LIB3076-030-Q1-K1-G11
catccaactttcaataccgtttcttctatatctatctccactgacccacctactaccactacctcaacaacatccttcatacctacttctaggtcctcgattctaagatcatcctatatccggagactcttatgtcccacatcttcggcttcttcaccttctccacttattactc

SEQ ID NO: 66581 - DNA, 362 bp, Zea mays
  Clone ID: LIB3076-030-Q1-K1-G3
cccacgcgtccgggccacattgcactagacattgctgtgtttcctaatgggacgacagggcatggtcttgatattcgttcaggagcaccactctggagagagggtcttgactatcggcatggtacaggccatggaattggatcttatttgaatgtccatgaaggtcctcatctaattagcttcagaccttctgctcgaaatgtaccgctgcaagcatcaatgactgtgacagatgagcctggttattatgaagatggggcctttggtataagattggagaatgtacttatttgcaaagacgccaatgctaagtttaattttggagataaaggttatttggcatttgaacatataacatgggc

SEQ ID NO: 66582 - DNA, 249 bp, Zea mays
  Clone ID: LIB3076-030-Q1-K1-D3
aattccctactcgacccactcgtccgctcacacataccaccacactcactcacctttaccttaacccatcatacaacaatacacacgacatgatactatcttttagcaaaacaatcaacaaccctacttctaacaatgtaatcaccattcactcaccccacgcttcaaactttaataatcttaccttccattccctctatatccccctaccttttccaaccatcaataatattacttttccaacaaaac

SEQ ID NO: 66583 - DNA, 167 bp, Zea mays
  unsure at all n locations
  Clone ID: LIB3076-030-Q1-K1-G4
ccatctccactcattacaaatattcctnactatcaccatcatacaatccatantattacatctcatataaatntccattaatatccccatataattacatacaaacctaactctctacacttaccaatacctacatcaattacttctacccatnaatcatcatctca

SEQ ID NO: 66584 - DNA, 340 bp, Zea mays
  Clone ID: LIB3076-030-Q1-K1-B11
ttatctagctaactcttacttttttcgctagtttttctattaagggtcccataccctcacttttcttctttttgttcattatcttcaactccattttccttccttctaatataaattacaatcatatttcacaaacttcccataccaccttctacaaatattcttattctaccttcacaatttaatgaacttatccttatttaaacctctacaatcaaaactatataactatcacaacaacttttatcacttcacttttcaacaataactctaactacatttccttctactatctccctttcaacaattatcctcaattcttcattaatctaaccataac

SEQ ID NO: 66585 - DNA, 389 bp, Zea mays
  Clone ID: LIB3076-030-Q1-K1-B12
tcggcgcgacgtgctggcggacgatgcggcgctgcgcgcggcggagtcggcgcgcaggatccagctgcattggagcctggtggaggtgctggagtcggagcgcctggtgctgctgggcgagaacgcgcgcctggggttccgcgcgacggcggccgaggacgaggccgcggcggcggcggccgacctgtgctacgcgcgccgtcgcgccgtcgagatggcccgcctcgtcctcaggctccgcgaggaccaccgcgcctgcgtgctgtggcgcatggccgagacgctgcaggcgcgggtgtacgcgctggagctccgcaaccgcgagtgctgcgaggccacggcggcgtgggaggccgaggtccagcggctcagcgccgagaaccgacgcc

SEQ ID NO: 66586 - DNA, 268 bp, Zea mays
  Clone ID: LIB3076-030-Q1-K1-B2
cccacgcgtgcgaccacgcgtccagccccattagcgccgccctcccttatccgacccaaggccggcgccaacgccgcatagacctcgccggcgcctctgcgccgccccgagggctccggaggtgctattcgcgcgcgatccgacggtgcgtccgtcgatctggcatagattcagcggcgctgcgagctgtgaaatcgacttgagcggagatcagaaacatgctacccaacttgaaaatggcactagtacggtctctaagatagtcgga

SEQ ID NO: 66587 - DNA, 90 bp, Zea mays
  Clone ID: LIB3076-030-Q1-K1-B3
ccctcccttatcctacccaagacaagctccaactccaaataaacctcacctgaacctctccaccacccctactcctccacatattctatt

SEQ ID NO: 66588 - DNA, 440 bp, Zea mays
  Clone ID: LIB3076-030-Q1-K1-B5
ggaataatccagaggataacaaaccatctgtaggtgaacaaggtgatgcttggggaagcgaggtgtcttctactgaaggtaaaggacaacagaatgattcttggtcaagtaagatgacttctcgtggtactgaggataccagcggtggctgggacagcaaggtgaaaggctcttcctgcaatgatgggggtgaaggactacaaaatgatccatgggcaaacaagattggttctaacgaaggtaaagaacaagaagctgatccttgggccagcaagatgtcttctgctgtgggtgctgatgacaagaatgataactggaacacgacaacaaagggcactccatctaacgaaaaggctgacgacccttggaatagtaagcggggtaatgatgatgacagcaagaaaactgacgcctggggtgcttgctcgtcaggtggggat

SEQ ID NO: 66589 - DNA, 451 bp, Zea mays
  unsure at all n locations
  Clone ID: LIB3076-030-Q1-K1-B6
atgcgggagtaatccanaggataacaaaccatctttaggtgaacaaggtgatgcttgggggaacgaggtgtcttctactgaaggtaaaggacaacagaatgattcttggtcaagtaagatgacttctcgtggtactgaggataccagcggtggctgggacagcaaggtgaaaggctcttcctgcaatgatgggggtgaaggactacaaaatgatccatgggcaaacaagattggttctaacgaaggtaaagaacaagaagctgatccttgggccagcaagatgtcttctgctgtgggtgctgatgacaagaatgataactggaacacgacaacaaagggcactccatctaacgaaaaggctgacgacccttggaatagtaagcggggtaatgatgatgacagcaagaaaactgacgcctggggtgctggctcgtcaggtggggatcaggaa

SEQ ID NO: 66590 - DNA, 442 bp, Zea mays
  Clone ID: LIB3076-030-Q1-K1-B7
gcgggggctctcagggcgcccctcgggaggaaagcgagagggggccccaacgaggcgcgagcgctcgtcttccagataaccaccgcggtggcctcgtaccgccgcctcctcaactcgctcggcacgcccaaggacaccatcacgcttcgtgataacctgcataagactagtcagaacatccttcaattagcaaaggatgcgaaagataagctccaaaaggctgctgaagcagacaagagcactgatacaagtgcagacaagaggatagctgatatgaagcttgccaaagattttgctgccacaatggaggagttcaggaaacttcagagtcttgcgattcagagggagacggcatataagccaattgttccacataatacgcagtcaaactattctacagatgagcgaagttccgaatctggtaatatgcctgagcagcgtg

SEQ ID NO: 66591 - DNA, 235 bp, Zea mays
  Clone ID: LIB3076-030-Q1-K1-B8
acccactcatactgcaataactcacatgataacaatccatatttaagcgaacaaggtcatcatcgacgaacagactctttttatactgatcaccaccgacaacacaatgatccttcgtcaactaaaatcactcctcacgccaatgaacacactaacgcttcctgatacactacataaaactactcataacatcacttaatttagcacaaggatccacaaaataatccatcaacaa

SEQ ID NO: 66592 - DNA, 296 bp, Zea mays
  unsure at all n locations
  Clone ID: LIB3076-030-Q1-K1-C11
caaacaccaaactcactcaactccttaactacccacttacacttcaacccaccacactaatcacaattcacacaaccccataccctaaaacctaaccaaaaacaacatacacaatcaactacacacaacatactaatacctcctaactcacaaccaccaaatcaaaacaatacacaccataccccaaaccactcaaacaacatattcccaccctcaacaccactataacacaaaaacacccacaaacacaacaaactcnacacactaactcacacactaaatacctcaaaaaacac

SEQ ID NO: 66593 - DNA, 294 bp, Zea mays
  unsure at all n locations
  Clone ID: LIB3076-030-Q1-K1-C12
cccactctttctctcactcatacncaagattctttccactcactcactcctatatcacaggtatgtctctatactacgcgacacctacaccatcaatcacatctccacactctctatctacattaacaaccccaactactacaacctaaatccacttctgtctcacctaatctaatctataactcctatccttatcttcaatactaccctcaatatatacaatatactatttccacaccaacctaattacttactctatcatacactttatactctcctcctacccaccaaata

SEQ ID NO: 66594 - DNA, 410 bp, Zea mays
  Clone ID: LIB3076-030-Q1-K1-C2
cagatccgtgttccgtgtccgcgtccagtgtgtccgctactccgctccccctcagtcctgagttgctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtcgatgaaatgaagaccattgctgagcaattcagcgtaaaggccatgccaacattcctgttcatgaagggag

SEQ ID NO: 66595 - DNA, 249 bp, Zea mays
  Clone ID: LIB3076-030-Q1-K1-C6
ctggactttatatccaacaagtttcgctttaagcacgtcttttcaaacttcagctaagctagcttttcaactaccgcctccccaaccaaatgtatcagtggccacatcaatgtacattataacaatcaacttctgtctcttcacctgacaatccctcaatatccatctcgtgataccattatagacactacatgactttcatgtccacaactatctttctcaaccctttacttcaccttctctctccat

SEQ ID NO: 66596 - DNA, 484 bp, Zea mays
  Clone ID: LIB3076-030-Q1-K1-C8
gaattcccggctggacgcactcatcctcccactcgtccgcccacgcgtcctgtgctttctcccacaggcaaatttttctcgagtcagtcgctttataagctgcgctgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacgacgttgagctcggcaagctgctgtctggcgtcaccatcgcgcacggggggttgcttcccaacatcaac

SEQ ID NO: 66597 - DNA, 414 bp, Zea mays
  Clone ID: LIB3076-030-Q1-K1-C9
cggactcgtggggagctgctcaggaggaacttcatcgacaccgggtgctttggtttcgggatccattagcacatcgggcttggtatcaagtacgatccgtcaacaggcatctacggaatggacttctacgtcgtgctggagcgtgccggctaccgtgtggcgcgccgcatgaggtgcaagtcccgcgtcgggattcagcacagggtgaccaaggaggactccatgaagtggttccaggtcaagtacgaaggcgtcatcctcaacaaggctcaggccaacacgttgtaaacctcacccgtgggcaaaacagctctctggtctcgtatcctcctccgtgtcaacgcaagaccacccacctcgccagggtttttttttggtttaatttgggttctcagccctgatgtttattctgct

SEQ ID NO: 66598 - DNA, 339 bp, Zea mays
  Clone ID: LIB3076-030-Q1-K1-D1
cccacgcgtccgaccacacccactgacccacaccccagcccagcatacaacaagcagccgggtttgcggtagctgctagcaaaacaatggagaaccctgctccgagcatcgtagtggccatcgccgcacccgtggcggcggagttcgtgaagctcaccttccgtgccctgtatatgcgccgggctggtccaggcagcagggagatgactgtgccgggaaggccatccgaccagctgggcaggagagtcgtcactgacagccccgtgtacgacggccgtggcgccgacgcccgcctcgtggctcgcatacagggagtcacggtcctggtcggtaacgcag

SEQ ID NO: 66599 - DNA, 171 bp, Zea mays
  Clone ID: LIB3076-030-Q1-K1-D10
tctcccattcaaaaaatgaaaaaatattctataccataatctcacaatacttaatctcttactacaatctccatcacagaacttcattctataactcaaacatactcataactatatcctatactataaaaacccaatactatcaacaactaccctcttaaactctccaca

SEQ ID NO: 66600 - DNA, 381 bp, Zea mays
  Clone ID: LIB3076-030-Q1-K1-D11
acgcttcgttgagatatagtgatgcgaatttgctacctgaaaactccatagcaacttccagtggttgggttgaatcatgggccttcaattctcttgacgatgtttgtggtgtaaacccatcacaaggtggaacctttgtgaaggtttacaaatcagggtccctcgggagatcgctcgacatcaccagattcggcagctactacgagttgcgtgtcgagctcgagcggttatttggtctcgaaggccaactggaggaccctgcaagatcaggctggcagcttgtattcgtcgaccgggaaaacgatgttcttctcctcggcgacgacccgtggcaggagtttgtgaatagcgtatggtgcataaagatcctctcgccgcaag

SEQ ID NO: 66601 - DNA, 350 bp, Zea mays
  Clone ID: LIB3076-030-Q1-K1-B1
ctcacacaagagacgcagctgcgagtccgccagccttatcctcctccccgtctccggctgcaacgcgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacag

SEQ ID NO: 66602 - DNA, 370 bp, Zea mays
  Clone ID: LIB3076-030-Q1-K1-D2
cttgtctccaccgcggtcctgcaccacggtcacctccaccggcgccgccgcctcgcccggcgtgctacgccgtcgtcgcgggagctgcggctgaggccccgctccccatggcgccgcgcttcggtcgggccacgcggcaacccataatcatgttactcgccatcctgtccgaatcgctgtaggaatgggagccaggggggagcatggatggaaggcaaaaagcatggcacgagaacgcgagaagatgctaaggttattgtccttttcatgccaactctagccggatatcttccccgatgccgctgcatattatttcggtcatcttcttgattcatgatttcgcgcagactctgacctcgaatcctttatg

SEQ ID NO: 66603 - DNA, 371 bp, Zea mays
  unsure at all n locations
  Clone ID: LIB3076-029-Q1-K1-G11
ggccgccctttttttttttttttttagtaaattgacgtcacattataaaccagttcagtaatgataacagaagtttcaacaccttaacagcaacatactgcagccgagagccaagtgcctaaacagcataacataaatctatcgccagtaacaaactcggcaataactagcagcaaccataactcctcaacctttcatagctttcgaaataagaaaaggtaatattttcgagaaccataattcgtcacattcggccaatctccaaatcaagagcttattcttnctcctcagcctcctcgagccatttgacaaacggctccagagctttcacaaaagattgcctgcccttcgggtttgaacctttacggaac

SEQ ID NO: 66604 - DNA, 462 bp, Zea mays
  unsure at all n locations
  Clone ID: LIB3076-029-Q1-K1-G12
gtcaggctggccttgtgaagacattggagaaaggaaagcatgcagagggtggtgaagatgacaactttgctattgtgtttgctgctatgggagtgaacatggaaacagctcaattcttcaaacgtgattttgaagagaatggttccatggaacgggtcaccctttttctgaatctggctaatgatcccaccattgaacgtattatcacccctcggattgctctaacaacagcagaatatttggcatatgaatgtgggaagcatgtacttgtcatcttgacagatatgagctcttatgcagacgcacttcgtgaggtttctgcagcccgagaagaggtgccaggtatgcgtggttatcctggatatatgtatactgatctggcaacaatatatgagcgtgctgngcgtattgaaggaagaacagggtccattacccaaattcctattctgacaatgcctaatg

SEQ ID NO: 66605 - DNA, 234 bp, Zea mays
  Clone ID: LIB3076-029-Q1-K1-G2
gcggcgagaagcccagagagggagtagatagattgagagagagagagtgatcggcgcaaggagcaccgctgagcctgcgcgtgctgcttcaccgaatcgagtcagaccctgtccgaatccgagccgaggcatggcagccggaactgaggcctcgaaggcagatgaggctgaggatgactggcctaagcgggacagacagaggatgctccatgcatgagaccaggttggggatct

SEQ ID NO: 66606 - DNA, 54 bp, Zea mays
  unsure at all n locations
  Clone ID: LIB3076-029-Q1-K1-G3
nccacgcgtccgtccacgcgtccgaaaaaaaaaaacagacagaaatatccatag

SEQ ID NO: 66607 - DNA, 373 bp, Zea mays
  Clone ID: LIB3076-029-Q1-K1-G4
tcttcattgaatagcactagctccgctggtccaaatctgggacccaatatgccagaaatgtctcctgatatgcttaagatggcatctgacatgattgctagtatgcctcctgatgacgtacagaaaatgatgagttttgcttctcagatgggtgggcctggtggtgcccccaggagttcaaagaatattaactttggaccttcagtgagagctacaacgagtaaatcttgcccgtggatcatcatctcaaccctgttttggagaaccctgatgaactatcagatgaccaaaggatgagccagtcatcctctagtcttccgccttctacaactgatatgcaagaaaccatgaggaattctatgaaagaccctgc

SEQ ID NO: 66608 - DNA, 142 bp, Zea mays
  Clone ID: LIB3076-029-Q1-K1-G5
cggacgcgtggggtctcagcctagcgcgccgccacaatgcaggccgccgccgccgtcgtcgtccgccacccgcgcctattcccgccgtccccgggccgctccgcgcagcaccggcgcgcacccagcaccgtgcgcatggcgc

SEQ ID NO: 66609 - DNA, 209 bp, Zea mays
  Clone ID: LIB3076-029-Q1-K1-G6
gcgagaagcccagaaggtgagaagatagatagagagagagagagtgatcggtacaaggatcaccgctgtgcctgcgcgtgctgcttcaccgaatcgagtcagaccctgtccgaatccgagccaagggatggcaaccggtagtgaggcctcgaaggcaactgaggctgtggttgactggcataaacaggacagcaagaggatgctccatg

SEQ ID NO: 66610 - DNA, 265 bp, Zea mays
  Clone ID: LIB3076-029-Q1-K1-G8
tccggaagacccacgccgaccgactcattcaataacactagctccctggttcaaattggacccaatatgccagaaatggctcctgatatgcttaagatggcatctgacatgattgctagtatgcctcctgatgacgtacagaaaatgatgagttttgcttctcagatgggtgggcctggtggtgcccccaggaggtcagagaatattaactttggaccttcagtgagagctacaacgagtaattctgcccgtggatcatcatctc

SEQ ID NO: 66611 - DNA, 431 bp, Zea mays
  unsure at all n locations
  Clone ID: LIB3076-029-Q1-K1-G9
cctcaatcagatatagagtacaccattccttctttattcttctataagcccaacttgtggtggccaaatggcatgggaaagcaatccttatacaacattgagattagtgtggatgtaaaagggtttggagaatctgattcctggagccattattttggattccgcaagattgagagtacaattgatgattctacgggtgggaggatcttcaaggtaaatggtgaacctatttttatccgaggagggaactggatattgtcagatggccttcttagattaacaaagaagcgatatatgaccgacatcaagttccatgctgacatgaacttcaatatgcttagatgttggggtggtgggctagcagagaggcctgactnttatcatttttgcgatgtctatggtctgatggtatggcatgaattttggataac

SEQ ID NO: 66612 - DNA, 345 bp, Zea mays
  Clone ID: LIB3076-029-Q1-K1-H1
tgcatcctccacaaagggatgcgaacaacccagcaggtctactcgctattgctgaggagacattggcggagttcatgtccaaggcgaccggaactgctgtcaactgggtgcagatggttgggatgaagcctggtccggattccgttggaatcatcgctgtttcgcacaactgcagcggcgtagcagcacgagcttgcggccttgtgagcctcgagcccacaaaggttgccgagatccttaaagatcgcgcatcgtggtatcgcgattgtccgcgtgttgatatcctccatgttatccctacgggtaacggtggagcgattgagctgaactatatgccgacttatg

SEQ ID NO: 66613 - DNA, 251 bp, Zea mays
  Clone ID: LIB3076-029-Q1-K1-H10
gtcaggcatccttcatccattgctcgtgtttaaaccaacatgtgtatgcattagggtatgggagttatcaatccaggtctgggttcaacctgactaacatctcattacagcttactgttgaaacaaacatctgtatgtaatattcattcctcaattgcatgatgattgcctaggatctctgaaacttatatccattacatcatgagatacctctttctctgtgctatcactatataactacttattcctca

SEQ ID NO: 66614 - DNA, 452 bp, Zea mays
  Clone ID: LIB3076-029-Q1-K1-H11
tgaatctctaattgtttgcaatataagaaccagatacctcattcaaatggtttttccatgttacagattggtagccaagaacaaagagaaaaacacacaacagtaatgggtcacgaccatatgtctcgtataaagatgcatatggcagaaggttcttttggtgacaggatccggtgccagcaacctgggtgcaatgaggttgtcgatagaagggtagtgtactgcaaaattcacagtggagagttgtcatgccaacagttcagttacctccagagcggactggagagctcaggtttatctgtgcgccctgttaacgacagccaatttaagggatctgtttccattgcagcagtgccatgcactgagcaagagttacatgtcaagcatgaaggtggtgatcgaggtaaactaaaggatagttctgggtacactttgggtcaggctgcacaatt

SEQ ID NO: 66615 - DNA, 196 bp, Zea mays
  Clone ID: LIB3076-029-Q1-K1-H12
tgaatctctaattgtttgcaatataagaatcagatacctcattcaaatggttttggcatggtacagattggtagccaggaacaaagagaaaaacacacaacagtaatgggtcacgaccatatgtctcgtataatgatgcatatggcataaggttcttttggtgacaggatccggtgccagcaacctgtgtgcaatg

SEQ ID NO: 66616 - DNA, 88 bp, Zea mays
  Clone ID: LIB3076-029-Q1-K1-H3
agcaaggtcttcatccaagaacttctactcaatgatggcagctattgactacagcgtctgagttcatagtgaggtttatgtgacacac

SEQ ID NO: 66617 - DNA, 184 bp, Zea mays
  Clone ID: LIB3076-029-Q1-K1-H4
cccacgcgtccgcccacgcgtacgaggacgaataacctttctaggctgacgacacagtggcgcttagcacatatcgggggagcggaacagctgtcaacatgctgcacatggatgggatgaaccctgaaccggaaggcgtaggaatcatctgtggctcacacaactgcaggggcgaagcaggaca

SEQ ID NO: 66618 - DNA, 257 bp, Zea mays
  Clone ID: LIB3076-029-Q1-K1-H5
tgatcggttgcttagcactgcccgtagtctactgtccactgcgctgcgctgctaacgagggcgggagatggagctgtcggcagctcgtggattcttgttcccgtggtgtttgttgttcgtctcggctgacgccgttgctgttgatgtggcgttgttgatgtgcaggtaatgagaggaagaaggcgaaatggtgaagcacatcaacgtcatccccaacgggcactttcagaagcactggcagaactatgtcaagacat

SEQ ID NO: 66619 - DNA, 106 bp, Zea mays
  Clone ID: LIB3076-029-Q1-K1-H6
tgcatacacgacaaagggatgcgaacaacccgacgagtcaactttctatggctgaggagacatcggccgaaagcaagaccaaggcgaccggaacagcgtgcaacag

SEQ ID NO: 66620 - DNA, 212 bp, Zea mays
  unsure at all n locations
  Clone ID: LIB3076-029-Q1-K1-H7
cccacgcgtccgcggacgcgtgggtttcaacgttgatgatcagcacatagagaatggcaacctcggaaatatgaagcggtttcaattcagagagctccaggctgcaacaganaacttcagcagcaagaacatattaggaaaaggcgggtttggtattgttttaccggggcagcttccagatggaagtcttgtaaccgtcaagaggctcaaag

SEQ ID NO: 66621 - DNA, 184 bp, Zea mays; identical to SEQ ID NO: 66617
  Clone ID: LIB3076-029-Q1-K1-H8

SEQ ID NO: 66622 - DNA, 410 bp, Zea mays
  Clone ID: LIB3076-030-Q1-K1-A10
gtcaaacaacgtctccggcccggcgctgttctcccaccaccacctgctgcccggcggaaggtacgtgttcggtggcctccaccgtcatggcggcggtgggtttgactttgacaaggggttggttgtcgagctcgccgtcgccgccatggaggagctggtgcggatggcccagctcggcgagccgctctggctccctgcccttgccgtagacggggctaccaccatcgagactctcaacgaggaagagtacgcccgcgggttcttccccaggggcgttggtcccaagctgccggagctccggtcggaagcgtcgcgggaagccgtcgtggtcatcatgaaccacgtcagcctcatcgagatgctcatggacgtgaaccagtggtcgacgctgttctcaagcatcgtgtcac

SEQ ID NO: 66623 - DNA, 451 bp, Zea mays
  unsure at all n locations
  Clone ID: LIB3076-029-Q1-K1-F9
gcctcacgcgggttctcatccagggcgttgacatgttcgggaaacgggtgggctttctcaagttcaaggctgatatcgtggacgaggaaaccaaaaccaaggttccaggaattgtctttgcaagagggcccgcggttgctgtgttgattcttttggagtcgaatggagaaacatatgctgtgcttaccgaacaggttagagttcctattggaaaattcctgttggagctgcctgctgggatgctagatgacgaaaaaggtgattttgttggcaccgcagtccgtgaggtggaagaagagactggtataaagctgaatatagaagacatggttgatcttacggcactgctggaccctgctactggaggtcgaatgctaccatcaccggtaactggccaaaacttctattcacctgngtggctgcgacgaagagattggcctgttcctgtaca

SEQ ID NO: 66624 - DNA, 189 bp, Zea mays
  Clone ID: LIB3076-030-Q1-K1-A12
ccttccgccaatccttccgaacaacaacgcccgtttttccttgttggacttaaccccccttttcgtctcttctccaatccgctcccgtgctctctctctctccctctccgctgcctcagccgccgtcgctgtcgctgagccgacagattcattcggccggtcatggctgacgcgttgtgcaacggcgtc

SEQ ID NO: 66625 - DNA, 409 bp, Zea mays
  Clone ID: LIB3076-030-Q1-K1-A9
gagggcctgaagctggacgagagtgaggatgagaagaagcgcaaggaggagctcaagggggagtttgagggcctctgcaaggtcatcaaggaggtgctgggcgacaaggtggagaaggtggtggtctccgaccgcgtggtggactccccctgctgcctggtgaccggcgagtacggttggaccgccaacatggagcggatcatgaaagcccaggcgctgagggactccagcatgtctgggtacatgtcctccaagaagacgatggagatcaaccccgagaacgccatcatggaggagctccgcaagcgtgccgaggctgacaagaacgacaagtccgttaaggaccttgtcatgctgctgttcgagacggcgctgctcacttctggctttagcctcgacgatcccaaca

SEQ ID NO: 66626 - DNA, 95 bp, Zea mays
  Clone ID: LIB3076-029-Q1-K1-D4
cacacgcgtgcgctcacgcgctcgcacagttgaatcgtcagattgcacgtaggtttggccggtcgtacaagtatatacttgaactggacgaagat

SEQ ID NO: 66627 - DNA, 96 bp, Zea mays
  Clone ID: LIB3076-029-Q1-K1-D5
cccacgcgtccgcggacgcgtgggcgaaaaaaaaccctccgacttcgatagcaatccattttttggctgcagcttatagctagttctagatcgcga

SEQ ID NO: 66628 - DNA, 437 bp, Zea mays
  unsure at all n locations
  Clone ID: LIB3076-029-Q1-K1-D7
cggacgcgtgggcgccgctgcagaggtaagcaacaggacaaggcctcccctgaggatactgctgctgtggctcgggacggcggaggttgcgccgatggcaggacaaattttgagggtgaacatgatactgtcactgagaaggacctagaacttctccttcaacttttagataataaggaaagcggggatacagcttggcagaatttgatggaacgtacaacctccaacatgacctacaaggcctggcggcgtgagcctgangagggacctataatgtactgcagccgcactatttttgaagatgctacaccttgaactggttagagatttcttttgggatggcgaatttcgtctaaagtgggatcccatgcttgcataactccaaatcttggatgagttccctcagaatggagcaacaattgtccactggataaaaa

SEQ ID NO: 66629 - DNA, 158 bp, Zea mays
  unsure at all n locations
  Clone ID: LIB3076-029-Q1-K1-D8
ggctgcaggaaccctgaggagatcccatggggttccgttggcgctgaatatgttgntgaggctactggtgttttcactgaccaagagaaggctgcagctcacttgaagggtggtgccaagaagttgtgatttctgctcctagcaaggatgcccccatg

SEQ ID NO: 66630 - DNA, 312 bp, Zea mays
  Clone ID: LIB3076-029-Q1-K1-E10
tgctgatcacagtaaagcaaagatttttatttatcatattgcgaagacactgagagcggggtacaaaactgtcccaaactgtgagcattgactgtattactaaaggtcacttatagaaggttgctatatcactggagattacacagagcagaattacctgacttatatggaaggtgcaggcctatctggtaagctctgcgcccagtgcattgggcctgattatcgcaggcttgaactaaggagcctgaatagcctacaatcaggagacggtgcagtaccttcttagtcgcaactggacttagatattggaat

SEQ ID NO: 66631 - DNA, 446 bp, Zea mays
  Clone ID: LIB3076-029-Q1-K1-E11
tgctgaccagagtaaagcctagattcttatttatcatattgtgaagacaccgagatcggggtacaaaactgtcccaaactgtgagccttgccggcctctccaaaggtcacctatcgaaggtttctatctagctggtgattacacacagcagaaatacctggcttctatggaaggtgcagtcctatccgggaagctttgcgcccagtccatagtgcaggattatagcaagctcgcactcaggagccagaaaagcctacaatcaggagaagttgccgtcccatcttagttgtagttgcctttaactatcgtcattcccacttggtgctatctgatcttctatttcaatgggaacccacccaatgggcatgtttggatacaacacccgttatggtcctttgaccatctcctggggacttgtattgttggtatattcggatatattttta

SEQ ID NO: 66632 - DNA, 455 bp, Zea mays
  Clone ID: LIB3076-029-Q1-K1-E12
tgctgatcagagtaaagcaaagattcttatgtatcatattgtgaagacaccgagatcggggtacaaaactgtcccaaactgtgagccttgccggcctctccaaaggtcacctatcgaaggtttctatctagctggtgattacacaaagcagaaatacctggcttctatggaaggtgcagtcctatccgggaagctttgcgcccagtccatagtgcaggattatagcaggctcgcactcaggagccagaaaagcctacaatcaggagaagttcccgtcccatcttagttgtagttgcctttagctatcgtcatccccactgggtgctatcttatctcctatttcaatgggaacccacccaatggtcatgttggagacaacacctgttatggtcctttgaccatctcgtggtgactgtagttgatgtcatattcggatatatatgttaaaggacctg

SEQ ID NO: 66633 - DNA, 113 bp, Zea mays
  unsure at all n locations
  Clone ID: LIB3076-029-Q1-K1-E3
caagcagcgtcttatctgggccggcgccatcacggngtttcttcttttaatctgggactttgttgctgttggacgaatgaattcccttcgatcggttagctttaatctgggtc

SEQ ID NO: 66634 - DNA, 426 bp, Zea mays
  unsure at all n locations
  Clone ID: LIB3076-029-Q1-K1-E4
cccacgcgtccgcccacgcgtccggtgccgccgagcgggtggtgggagatatccggttgggcggagtcggcagcgggcgcaaggagtcactagcgaggtgcctgattgggattagtgaagggcggggtggtgaggtcgccggtggccggggcagtgctcgaggcagtggagggaggagaaagatgggtgcagacagaggaagaagaccatgcggcagaaacctttctgacacgcctgcacggacgacctttattctatggattgaagatgggtgtnctaccatctggagaaagagctctaaaggtatcaatgcaggccttccttctttcccttttcatgattttctttcttccctggcaattcagaacgggaggttctattggaagccaattacttactgagatcagcatttttatagtgaccact

SEQ ID NO: 66635 - DNA, 351 bp, Zea mays
  Clone ID: LIB3076-029-Q1-K1-E5
caagtgtgtcgggtgcacctccaagctctgatcaaatgattgttgctgtacagcagcaaacaccagtggctttacctagcaaagttcctcctgctaaaggtacgaagcgcgtggcccctttgcctcggagggcaagagtacgaggagctttgttgcaagatactgaagaaaatgctgatgataatacttagatattgctgatttatcagcattgattaactctttggcatgtaaacttattagtacatttctgctggacttatgtcaaacttgtggaattaaagtacacgcagctcatggtgtagaaaaggtatgagactgtgttcctacaagaaaggatgggttccctag

SEQ ID NO: 66636 - DNA, 159 bp, Zea mays
  Clone ID: LIB3076-029-Q1-K1-E6
gcgcctgtcgtgccgttccggaacgaccgactcgaccgacgacgcctccgaccactcgtcccgtgccgacaagcgtgtggcaggagatatcccagtgtgcgaaaccggcagcgtgcgcaaggagtgactatcgaggtgcctgagtgggattaatgaagg

SEQ ID NO: 66637 - DNA, 379 bp, Zea mays
  Clone ID: LIB3076-029-Q1-K1-E7
accaaagatcatccatggctagttctctacttcagcagctgctgtctctctgctgctgctcctgctgccctctcctcttcgtctccgggagcatctatcaggaaacaatgctgtcagcgccaacaacttccaccccatctttctggtagctgggatgagctgcagcgacctggaggcacgtctcaccgaggagtaccggccgtcggtgccgcattgcggcgccatgaagggcaagcggtggttcggtctgtgggagaacagttcggagctgctgtctcgtgactacatgcagtgcttcgaggggcagatggacctcgtctacgaccctgacatcaacgagtaccggaacctcgccggcgtcgagacacgaatgcccaac

SEQ ID NO: 66638 - DNA, 224 bp, Zea mays
  Clone ID: LIB3076-029-Q1-K1-E8
gcgacgacatgcctgctcgtcgtgctcaactgcctcagcagcttccaaatttactccatgccggtgtttgacagctttgaggcctactacaccggccgcaccaaccgcccgtgctcggcatgggtacggtcagggttcacggtcttttactggttcctctcgctgttcatcagtgtgggcctgccatttatctccagccttgccgggctggtgggctggcctca

SEQ ID NO: 66639 - DNA, 445 bp, Zea mays
  Clone ID: LIB3076-029-Q1-K1-E9
tgctgatcagagtaaagcaaagattcttaagtatcatattgtgaagacaccgagatcggtttacaaaactgtcccaaactgtgagccttgccggcctctccaaaggtcacctatcgaaggtttctatctagctggtgattacacaaagcagaaatacctggcttctatggaaggtgcagtcctatccgggaagctttgcgcccagtccatagtgcaggattatagcaggctcgcactcaggagccagaaaagcctacaatcaggagaagttcccgtcccatcttagttgtagttgcctttagctatcgtcatccccactgggtgctatcttatctcctatttcaatgggaacccacccaatggtcatgttggagacaacacctgttatggtcctttgaccatctcgtggtgactgtaggtgatgtcatattcggatatatatgta

SEQ ID NO: 66640 - DNA, 80 bp, Zea mays
  Clone ID: LIB3076-029-Q1-K1-F1
ggagtcacctgctgcctaaggttccctggtcagctgaactccgacctcaggaagctggcagtgaacctgatccctttccc

SEQ ID NO: 66641 - DNA, 454 bp, Zea mays
  unsure at all n locations
  Clone ID: LIB3076-029-Q1-K1-F10
cccacgcgtccgccccgatctcgtcgagaggaagcccaatcccgaaaccgtcgccgtattccaatggcgcccaaggccgagaagaagcccgccgccaagaagcctgcggaggaggagccggcggcggagaaggccacggcggggaagaagcccaaggccgagaagcggctccccgcgggcaagtccgcaggcaaggagggtggcgagaagaaggggaagaagaaggcaaagaagtcggtggagacgtacaagatctacatctttaaggtgctgaagcaggtgcacccggacattggcatctcgtccaaggccatgtccatcatgaactccttcatcaacgacatcttcgagaagctggcggcggaggcggccaagctggcgcggtacaacaagaagcctaccattacgtcccgcgagatccagacctncgtccgnctcgtccttcccggcgagc

SEQ ID NO: 66642 - DNA, 457 bp, Zea mays
  unsure at all n locations
  Clone ID: LIB3076-029-Q1-K1-F11
gtaacacgtcacacacaagtacaggaaaacacggcacaccaagtggagcatccattttattactacttcctccaaactaaaagcacatccaaccagaaatatcctgggcctgtctggtccatcaacagtgcgggcccagaccggcctagtacagtacaggacaccacatgcatccggcccgttccactgaccaagcatgttggtgccataaaatcggcgcatgtgatcgcctctgagaaagctgcagtggtgccacgtttgtccggctaagagttaagatgcctttcgaatgtgaacccaataataatgcggtgcgggtgcggccgggaaatcacaggccgaaccgaactgctgaatgaaagagaccactcacgctgctgctgtgtcaggtcagcgacgagacttttgctccagctgccggngaccatccaaaaccagccattatagatcaaatcaa

SEQ ID NO: 66643 - DNA, 457 bp, Zea mays
  Clone ID: LIB3076-029-Q1-K1-D12
cccacgcgtccgcccacgcgtccgcggacgcgtgggttggcacgctcagaggttgaagatgttcacgagacagctgcaggggcactatggaatcttgcattttattctggtaatgctctccgcatagtcgaagaaggcggggttcctgttcttgtaaaaatttgctcatcatcacggtccaagatggcacgtttcatgtctgcactagcactagcatatatgtttgacggaagaatggatgaagttgctttggttggagcatcctcagatagcagttccaagagtgttaatgttgagggagctagaagaatagcatttaagcatatagaaacctttgtgctcactttctcagatccacaaatgttctctatggctgctgcctcctcagccccagcagcgctgtctcatgttgctgaagcagtgtttatacacgaagctggacacctgagatgcagtc

SEQ ID NO: 66644 - DNA, 269 bp, Zea mays
  Clone ID: LIB3076-029-Q1-K1-F5
tggataaaagggaaaagttttgctctgggtccccggcgaaggattttaaatgaattgcagacaggtcctcggtgcactattcacttgagtttacggctctgcagaaaaccccctagggtttctggaaatcgaacccacgacccttccctaatggaacggtggccgcagaggaaggaaggggtggaggggcttaccggcggcgagactgctctggtgaggtggtcgaagatgtaggggaagtcttgaggatcacggcgatgtgcgggtcg

SEQ ID NO: 66645 - DNA, 447 bp, Zea mays
  Clone ID: LIB3076-033-Q1-K1-D9
gttggcttctcctccccctccggttcgggttcgggttcgtgaggttctccggggttcggtgtcaagggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggc

SEQ ID NO: 66646 - DNA, 456 bp, Zea mays
  Clone ID: LIB3076-033-Q1-K1-E1
cccacgcgtccgggtattttcaacattggaaaagctacagtgatgaagatggacaagaactccaaaaataaggtgttttttaaggatgtagccggttgtgacgaagcaaaacaagaaataatggagtttgtgcatttccttaaaaaccctaagaagtatgaagatttgggagctaaaatacccaaaggtgctctacttgtaggccctcctgggacagggaagactttgctcgccaaagctacagcaggagagtctggtgtgccatttttgtctatttctggttcagatttcatggaaatgtttgttggtgttggaccgtccagggtacggaacttgttccaagaagctaggcagtgtgctcctagtattgtattcattgacgaaatcgatgctattggtcgtgcaagaggacgtggaggtttttcaagttcaaatgatgaacgtgagagtactttg

SEQ ID NO: 66647 - DNA, 241 bp, Zea mays
  Clone ID: LIB3076-033-Q1-K1-E12
gtcgccatgaaccccatcaacatcgtcttttatgccacgcgtatcattggcaggaggcttgttgactactatgtgcggagtgatattaagctgtggcccttcaaggtcattcctgctcccgatctgaagccaatcatagatcttcagaacaatggtcaggagaaactgcttgcattctaccagatcccctttacggttctcatcaacatgcgttacatctcttaagcttacattgacagca

SEQ ID NO: 66648 - DNA, 454 bp, Zea mays
  Clone ID: LIB3076-033-Q1-K1-E2
cccacgcgtccgcttactattatcgttgaggctgctacattgcctttaactgacaagcaggtggagtcaactgtggcaatgcaggatgtacagccgcatattaaagcgatccagcagagatatgcgggcgaccattaaaggatacagctagagactgctcggatatacaggcatgctggtgtcaaccgtgtagcacgatgttgtccaacattggcaacaatacctgtatggattggtctttaccaggcactttcaaatgtaccatatgaggggctattgacagaaggatttatctggattccatcactgggtggacctacaacaattgcagctcggcaaagtgatgctggaatgtcggggctcatcccatttgtggatggccatactccggttggctggtatgacacgatatgctaccttgtattgcctgtgctacttgatgcttctcaatatg

SEQ ID NO: 66649 - DNA, 423 bp, Zea mays
  Clone ID: LIB3076-033-Q1-K1-E3
cccactcgtccggttattatcaacattggttatgctacattgatgaagacggacaagaacgcgaaatataatgtgtcttttaaggatgtacccgcttgtgacgaagcaatacaagaaataatggagttcgtgcatttacttatacaccctaagaactatgaagatttcagagctaatatacccaaaggtgctctacttgtatgccctactttgacagcgaagactttgctcaccaaagctacagcaggacagtctggtgtgccatttttgtctatttctgcttcagatttcatggaaatgttagcagttgttggaccgtccacagtaccgaacttgttccaagaagctaggcagtgtgctcctagtatagtattcattgaccaaatcgatgctattggtcatgccacatgacgctgacgtttt

SEQ ID NO: 66650 - DNA, 461 bp, Zea mays
  Clone ID: LIB3076-033-Q1-K1-E4
cccacgcgtccgcggactcgtgggcggtctcctccgtgtcccattcgccacgcagcggcgccacaggagacggagacggagatgaagctgtccatccagtcgctcgccaggaagctgtccctgccgtccccgaagcggggcggcggcggcatcgtcgaggacgggaagaagaagaagaagcgctcgctgtcgcgcggcgaggcgccgtcgttcgcgtcctcttcttcatcctcctcctcctcctccgccaccacgacgccgcggtccgtgctggcggcggcgccggcgctggagatcccgcggcgggagctggaggccgtgctgcggcgcctgggccacgcggagccgtccgacgccgagctcgacgccgtggccgctctcgccgcgcagcccccgtcgggcgacgccgacgcggacgccgacgccgacctcatggaggcgttccgcgtgttcgacgcgga

SEQ ID NO: 66651 - DNA, 465 bp, Zea mays
  Clone ID: LIB3076-033-Q1-K1-E6
cccacgcgtccgctttcatatgttatgattaatgtgttttcaagtctatttcaaaccaagtcataggtgtatcgaaagggaattggagtcttcgacgaagacaaaagcttccactccgtaactcatccttcatcgtcgctccgagccactctctatctttgggggagagagcatgcagtcaaagcaaaaggactccgactttggtataatcttcactcatttatttatgaccaaagggggagtaattcttaagggctctaaatgactctgtttttggcgattcatgccaaagggggagagagtattagcccaaagcaaaaggaccgtaccaccacctaattttaaaaagagttcttcaatttataaatttcaaattggtatcttattgtgttcaaaagggggagaaagtagtatttcaaaattgatatatcaaaaccctcttgaacactaagaggaggatctcat

SEQ ID NO: 66652 - DNA, 438 bp, Zea mays
  Clone ID: LIB3076-033-Q1-K1-E7
attgctctggtgttattacagaacacctattcaaagaggttgattgtttgctccttggagctgcacaagggcttgtcctttctgatcctttcagatgctgtggctctagcaagttcaagagtgtcaactttcctagcatttctgttgttcctcctctgccattgttaattgccaatgttgtgggtggagatggttctattcttctttatgaaggagaaattcgtgatgttctgataacactgacaaatgccggaaccgtaccagttgaagaagcaaatgttgcattgtcagggaagaatcaggattctgttatttcgattgctcatagcacatggaaatctgcgctccctattaaaccgggtggagaagtgacatttgcagtgactctaagagcctggcatctcagctcagcagatttggaagcagatggcagtagat

SEQ ID NO: 66653 - DNA, 343 bp, Zea mays
  Clone ID: LIB3076-033-Q1-K1-E8
accgctcgtgcgttatcacataacaccaattctgagaggtcgattgtatgctacacgaagcgatacatggacttgtcggtactgatcctctcagacgctgacgctctatcacgctcaagagctgaaactttactagcatttctagcgattctctatctgccatgggaaagagcctacgttcgaagctggagaacgttctattctgcttaatgaacgctaatttattgatgacctgatgacactgacttatgccgggccctaactaactgtagaagcagctattgattcgtcagggaaaaagcatgatactccaattcagattgatcataccacatgctaatct

SEQ ID NO: 66654 - DNA, 447 bp, Zea mays
  Clone ID: LIB3076-033-Q1-K1-E9
gtcgccatgaaccccatcaacaccgtctttgatgccaagcgtctcattggcaggaggtttagtgactcctctgtccagagtgatattaagctgtggcccttcaaggtcattcctgggcccggtgagaagccaatgatagttgttcagcacaagggggaggagaaacagtttgcagccgaagagatctcctctatggttctcatcaagatgcgtgagatcgctgaagcttaccttggcagcacgatcaagaatgctgttgtcacggtccctgcctatttcaacgactcgcagaggcaggccacaaaggatgctggggtgattgctggcctcaatgtgctgcgtatcatcaatgagccaaccgctgctgctattgcctatggtcttgacaagaaggcaaccagtgtcggtgagaagaatgtcctcatttttgaccttggaggtggtacc

SEQ ID NO: 66655 - DNA, 301 bp, Zea mays
  Clone ID: LIB3076-033-Q1-K1-F1
gcgtactcccacgcctgctgatgcattcattcacagctgctgttgcaacacatgttaacccagcttgggtggggtgaaaggacgggtgccgggtgaacgtggacataccccaacacgagagccttttttattgaggaacaaactagcaaccgtgatgacccagctttctgaatcagcaatatggcgaaagagggagcccagataaagacaggccaccatataagggagagactcgtgcaccacaagaggacgcttacaaaggacaaagatgcaccccctgcacaagaatgggcagaaatga

SEQ ID NO: 66656 - DNA, 417 bp, Zea mays
  Clone ID: LIB3076-033-Q1-K1-F10
cccacgcgtccgcccacgcgtccgcccacgcgtccgcggacgcgtgggcgaagggggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtgggactagtttggctgccttcctgtgttcgtattgtagcagttgtggtagctggttgctttgtcgtcctgtagtcgtgcttctttgggtctgtaagaaccgctggt

SEQ ID NO: 66657 - DNA, 425 bp, Zea mays
  Clone ID: LIB3076-033-Q1-K1-F12
gaattggctcacggcgctaacgcggggctggacatcgcggtgcggctgctcgagcccatgagggaggagttcccaatcctctcttacgccgatttctaccagctcgcgggagttgtggccgtggaggtcaccggtgggcctgagattcccttccaccccggtagggaggacaagcctcagcccccacctgagggccgccttcctgatgccactaagggttctgaccacctgaggcaagtttttggcaagcagatgggcttgagcgatcaggacattgttgccctctctggtggccacaccttgggaaggtgccacaaagagcggtctggtttcgagggggcctggactacaaaccctttggtctttgacaactcttactttaaggaacttctgagtggtgataaggaaggccttcttcagcttcc

SEQ ID NO: 66658 - DNA, 288 bp, Zea mays
  Clone ID: LIB3076-033-Q1-K1-F2
gcgctcctccgcccaaagaaagacgtcaactccatgatactaagatagtgagaactgaagagaaggatgggcttcgataagcagatcctgagatcctgcacctgccccaatccgattaatgtccagaatgtcaccgttcactgcaccggctactgtaaggatcgtgatctgtccaagaaatcttggagcaccaatgaccctgagctgcatccattcagttcatcatcgttcatggttcactgatcaaaggatgggactagggagctattaccatgcaagtgggtgaag

SEQ ID NO: 66659 - DNA, 439 bp, Zea mays
  Clone ID: LIB3076-033-Q1-K1-F3
cccacgcgtccggatgcagccattcccgccagttgttgctccacatgttaacccagctttctttggtcgtggcggaatgggtgccggtggaatgtggcctgatcccaacatgggagcctggggtggggaggaacaatcgagttacggtgatgacgcagcttctgatcagcagtatggtgaaggagggagccatgggaaagagaggccaccagagagggagtggtctggtgcaccagagaggaggcgtgaaagggagaaggatgcgccccctgcacaggagtggccagagaggaggcaacgggatgagcgtgacatggaccgtgagaggaatcgtgactatgacagagacagggaaaaagaccgtgacagggaaagagaccgagaccgagatagggagagggacagagatagggagagagagagggagagggagaaggag

SEQ ID NO: 66660 - DNA, 402 bp, Zea mays
  Clone ID: LIB3076-033-Q1-K1-D8
gcactcgttcggcgctgctgacgatggcttcgtctgtgaattggctggtgcctacgtcttgcggcgacaggtatgtgtgccacccgacggacgctcatgctgcggtggtgttcgtggcgctgtacctcatctagctgggcacggtcgggatcaagccgtgcgtgtccttcttcggcgccgaccagttcgactagaactactagctggagaagaagatcaagagctacttcttcaactggttctacttctccatcaacatcttcgcgctggtggcgtccacagtgctggtgtacgtgcagactcacgtgggctgggtctgtggcttaggcatacacgacgtggtcatggccatcgacgtcggcagcttcttcgtgggcactccgatgtacatgcaccataagc

SEQ ID NO: 66661 - DNA, 452 bp, Zea mays
  Clone ID: LIB3076-033-Q1-K1-C11
ggtagacaacacatatgcacgcaatattgaaagcttggtgcacaaagtatgtgcactttcgcgtcgacaaggagaggatcacaggcttcttagggccgcaagcttgcagtgtctgtcagcaatgatctggttcatgaaggagcattcatacatatttgctgattttgatgagatagtgcattcagtgctggaaaattataggacagaggaatctaatggtggtggtgatgacagacatgcattgcagcataattgggttgatgaaatagcaaggtctgagggtagacctggtgtaagtggtggtaatgatgtgaatattaacactacaactattaggttgcggccagcaagaaattcgtcagctcttacaagggatgaacgtgactccccagaagtatggtcacatatttgtgtccaaaagcttgcagaactggccagagagagtacaacca

SEQ ID NO: 66662 - DNA, 426 bp, Zea mays
  unsure at all n locations
  Clone ID: LIB3076-033-Q1-K1-C12
cccacgcgtccgcccacgcgtccgatcctccctccattgtttcccggctctccgtgccttgggagttgggccttggcatttccttaagataaaaaaggggggaaatcggcttcctactccccgtccttatcgccagccgaaccgacattgttttctccccccttctcgccttctccttctcccccctagtctagaggcgtttgctccccaatcccttcggcccgcccgctcgacgtgatcccaccggcagccatggatccatacaagcaccgnccgtctagtgtgagcaactccagcttctggaccaccaactccggcgccctcgtctggaacaaccactctgncctcaccgtccgacagcgaagtccaatccttcctgaggattatcatctaatcgaaaagcttgctcagttcgacagagaacgt

SEQ ID NO: 66663 - DNA, 468 bp, Zea mays
  Clone ID: LIB3076-033-Q1-K1-C3
cagctagctgtgcgatctgtcttgttcgctgctgttggtacagcaggacaacgctgcaccacatgtcgtaggctgattcttcatgagaacatatatcaaaccttccttgatcagcttgttgaggtatacaaacaagtccgaattggggatccgttggagaaaggcaccttactgggaccactgcacactcctgcttcaaaagagaactttttgaaaggcattcagactatcaaatctcagggagggaaaatcctttttggaggatctgccattgaatcagaaggaaactttgtgcaaccgacaattgtggaaattacaccttctgcaccagttgtgaaagaagaactctttggtcctgtcctttatgttatgaaatttcagaccttgaaggaagcaattgaaatcaataactctgttcctcaaggattgagcagttctatatttacaaagaggccagatattattttt

SEQ ID NO: 66664 - DNA, 468 bp, Zea mays
  Clone ID: LIB3076-033-Q1-K1-C4
cagctagctgtgcgatctgtcttgttcgctgctgttggtacagcaggacaactctgcaccgcatggcgtaggctgattcttcatgagaacatatatcaaaccttccttgatcagcttgttgaggtatacaaacaagtccgaattggggatccgttggagaaaggcaccttactgggaccactgcacactcctgcttcaaaagagaactttttgaaaggcattcagactatcaaatctcagggagggaaaatcctttttggaggatctgccattgaatcagaaggaaactttgtgcaaccgacaattgtggaaattacaccttctgcaccagttgtgaaagaagaactctttggtcctgtcctttatgttatgaaatttcagaccttgaaggaagcaattgaaatcaataactctgttcctcaaggattgagcagttctatatttacaaagaggccagatattattttt

SEQ ID NO: 66665 - DNA, 445 bp, Zea mays
  Clone ID: LIB3076-033-Q1-K1-D1
cccacgcgtccgcccacgcgtccgaagaagaccaccgtcgccaggttccggcgccgcacggcgacgtgcatggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacggacccggccgggcagcttccgtgccctctggtgtcgccgacggaccccgtggacttcaagccggaaagcaaggtgacgcgcatccggcagccggtgcatctcctgagccgggagtaccaggagaagtacaaggaggccgtcgcgaagatgaaggcgctaccggaagagaacccgctgagct

SEQ ID NO: 66666 - DNA, 304 bp, Zea mays
  Clone ID: LIB3076-033-Q1-K1-D10
atcacccactctactactcgaagttactaccatcaactagcttcaacattagagtagagcgtgcctaggatggcggcaccgaagccctaacctgcggccctactactactgactgaagcccacatactgtcgctgtctcacgcgtacctgacgcacaacaactgcatgaacaacagcatgctcacagtccaaaacttgtgcagccacaacttgactctgacgctgaaacccctttccaacaacacaccgatattcgcgtgaacctacactttgcacccgaacatccacgcccagatctctgtgc

SEQ ID NO: 66667 - DNA, 454 bp, Zea mays
  Clone ID: LIB3076-033-Q1-K1-D11
acgctggcgcattctctggatctccatgcatggttgaacaagagacggatggagacagatgcggggcatcttacaggggttgttgtctgtctttgtagcagaagaaacagtcctaaaaaagaatggagagctcctcagataggagcaacgtttctcaggggaaccacctgtgttatgcgagaagcacatccatggattccactggtcctcagttagctggtaggtctagctcaatgttgagtaggagaagtagcagacagggctcaaggggatccatcagcctctcaagggagatgggggactccatactgagctcaatgaggcattctcttcagtcggcggatcaattgctaggagacatcgatagctcagttctggctcaactcatcgaaagtggtcgagttctatcacccgaaagcgatgttgatgaggatacagtaagaatctttgaaca

SEQ ID NO: 66668 - DNA, 445 bp, Zea mays
  Clone ID: LIB3076-033-Q1-K1-D12
ggcagagaaaaccacttggatctgcaccagctgggtgcgaggatgctccagcacgcgcacgagcgcgaacgagatgcttctgaggaggaagctggaggagcagcagcaggccgctgctgccgagctgcagcaggccatggagctccagagccgtcgcctgatgaggctgcagctgctggacctgaagccgcgcgcgtcgccgagccccatcggcagcatgcccctgggccccacccaaagggccgtcgactcgccgcccgattccggcagggaggagtcgtccgccggcgacgcgagcccgaacgcggacagcgaccaaagcgccgagcacaacctgccggacagcccgttcgcgtcgccgacgaggtccgcggccttggctcgcgaccctttcgcggccatcgaccgggagatggctgcctcgcccggtcgtcgaaacggcgcc

SEQ ID NO: 66669 - DNA, 468 bp, Zea mays
  Clone ID: LIB3076-033-Q1-K1-D2
ctggaatgaacattcggctagttggggaggccaatgattatgttggaaagggtatggctggtggagaactggtggtagttcctgtagacaaaacaggatttgttcctgaggatgctactatagttggaaacacttgtctgtatggagctacaggtggtcaggtatttgtgagaggcaaggcaggagaaagatttgctgttagaaactctctatgtcaggcagtggttgagggcaccggagatcattgctgtgagtacatgactggtggctgcgtagtcgtacttggcaaagctgggaggaatgttgcagctggaatgactggtggtcttgcctacattctagatgaggatgatacacttgtcccaaaggtcaacaaggaaatcgtcaaaatgcagagagtgaatgctccagctgggcagatgcagctaaagggcttgattgaggcctatgttgataaaacgggcagcg

SEQ ID NO: 66670 - DNA, 453 bp, Zea mays
  Clone ID: LIB3076-033-Q1-K1-D3
gatggtgctgcgcctctgtggagccggcagctgttctgggtttcttggggctaaatcacggggtttccatgatgccacgtacctgtggcaagatgatgatgacaggttatgtggcgagaatatccctctttacgattctgctgatgactaacctactagcattaacaaggaaatgctcgtatcaagtgatggcatgggtacccaattcagcatcatcagcagagtacagagtaccgaaaatcctgtaaacactggaactaacgaatttgcgccaattatcgccgacgaactgacaacaagctcaaatggattagcaccaatgaacgttgaaccattgactgtaagctcaaatgagctcacgccacctaacgccatgccaatggtagctcgtctagtcgagaatgggtcaaccgtatacagctcacaggacactcacgactcttctcagaattc

SEQ ID NO: 66671 - DNA, 453 bp, Zea mays
  Clone ID: LIB3076-033-Q1-K1-D4
gttggttctgcgcctatgtggatccggctgctgatctgggtgtcttggagctaaatcacggggttgacatgatgccacgtacctgtggcaagatgatgatgacaggttatctgtctacaatatccctattcactattctgctgatgactaacctactagcattatcaaggaaatgcttgtatcaagagatggcatgggtacccaactctgtatcatcagcagagtacagagtcccgaaaatcctgtaaacactgtaactaacgaatttgcgccaattatcgccgaccaactgacaacaagctcaaatggattagcaccaatgaacgttgaaccatcgactgtaagctcaaatgtactcacgccacctaacgccatgccaatggtagctcgtctagtcgagaatgggttaaccgtatacagctcacaggacactcacgactcttctcataattc

SEQ ID NO: 66672 - DNA, 457 bp, Zea mays
  Clone ID: LIB3076-033-Q1-K1-D5
tggaaccttccgacacacagcgggaacctactctggagaccctgacgataaaggtgtacagacaactggggatgccaaacattttgctatatcagcaaaattcccacaatttagtaacaaggaccggacattggttatccagtactctctaaagattgaacaagatattgaatgcggtggtgcttacatcaaacttatgtctggttatctcaaccagaagaaatttggtggcgacactccttacagcttcatgtttgggcctgatatatgtggggatcagaaaaagaagctgcatctcatactttcataccaagggcaaaactaccgtatcaagaaagaactaaaatgtgaaacagacaaattgacacatttttacacatttattcttagacctgatgccacttatagcattcttattgataaccgggaaacagaattcttgagcatgtacactgac

SEQ ID NO: 66673 - DNA, 450 bp, Zea mays
  Clone ID: LIB3076-033-Q1-K1-D6
cgagcaggaggcggacaaggtaagcagcaatcgcaggaaccctagcgccgccggagccgggggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcatgggccaggattgtcaatgctggtggcgagtgcctcacatttgaccagcttgctcttcgtgc

SEQ ID NO: 66674 - DNA, 463 bp, Zea mays
  Clone ID: LIB3076-033-Q1-K1-D7
ggcatgggcaacgaagaagagctaattagatgcaacgtgatacgtaataggcaaatactagagtaaaaaactaagaaacctgcaaattatagaacaaaaaacatagataggaaggggggcatacagccttggcaccaaaccggcatcatgagcaagcaggagcatgtatcatatatctctgttaacatattgatttttacagcaaatcaactaacatctcttccctagatcggttgaatccagcaccagccacacaaggagaacatgaactggaagaaatataaaagaaaatcgcacctctgttcagtatcaaatacaccggcggaagcgccgtcacaccggccaccatcccctccacagtttccatccaactcaacacatggtatctagggacgtacgaataatcggtgatctcctgtgtgaaggcatcttctactccggcttcatctgccatagggtcatc

SEQ ID NO: 66675 - DNA, 419 bp, Zea mays
  Clone ID: LIB3076-033-Q1-K1-C1
ccctcgcccaatgcgtagttgtatctgcatctccaacaccaccagcagaggtttcagttgggcttgtttttagattagaaaaatcgagtccaacagactcgccgcactgcgcgggaccgacctcgtcgcaactcccgtccgccgccaataatggagacccgggacacggctgcgacgccgctcccctactcgtacacgccgctgccggccgtcgacgccgcgtcggccgaggtctccggcaccggcaggacgcggagcaggcggcggcccctctgcgcggcggcgctcgtgctctccgccgcgctgctcctagccgtggccgcgctcgccggcgtcggcgtcggcgtctgcagccggcccggcgcggtggggatgacagagtcggcctcgtcgccgacgccgagcaggagcaagggccc

SEQ ID NO: 66676 - DNA, 474 bp, Zea mays
  Clone ID: LIB3076-033-Q1-K1-A4
cccacgcgtccgcttactattattgttaaggctgcgacattgcctttaactaaaaagcagggggaatcaactctggcaatgcagaatttacagccgcagattaaagcgatccagcagagatatgcgggcaaccaggaaaggatacagctagagactgctcggttatacaggcaagctggtgtcaaccctttagcaggatgttttccaacattggcaacaatacctgtatggattggtctttaccaggcactttcaaatgtagcaaatgaggggctattgacagaaggatttttctggattccatcactgggtggtcctacaacaattgcagctcggcaaagtggtgctggaatttcgtggctcttcccatttgtggatggccatcctccgctaggctggtatgacacgatatgctaccttgtattgcctgtgctacttgttgcttctcaatatgtctctattgagatcatgaaa

SEQ ID NO: 66677 - DNA, 426 bp, Zea mays
  Clone ID: LIB3076-033-Q1-K1-A6
aatgaagaggagcaatgataagcagctcattattgatcatgaattatgtgagagggtcatgtgccatcttgaggaagggaaagatgtccgtttaggagattggaaagctgctgacattgagatcttgaatacattccagctactttcagctaatccagttgtctatttggtgaatatgagtgagaaggatttccagagaaaaaagaacaagtttctacccaagatacatgcttgggtgcaggaacatggtggtgaaaccatacttcctttcatctgtgcttttgaacagaaactagtggatatgccagaagatgaagccgccaaatattgtgctgaaaaccagataacaagcatgatcccaaaaattatcaagactggttttgcagcaattcatctgatatactttttcactgctggtcctgatga

SEQ ID NO: 66678 - DNA, 394 bp, Zea mays
  Clone ID: LIB3076-033-Q1-K1-A7
ctgatagaatgattgaagacaaggaacgagagataactaaactcctcaaggaaaacagggaccttcaccagtctttagatgctagaccaacagttagcaacaatgatcatcaaagtcaaggacctgttaaggatacaatgagtgttgaattggctgagcaacaaattttgcttctcgcaaggcaacaagcacaacgagaagaggaattggctcagtcacagaggcatatcttagcacttcaacaagaaattgaagagctcgagcgtgaaaatcgtctccatgatcaacaggaagcaatgttgaaaaccgagcttcgcaatatggagagatcacaaaagcgagaaggaatagatatgacatatctcaaaaatgtgattctaaaacttcttgaaac

SEQ ID NO: 66679 - DNA, 443 bp, Zea mays
  Clone ID: LIB3076-033-Q1-K1-A8
ctgatagaatgattgaatacaaggaacgagttataactaaactcctcaaggaaaagaggggccttcaccagtctttagatgctagaccaacagttagcaacaatgatcatcaaagtcaaggacctgttaaggatacaatgagtgttgaattggctgagcaacaaattttgcttctcgcaaggcaacaagcacaacgagaagaggaattggctcagtcacagaggcatatcttagcacttcaacaagaaattgaagagctcgagcgtgaaaatcgtctccatgatcaacaggaagcaatgttgaaaaccgagcttcgcaatatggagagatcacaaaagcgagaaggaatagatatgacatatctcaaaaatgtgattctaaaacttcttgaaacaggggaagtgggagcgttgttgcctgtggttgggacgttactacagttt

SEQ ID NO: 66680 - DNA, 394 bp, Zea mays
  Clone ID: LIB3076-033-Q1-K1-A9
tcgatcgcggacgagcagctgtagcatgataacactaaccaaacgtgcccatccagggtgactggtccgaggtgcgtggcgttgacccatggtgaataacggcaagtggttaacctccggactgaaagtatccatgccgtaatccaacgaaatcaactaggagaggataacgatgaaatcagctggtatcatcccaacaacggtagatctgaccgcatctacctacctggaagtcaatgtgaacggcgacagcgactccggctgctactgcagatttagccagaccgacgaggtcattatccccgaagccaaccatgagctgagcaagcatgtaaccctggatgatgcccctgctgctgctgctgtctcagcacatgcgtcggttctgccacct

SEQ ID NO: 66681 - DNA, 441 bp, Zea mays
  unsure at all n locations
  Clone ID: LIB3076-033-Q1-K1-B1
gatatgatgaagcttgcaaatcgaatgcagtttgggattccggaggagagctcactaggtgatggcttgggggaaggttatggcatgcttggacaagcagggagtggcaagctacgtgtctcagctggacaaagcaaacttgctgctaaagtggcgaaaaagttcaaggagaagagctatggtagcagtggtgcaacatcaggattgacatccagtttggcatttacaccagttcagggaatagagttgtcaaatccacaggtccaaggaaaccttctcggaggcggaactcaaagtacttacttttccgagaccggcacattttcaaagatcaggaggacgcaatagaatcctctttgcaaccatcacatctcatttgcactgcatttgttgatantcctgggatgcactgtagaaaattcaaaagtcaatcttgcaatg

SEQ ID NO: 66682 - DNA, 449 bp, Zea mays
  Clone ID: LIB3076-033-Q1-K1-B10
cggacgcgtggggcatatttttgctaaagaattgaatgaaatgtttgattcagaatgggaatcagtagaaaggaaatttagaggccgaaaccttggtcaagaccagcagacaatgaaggccataaaagttcgagctatgatggattcaaagtctacagttgctagagggccggttgcatgctcaaaccctaaaactttggttgctagaggtccagtagcttgctcaaattcgattgcaagaagacactgacagatgcattatcctccaaagtaaaaatcaaattttccgtgcgcagctctgcgcatacctcttccaaagatatactcgttcaagcagctggtagcaaagaggggtccttaaatcactctgtccctactggcaacaaagaggcatcttcaaattgtactattcctatcgctaaggaggctaaaatatcaagggcacgaga

SEQ ID NO: 66683 - DNA, 433 bp, Zea mays
  Clone ID: LIB3076-033-Q1-K1-B2
gataggatgaagcttgcaaatcgaatgcagtttggtattccggaggagagctcactaggggatgggttgtgggaaggttatggcatgcttggacaagcagggagtggcaagctacgtgtctcagctggacaaagcaaacttgctgctaaagtggcgaaaaagttcaaggagaagagctatggtagcagtggtgcaacatcaggattgacatccagtttggcatttacaccagttcagggaatagagttgtcaaatccacaggtccaaggaaaccttctcggaggcggaactcaaagtacttacttttccgagaccggcacattttcaaagatcaggatgacgcaatagaatcctctttgcaaccatcacatctcatttgcactgcatttgttgatatccttgggatgcactgtaaaaaattcaaaagtcaatc

SEQ ID NO: 66684 - DNA, 429 bp, Zea mays
  Clone ID: LIB3076-033-Q1-K1-B3
gatatgatgaagcttgcaaatcgaatgcagtttgggattccggaggagagctcactaggggatgggttgggggaaggttatggcatgcttggacaagcagggagtggcaagctacgtgtctcagctggacaaagcaaacttgctgctaaagtggcgaaaaagttcaaggagaagagctatggtagcagtggtgcaacatcaggattgacatccagtttggcatttacaccagttcagggaatagagttgtcaaatccacaggtccaaggaaaccttctcggaggctgaactcaaagtacttacttttccgagaccggcacattttcaaagatcaggaggacgcaatagaatcctctttgcaaccatcacatctcatttgcactgcatttgttgatatccttgggatgcactgtaaaaaattcaaaagtc

SEQ ID NO: 66685 - DNA, 467 bp, Zea mays
  Clone ID: LIB3076-033-Q1-K1-B4
ctctccttccggcttccggccccgctcctccccaaattcccccaaaacctgacgagctggagggccgatccgcggctccccgccgcctgatccgagcagtctcctcggcccagccggggatccaagcgggatggggtacttgagctccgtgatcggccaccccaccgatggatcctccgtcagcggcggcggcctcagccagaatggtagatttagctatggctatgcaagctcccctggtaaaagggcatccatggaagacttctatgagacaaaaattgattgtgttgatggtcagatagttggtctttttggagtttttgatggtcatggtggtgctaaggtagcagagtatgttaaagaaaacctgttcaacaatcttgttagtcatccaaagttcatcagtgatactaaagtcgctatagatgatgcttataaaagcaccgacagtgaattcttagaatctg

SEQ ID NO: 66686 - DNA, 460 bp, Zea mays
  Clone ID: LIB3076-033-Q1-K1-B6
cggactcgtgggatcatgataggtgtgcttgagcttttgatagctagtttatttgaacttttatctttttatgatcatggtatattgagacagaaatattttacatgtacctttgcagtttttcagttggagaaaatatttaagacaacattttcatcgtttgttctccatatggggcttgtttcacgccacttgaaggaaggagggaatgatggtgttaagttcggacaatacatctacacatctatgaaatgtacaaccacgatgtagagcatagagtttctaaagttgggtaagctgtttggctgttttatagaaatttgtatcaacatcaacatagatttttagtcccaaacaaattggggtaggctagatttgaaacccaacaagaagtcaccaaaaagagaaagagagataaaggggaggggaaaagcttttgagagaactaaaagagaaaatg

SEQ ID NO: 66687 - DNA, 466 bp, Zea mays
  Clone ID: LIB3076-033-Q1-K1-B7
cggactcgtgggatcatgataggtgtgctttagcttttgatagctagtttattggaactgttatctttttatgatcatggtatattgagacagaaatattttacatgtacctttgcagtttttcagttggagaaaatatttaagacaacattttcatcgtttgttctccatatggggcttgtttcacgccacttgaaggaaggagggaatgatggtgttaagttcggacaatacatctacacatctatgaaatgtacaaccacgatgtagagcatagagtttctaaagttgggtaagctgtttggctgttttatagaaatttgtatcaacatcaacatagatttttagtcccaaacaaattggggtaggctagatttgaaacccaacaagaagtcaccaaaaagagaaagagagataaaggggaggggaaaagcttttgagagaactaaaagagaaaatgcctaat

SEQ ID NO: 66688 - DNA, 463 bp, Zea mays
  Clone ID: LIB3076-033-Q1-K1-B8
gcccgccgccgcggccgtctccgccgctccgcccctggcagccgtcgccgccgccaccagcggcagcggcttccagaaccactctctatacccggccatcgccggcagcactggtggtggaggagttggcgggtccggcaatatctcctccccgttctcctcgtcgatggggggatcgtctcagctgcacatggacagtgctgccagctactcctacgcagctcttggtggtggaactgcaaaggatctcaggtacaacgtttacggaataagatctctggcggacgagcacaaccagctgatcgcagaagccatcgactcgtcgatagagagccagtggcgcctccccagctcgtcgttcccgctctcgagctacccacagctcggggcgctgggcgacctgtgcggccagaacagcacggtgagctcgctgccgaagatggaaaggcagcagccaccctcg

SEQ ID NO: 66689 - DNA, 435 bp, Zea mays
  unsure at all n locations
  Clone ID: LIB3076-033-Q1-K1-B9
aattcccggttggtggttaccgaagcttgagatatcgcagatagagatagaatatatacataagtaagctcctatagaattaacgtctagcgttctagctgttgtgcacattctacagcactaaccactgtgccaagagcaccagaaacagatcgatttcgcaaaatattaaaaaaaagacggccggaaacagaaagcgcaactcacccgatccaaatcggcgtgtacgtatgtacgcagtagatcagtgggagagatcgttaataatttccccatttgtagcggcggaagaggtcttgtgtcgcatcgaaaccttcaggctaaatgcttagttgaaactgttcccgtgattcttaagctatctatgtatntgaagattccccggcatgctttcgactatgaactgcaataatttgaatgcaagaggattgtttg

SEQ ID NO: 66690 - DNA, 397 bp, Zea mays
  Clone ID: LIB3076-033-Q1-K1-A3
cccacgcgtgcgcccactcgtccggtcaaatcccagactctatatagcaacggtagccgagacttggggatacatgggacgggggctctgggttgcctgccgcagaagcttgccataccaaggaaaaacgacagcgatcttgatcagtatggctgtctcaagacctataacagagctgcagttgcgttcaacgcagcgctgggcagcctctgcgacgagctgagtgcgcagatgaaagacgcgacgcttgtgtacacggacctgttccccatcaagtatggtcttgtcgccaaccacactaaatatggttttgacaagccgctgatgacatgctgtgggtaccgaaggccttcctacaactacgacttcagcaagggttgccagtctaaggatgtgg

SEQ ID NO: 66691 - DNA, 449 bp, Zea mays
  Clone ID: LIB3076-032-Q1-K1-G7
cggacgcgtggggcgagtaagcactcccatcctcaatccctcccctccgcgggtgcgccggaaaccccgctgttcttcgccggagcactccctccccgttcccccgccgcccccggccccccgacctcgatatcttcggagcccgccgttgggggcctactgcatgctcaaatcgtagacactgggtcggggcgtggtagagatccgtccgggctcggatcgatttcttcgttcgctggtgagtagcctaggcaagctgggcggggttgtttaggagctcgctttggtctaggaaaccacctattttctgagtgagaacaattacatccaaatgaactctctccattcagccgggagccatttgcttgcttggcaccctattctagtgactctagtccatccacgcgtggttcagttaggttcttcagcgcgcaagatcgacctacact

SEQ ID NO: 66692 - DNA, 343 bp, Zea mays
  Clone ID: LIB3076-032-Q1-K1-G8
tcgcgagcactcgccgccactcaccagcaaattcccgagccgccccttccccatgggtttcgggacccatttgatcgattcctgatggcgcccaaggccgagaagaagcccgcggagaagaagccggcggaggagaaggccgagaagaagccaagggcggagaagcgcgtgccgagcaaggagggcggcgagaagaagggaaagaagaaggcgaagaagagcgtcgagacgtacaagatctacatcttcaaggtgctcaagcaggtgcacccggacattggcatctcgtccaaggccatgtccatcatgaactccttcatcaacgacatcttcgagaagctcg

SEQ ID NO: 66693 - DNA, 343 bp, Zea mays
  Clone ID: LIB3076-032-Q1-K1-G9
cccactcgtccgcccacaccgtccgagaacttgaacttaaattgaaggatcgtttcaagagatactgtcaaattgcccacaaacgagttgtagataaaccaattactgaagtcagagaatctggaatatgcatgcgtgaaaattctctctatgtacacacattgcgtaactttcgtgatagaagatatgaatacaaatgtcttaacaaaacatggaaaggaaaactcgcataatctaatgccaatggaaattctatgaaaattcatgaagcgcatgatatggttgttctatatgattctttgcaacttgctcacaattgcatattgaattctttttatggata

SEQ ID NO: 66694 - DNA, 294 bp, Zea mays
  Clone ID: LIB3076-032-Q1-K1-H1
ccgtttcgacccactcttccacttactcttttttctagtaatttctcccattctcaatccctccccttctcaagtcctcctgaaacccttctgttcttctccatatcactcccttccctttcccccaccttccccttctccccctacctctatatcttctgatccctccatttttttcctacttcattctcaaatcttatacactctttcttatctttttacaaatccttcctttctctaatcgatttcttcattctctttttaatatcctattctaacttatctttatttttt

SEQ ID NO: 66695 - DNA, 397 bp, Zea mays
  Clone ID: LIB3076-032-Q1-K1-H10
gttattcagcaaggacgattggcagagcagaaaactgtcaataaggatgaccttctgcgaatggtgcggtttggtgctgaaatggttttcagttctaaggacagcacaataactgatgaggacattgaccgtattatagctaaaggagaggagacaacagctgaacttgatgcaaaaatgaaaaagttcacagaggacgccattaaatttaagatggatgataatgccgaactgtatgattttgatgatgagaaggatgaaaacaaggttgatttcaagaaacttgttagtgataactggatcgagccacctagaagagaaaggaagagaaactactctgagtctgattactttaagcaagcgcttcgccaaggtgcaccagcgaagccttaggagc

SEQ ID NO: 66696 - DNA, 413 bp, Zea mays
  Clone ID: LIB3076-032-Q1-K1-H11
gttattcagcaaggacgattggtttagcataaaactgtcaataaggatgaccggctgcagatggtgcggtttggtgctgaaatggttttcagttctaaggacagcacaataactgatgaggacattgaccgtattatagctaaaggagaggagacaacagctgaacttgatgcaaaaatgaaaaagttcacagaggacgccattaaatttaagatggatgataatgccgaactgtatgattttgatgatgagaaggatgaaaacaaggttgatttcaagaaacttgttagtgataactggatcgagccacctagaagagaaaggaagagaaactactctgagtctgattactttaagcaagcgctttgccaaggtgcaccatccaagcctaaggagccaatgatttcaagaaa

SEQ ID NO: 66697 - DNA, 414 bp, Zea mays
  Clone ID: LIB3076-032-Q1-K1-H12
gttattcagcaaggacgattggtagagcataaaactgtcaataaggatgaccggctgcgagatggtgcggtttggtgctgaaatggttttcagttctaaggacagcacaataactgatgaggacattgaccgtattatagctaaaggagaggagacaacagctgaacttgatgcaaaaatgaaaaagttcacagaggacgccattaaatttaagatggatgataatgccgaactgtatgattttgatgatgagaaggatgaaaacaaggttgatttcaagaaacttgttagtgataactggatcgagccacctagaagagaaaggaagagaaactactctgagtctgattactttaagcaagcgcttcgccaaggtgcaccaacgaagcctagggagccaaggattccaagaat

SEQ ID NO: 66698 - DNA, 380 bp, Zea mays
  unsure at all n locations
  Clone ID: LIB3076-032-Q1-K1-H3
attcctcccatctcccaagacctcctcagacccgagaagcgcagctgcggccatggacgcgaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtnccgcgccacgtgctgcttgcgatccgcaacgacgaggagctcgggaagc

SEQ ID NO: 66699 - DNA, 303 bp, Zea mays
  Clone ID: LIB3076-032-Q1-K1-H4
accacgcgtacggttttttgaaacgagtgcgaagacaaacctgaatgtggagcaagtgtgtggtctccatcgcacgtgacatcaagcagaggcttgcggagactgattcaaagccagaggacaaggcaatcaaaattaacaagccagaccagggttccgaggcaccagctgcccagcgatctgcttgctgcggctcataagcagatgcacgatggccatagcctttggttatttgacattatttatttcccgcttggctgttataggaaggatttgaagaaaccacttatgatataccgatgt

SEQ ID NO: 66700 - DNA, 350 bp, Zea mays
  Clone ID: LIB3076-032-Q1-K1-H6
accgcctccgccgccgacaacagcgtagtgtagtgtagttccggagagggtgggggagagtagtagtgatccgcaatgtcgacggaggaggctgttgtggctgaggtcccggtgaccgaagtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaaggaggggtcgagctcggtggccatcatcaagtacgtcgaggggaaacattgcggcaagct

SEQ ID NO: 66701 - DNA, 433 bp, Zea mays
  Clone ID: LIB3076-032-Q1-K1-H7
gctgtgatggtggtggccgtggtatcggtggcgccgcgcggcgcggaggcgaagacgacggtcgagccgtgctcggggtccgactcctgcccggcgctgctgggctacacgctctacgccgacatgaaggtgtccgaggtggccgcgctcttcgccgtcgacccggcggcgttgctggccgccaacgcgctcgacttcggcgccccaggggcggcgcaccgcatcctgcccatgggcctcttcgtgcgcgtgcccacccgctgttcctgcgccgacggcgtccgcaagtccgtctccgtacgctacgccgcgcgcccggtcgacacgctcgccaccgtcttcgacgtccgcttcgcagggctccgcttcttcgaccagatccgcaacgagaacggccttaccttcaacgaccctgacgcgccgctggacgccg

SEQ ID NO: 66702 - DNA, 359 bp, Zea mays
  Clone ID: LIB3076-033-Q1-K1-A1
ctcggaaaggatggcagcggtatcaaggaaccagtccaggcaaaatccgtggacgtcagggctggactaggaagtcagcagcggaaggctgatccaatcctggaggccaaagccggagacagctacaaaaccatcatccagaagaaggccatggcaagattcaaggagatgtcctagctagaccttttttttttgtatattcggttgtcgtattttgtcgtccgtatacttttttttttacaatctgtgcactgttttgcttgtgttttttttcttcacaaacctagccactgaattgtgatttattatcctcaaaggggcaccgtgtttatcttattattactatgtagttcgagacc

SEQ ID NO: 66703 - DNA, 464 bp, Zea mays
  unsure at all n locations
  Clone ID: LIB3076-033-Q1-K1-A11
acggcgcgctccacctncgccgtgtgctcccctcgcccgccgtcaccgccgccgcctcccagcgcctcatccccgccttctcgaccacccccacgccgaccccgaccacctnccagcagaacgccgccaccactacgatcgacctctcctccgacgagagccgccgccgcctcctcaataggttggtgtaccggagcaagcagcgaggttttctggaactggacctggtgctggggacctgggtcgagcagcacgtgcacgccatggacgaggccaacatccgcgccctcctgcaagtgctcgacctcgaaaacccagatttgtggaaatggttgactagccaggagcagccaccagaggatctgaattctaatccggtgtttgctgccatcaaatcaaaggtcacagataacctgaccaagcatgcttctcctgagacccgatctacaccaggtcaaccatgg

SEQ ID NO: 66704 - DNA, 445 bp, Zea mays
  Clone ID: LIB3076-033-Q1-K1-A12
ggcatcttcccttctctgggccgcacccgcagtcccgcaccgccacgcgccagagaccatgtggcgccgcgccggagccgggccgctcctccaccacctcgctgcagccgcctccgccgccgccgccggccgctgcattaatggacggccgctacctcctatgcccaccgcctcttggtcccccctgttccagcacaatcttggaatctcgtggggttccgcttctgtcggggctcccttccggagcctgtcgaaccagtcaagcggcggcggcgcgtgctggagctgcggtgcgacgggcgcgttcctctcctgcgggtcctgcgggagcgtgcagcctgtcgaccccgccgtcgactacttccaaatatttggcctaaaaagagagtataatataacggataataacttggaagggaagtacaaggactggcagaagaagtta

SEQ ID NO: 66705 - DNA, 391 bp, Zea mays
  Clone ID: LIB3076-033-Q1-K1-A2
acgctcggaaaggatggcagcggtatcaaggaactcagtccaggcaaaatccgtggacgtcagtgctttactaggaagtcagcggcggaaggctgatccaatcctggaggccaaagccggagacagctacaaaaccatcatccataagaaggccatggcaagattcaaggagatgtcctagctagaccttttttttttgtatattcggttgtcgtattttgtcgtccgtatacttttttttttacaatctgtgcactgttttgcttgtgttatttttcttcacaaacctagccactgaattgtgatttattatcctcaaaggggcaccgtgtttatcttattattactatgtagttcgagaccaaaaaaaaataattaattttttatttat

SEQ ID NO: 66706 - DNA, 450 bp, Zea mays
  unsure at all n locations
  Clone ID: LIB3076-032-Q1-K1-G6
gcttgtaggacacccaactacttctgtgggacctggcactggatgagattgttgtcccagtacggcatccttcaagtgcctcacctacgtttagcagcgggagcccttccacacactgggacaatgcatgccctccaacaggtgttcttcaaccttctcctagaatgcgagatgtcccaaaactatcgcccctagttgcccaccgagtacatgccgatcccctatctggtatggtgttcaccagtgaatctatcctcaccatctgccgcgagggcctcatcaaaatctgggttcgaccagagcagagcgaaaacaatcagcaatcgaattcttcagaatttgctttaggccctgcttcgaaggatagggcgatcacatcttccaataagcangtagctccagctttaagaagcttgcgnctgntcttgtcacatgatgaatcaacgggat

SEQ ID NO: 66707 - DNA, 296 bp, Zea mays
  Clone ID: LIB3076-032-Q1-K1-E9
cccacgcgtccgcacctaccatcttcatcttcgacaacagcgtaatgtagtgtacatcgggagaggttacttgagagaagtaccaatccacactgtcaaccgagcaagcttctaaggctcatgtcaaattgacctacgtgccatcccatgatccttcgcaccaggtatctcgaagctcccaaggctaacattgctcccaaggataagaaggcgcataaccagactaaacttttcatgactaccaagccgtcgatataaccttcatacgctgagatgaatgtacaggcaatcgttga

SEQ ID NO: 66708 - DNA, 441 bp, Zea mays
  Clone ID: LIB3076-032-Q1-K1-F1
ctccgctcggccaccagctttgaccgcctcccctcccctcgtctcctgtgttcctccataggccactccccccgcaggagcggcgcggcggcggcaaaggcaaaggcaaaggcaagatgttcgggcgcgcgccgaagaagagcgacaacaccaagtactatgagatcctcggggtgcccaagtcggcgtcccaggacgacctcaagaaggcctaccgcaaggccgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggtggtggtggatcccatgctgatccatttgacattttctcatcattctttggaccctcttttggaggaagtggtggaa

SEQ ID NO: 66709 - DNA, 396 bp, Zea mays
  Clone ID: LIB3076-032-Q1-K1-F11
cccacgcgtccgcggacgcgtgggcggttcttgccctttccccgccccaagggtacacggtctccggcacctgccctagccgcaggagggagcgttcgccgccccgccccgccctccgtctcccgtcgcctcgccccccgcgctccgtctgccgcccctctccggagaaatgtctgagcatctctttgaggacaccttcgtcgtcactagactcgaccctgatggcaaaaagtttgatagagtttctcgtgttgaagctcgcagtgagcagttagatatgtatatgcagctagatgttgccacagatgtttatcctatgcatgcttgtgagataattaacatggttatagcgcccactctgaatttggatggcaccccagatactggctactatac

SEQ ID NO: 66710 - DNA, 429 bp, Zea mays
  Clone ID: LIB3076-032-Q1-K1-F2
ctccgctcggccaccagctttgaccgccttccctcccctcgtctcctgtgttcctccataccccactgcccccgcaggagcggcgcggcggcggcaaaggcaaaggcaaaggcaagatgttcgggcgcgcgccgaagaagagcgacaacaccaagtactatgagatcctcggggtgcccaagtcggcgtcccaggacgacctcaagaaggcctaccgcaaggccgctatcaagaaccaccccgacaagggcggtgaccccgagaagttcaaggagctcgcacaagcctatgaagttttgagtgatccagagaaacgtgagatttatgatcagtatggtgaagatgcccttaatggaaggatgggtggtggtggaatcccatcctgatccattgacatattctattattctttggaacctcttttggaag

SEQ ID NO: 66711 - DNA, 459 bp, Zea mays
  Clone ID: LIB3076-032-Q1-K1-F3
cccacgcgtccgcccacgcgtccggctaatagtgcatcagatattttaatggcaagtgtatctgatgaactggacagttttctgtatggtacaaatgaacctactctagttcggtccaatgagttggaaaagtacatggcagatccacttttgcgtcttggtggtccatttgatggcccatttgatattttagcgtggtggaagagcaagagggaagtgtatcctattctttcacaaattgttcgagatgtgatggccatacaagtatcaacggttgcatctgaatctgtttttaatgctgctggccgttttgttgatccttatcgtaatcgtcttgagccggagatggtagaggcattgatatgcaccaaagattggatagctgcagaaagaaaagattctaagattgttggttcaattgtgagtgaccttgaaattgagactttatctaccgtcatg

SEQ ID NO: 66712 - DNA, 337 bp, Zea mays
  Clone ID: LIB3076-032-Q1-K1-F4
cccacgcgtccgtccacgcgtccggctaatagtgcatttgatattttaatggcaagtgtagctgatgagctgtacagttttgtgtatggtacaaatgaacctactctagttgggtccaatgagttggaaaagtacatgggagatccacttttgcgtcttggtggtccatttgatggcccatttgatattttagcgtggtggaagagcaagagggaagtgtatcctattctttcacaaattgttcgagatgtgatggccatacaagtatcaacggttgcatctgaatctgtagttaatgctgctggccagttatgtgatccttatcgtaatcgtcttg

SEQ ID NO: 66713 - DNA, 217 bp, Zea mays
  Clone ID: LIB3076-032-Q1-K1-F5
ttccctggtcggccgacaccttcggctacgcttgcgcacacgcttccagctaatattgcatcatatattttaatggcccgtgtagggtgttaactgcacaaggggctgtatggtacaaattaacccactctaattcggtccaattagttggcaaactccatggcaaatccccttttgagtatttgtggaccatttgatggcccatttgatattttaa

SEQ ID NO: 66714 - DNA, 387 bp, Zea mays
  Clone ID: LIB3076-032-Q1-K1-F8
cgattgaacaaattggagcagcactacactcctccacgcctccacctccagggtcccactgatctggcctctctcgagttaatcctagatcaatatgagaaggggctacagttacagtccttcaccaccaaggggctacaggagaagggcccgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggggatccccgagggtttgggtttgtccagtattatgatcctgctgatgctgctgatgcgaagtactatat

SEQ ID NO: 66715 - DNA, 391 bp, Zea mays
  Clone ID: LIB3076-032-Q1-K1-F9
ccgacgcgtgcgcgcacgcgaacgcgactttcagtttcatcatcaagcaccgcgcaggttgcccggttacatcgaggagcgcggcaagcacgccttcgacctaaccactggtgactactccgcccatctcgccgtttgccggctccggtggtcgcttcagaaggaaatcatcggccgacgcatactagagggcgaccccaccatggacgaccagccaccctactgccttcaacgtgtgaactgaccgcaccctcagacttgcttttgctccttgacaagcattatctactgtagacatttaggaccggagaagacatcacgaggagaacggagattatctagtcacggatcgtcttacctgtactgtgatatattatattgtacatatatc

SEQ ID NO: 66716 - DNA, 429 bp, Zea mays
  Clone ID: LIB3076-032-Q1-K1-G1
cggacgcgtgggcggacgcgtgggcggacgcgtggggccaggattggattgtggcgggtagtacccgtgggattcctccacgtgtacgattgcgaatcgaggaaggaaatacgccgtctttgtgaacacccgaaatctatcacgtctttggctgttgacgatgatgcccttgagctggtgctgtcagcgtccatcgatggcaagattttgatctggagctactggcactactaccgcgcacgtagaggtagacgtagtacctggcatttggaaaaaacatttgacgcgggaagccagtgtctgaagcaagtcgcgtttattgctccaagtgtccatcgcagcagcagcactatcatcggtactgctcgagacggaacaagtaagatttgggatcccgatcgttctgaccgatgccgtgagctcacattg

SEQ ID NO: 66717 - DNA, 405 bp, Zea mays
  unsure at all n locations
  Clone ID: LIB3076-032-Q1-K1-G10
gccactaacagactgccggccgccaggagctatccatgcatttctgcatgggcctcatggccgagctatgctcaagtgccgcctctggtttccctttttttttttttttaattttcttctccccagccgctgctccactcggccgccagggagcatcacgcttgtttctttctctgattctttgtctgagcagccgctagagcacagagctactggccgaacgtgcccgagtacggccgttcctgcgcgttgcatgctcctatctctctcttttttttttctttctttcactgtttactgattttggagattactaacgcacggttggcttcaatgcaccggagatggccggcctgagccgnctcgcatccccatcccgccgacgtgcgcgtcccttcgggtggg

SEQ ID NO: 66718 - DNA, 335 bp, Zea mays
  Clone ID: LIB3076-032-Q1-K1-G12
gccactaacagactgccggccttcaggatctatccatgcatttctgcatggggctcatgtccgatctatgctcaagtgccgcctctggtttccctttttttttttttttaattttcttctccccagccgctgctccactcggccgccagggagcatcacgcttgtttctttctctgattctttgtctgagcagccgctagagcacagagctactggccgaacgtgcccgagtacggccgttcctgcgcgttgcatgctcctatctctctcttttttttttctttctttcactgtttactgattttggagattactaacgcacggttggcttcaat

SEQ ID NO: 66719 - DNA, 371 bp, Zea mays
  Clone ID: LIB3076-032-Q1-K1-G2
cggacgcgtgggcggacgcgtgggcggactcgtgcggtcaggattgcattgtggtgcgtggctacccggggatgcctgcactcgagctaatgctaattcaataaggaaatacgccgtctttgtgaacacccgaaatctatcacgtctttggctgttgacgatgatgcccttgagctggtgctgtcagcgtccatcgatggcaagattttgatctggagctactggcactactaccgcgcacgtataggtagacgtagtacctggcatttggaaaaaacatttgacgcgggaagccagtgtctgaagcaagtcgcgtttattgctccaagtgtccatcgcaacagcagcactatcatcgctactgctcgaga

SEQ ID NO: 66720 - DNA, 394 bp, Zea mays
  Clone ID: LIB3076-032-Q1-K1-G3
cggactcatgggcggactcgtcgactgactcttgtggccaggaatggattgtgtcggttagtacccttggattcctcggcgtgtacgattgccaatctatgaacgaaatactccgtctttgtgaacacccgaaatctatcacgtctttggctgttgacgatgatgccctttagctgatgctgtcagcgtccatcgatggcaagattttgatctggagctactggcactactaccgcgcacgtagatgtatacgtattacctggcatttggaaaaaacattttactccgtaagccagtgtctgaatcaagtctcgtttattgctccaagtgtccatcgcatcagcagcactatcatttctacttctctatactgaacaattaacattttggatcc

SEQ ID NO: 66721 - DNA, 319 bp, Zea mays
  Clone ID: LIB3076-032-Q1-K1-G4
cgagattgtaaagaaactggagggcatgcagtggacaattcaccaggtggagatggacctgaaacctgaccatgaccacgcagctgtttaagtccacatctgttggaggccatgtttattacctgaatgcagcgggtgcgagttaggggggttgcagtggatgtgatttgagccagagggtttctgtttgtgcatgttttttttgtgtgtctatccatgctggataatagcaccatcaatgcttgcttagttatacggtcatgtattcggtttgtttgatgacgagaaacactagaagagagcgagacatggaaaacac

SEQ ID NO: 66722 - DNA, 382 bp, Zea mays
  Clone ID: LIB3076-032-Q1-K1-E8
atcatcccccttgcaagtatagtctcggctgctctagaagacgatgggcaaggacgacgggatcgatagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtctgcgtcgggtgccgacgcggcgtgcggcggcgtgggggtgctgggcatcgcctgtgccttcggcggcatgatctttggcctcgtctactgcaccgtcggcatctctgggggccacattaacccc

SEQ ID NO: 66723 - DNA, 302 bp, Zea mays
  Clone ID: LIB3076-032-Q1-K1-C2
gtgcttgtttgctctagggtttttgccacgccgccgccgctctgccccttccaccccacggatataccaagatgacggcgcaggctgcggaggagctcgccgcccagatcgagcagcagaagctcgaggagcagaagaccgaggcagaagaggttgtggtggaggaggatgacgaggatgatgaggatgacgatgatgatgacaaggatgatgatgaactggatggacaagaaggggatgggagtggcaagtcgaagcaaagcaggagtgagaagaagagccgcaaggccatgctgaagctt

SEQ ID NO: 66724 - DNA, 410 bp, Zea mays
  Clone ID: LIB3076-032-Q1-K1-C3
ggcgacctccgccgccacactaaaccctactccaggtgcccaggtctgcgtcgggcccttgccggcgacgagcacccgctaggtaccattggccatgtggctcatggaaagtctactgttgtgaaggctatatccggagttcagactgttcggttcaagaatgagctggaacgtaacattactataaagctgggctatgctaatgcaaaaatctacaaatgtgaggatgacagatgtccacgaccaatgtgctacaaggcctatggaagcggaaaagaagatagccctctatgtgatgtgcctggatttgaaaacactagaatgaagctcctgagacatgtttcttttgttgattggcccggacacgacattctcatggctacaatgcttaatggagctgctatcatgga

SEQ ID NO: 66725 - DNA, 428 bp, Zea mays
  unsure at all n locations
  Clone ID: LIB3076-032-Q1-K1-C4
cccacgcgtccgcccacgcgtccgcggacgcgtgggctcgagggcgccggcgccggctccggccagtccaccgacgcctccccggccgcggccggcggcacggaccaggtcatgtcggaggtgtacctcggccggcagatctgcaacgtggtggcgtgcgagggcgcggagcgcacggagcgccacgagacgctgggccagtggcgcagccgcctcggcggctccgggttcgcgcccgtgcacctgggctccaatgcctacaagcaggcgagcacgctgctggcgctcttcgccggcggcgacgggtacagggtggaggagaaggacgggtgcctgaccctggggtggcatacgcgcccgctcatcgncacctcggcgtggcgcgtcggcgncggcggcggttcctgatcagggaggggtggttgggg

SEQ ID NO: 66726 - DNA, 337 bp, Zea mays
  Clone ID: LIB3076-032-Q1-K1-C6
ttgacgcgtggggggtattcatgatcgattattcctctagcaagagcttcaagggtcttaggataaacttgccagctggagcgcaccctacggctgttactttctcataggggtcatcatctgttgttgtggcgtcgcatgcgcttctgggatcatctctttatatgtatgctgatgttaacgctccttcaaccgtggaaaacaaactgcatggaaagctttcttcacctgaaatcaagtgtagtcaccccaagatacattggtatggagtctgttctcaaccttgcaacataccgtgcatctcatgtggttggtgatgggagcactattaatcatt

SEQ ID NO: 66727 - DNA, 265 bp, Zea mays
  Clone ID: LIB3076-032-Q1-K1-C7
tgcaacacccagcacctgatgaatgccgttttctcgctcccggagctcacagagcgcatgaggatgatcgacatgcacactaatatcgcgacagcgatgcttgggcacatcaaggagagatcgctggatggatactgtgactgcgggaacagacatgctcacgaagggcaccgtggacaggagcacgctactgggccttctacgagggaagggcacctaggccgacaagcttcgtatggctgtgacctacctactatgtttcgag

SEQ ID NO: 66728 - DNA, 425 bp, Zea mays
  Clone ID: LIB3076-032-Q1-K1-C8
cggacgcgtggggcttcttgagacatactggatggaggaggaagatgacgcaggggctactgccgtggaagctgctcctgctgtttttgactttaaccaaggtggcaacccttctggtgctggtggtctgaacttcaactgatacagtctttgatcgaaagggtgttaattccctcagtgatgggcttggcattggcttgtcgtgacaaatgtagtctggtcgactccacgtgggatataatggtttgtggtgagtccaataaactcaagatttctaagggagatgggctgagcattatttccaagtgaaccattggtatcaatattaatattgtagggtctgtaacatgattatattatccttgaacattaaaacgtgggtttttgagaacactactcttaggtgtgcgtcctttaattatttt

SEQ ID NO: 66729 - DNA, 327 bp, Zea mays
  unsure at all n locations
  Clone ID: LIB3076-032-Q1-K1-D1
cccacgcgtncgagaacagagtcactntattccttgcattatttaatcttgttcccggtacagctagcaagacacaagttttacagatgtaggattatcaggaagcaatccttggaacaaggagaagcttctccttccggcgaagcgtcagcccaaaggactcgtccatggacacccctgctgcagagcccggaacctnccaatcaaaatggtacatgagattggccagcatgatctccatggtcgcgaatccgaagttcatcccggggcagatcctccggccggagccgaacgggatgaacctgaggtccttgcccttcatgtgga

SEQ ID NO: 66730 - DNA, 166 bp, Zea mays
  Clone ID: LIB3076-032-Q1-K1-D10
actcgtcctcttcatcaaattagcatttttcatgctttatttcatcttaggctttgttcaaatttacattggatatggttatatataatctaccactgattccttactatccatatcttgctcatctatgcttgttttatttatttttattacttgtattttatca

SEQ ID NO: 66731 - DNA, 386 bp, Zea mays
  Clone ID: LIB3076-032-Q1-K1-D11
cccacgcgtccgctcctgaaatgctcatctccttgtcatgccttattgcttttgcagtggttgttagtacttatgtgattttccatctgttgcgtctaattgtgctgctatccaagtttctcctgaaatgctcctccttgtcatgccttattgctttgcagtgtttattagtacttgtgtggtttccatctgttacgtgtttgtgttttagtatcaccagccttaagtgctaatgattacccattagttgatatgatttccatgccggtgctgtatatacttttatctcttcggtcttagcttcatgggtgtgaaattacgtttgcagggcactcaaagaagagaaaattgctgctcgtagtgctatactgccgatgctccaagct

SEQ ID NO: 66732 - DNA, 405 bp, Zea mays
  Clone ID: LIB3076-032-Q1-K1-D12
cccacgcgtccgcttcatcaaaagagcatatttcatgctttatttcatcttacgctggttgacgtggtgacattggaaatggtgtgataaagctaccactgaggccttactatccatttcgtgctcatctatgctgttgttatttatttttattacttggatggtagcatgctgctgctgtttgctgattctgcggtacctatgtggctatgtgattagcatgcatatctgtttcttgttgcttactgttccttattcctcccttggtctactgagactatgttcaacggtgcacccttggctccccctcccctaacactgtagccgatttaggggctacagtgtgcccctatccccttcaccgacttcctcctccttctcctctcccctcccgattccttctct

SEQ ID NO: 66733 - DNA, 381 bp, Zea mays
  Clone ID: LIB3076-032-Q1-K1-D2
gtcctagaggagaacacaagaaagattcaaaaatcttttgctgatgaaagaacagctctcagaaaattaacagaggaacaccgagcagctaatgaaatacgtcaaaaggcctacagcgattggactgagcttagatcagagcccagcaagaagaatgaatactttttcaagtacagggacgcccgaaatgcagcagaaactttcagagccaatggagatataaatggacttatatcacactgtaatagtcagattgagagagttatggaaatatggaacaaaaacgaggacttccgcaagcagtatgttgaatcgaacaaggttagcacactaaagagattagggactcatgacggacgaaaacttggccctggtgaggat

SEQ ID NO: 66734 - DNA, 303 bp, Zea mays
  Clone ID: LIB3076-032-Q1-K1-D3
gccacacatgcgagcacagagtcacttcattccttgcatgatgtaatctgagcacctgtgcggctagcaagacacaagcattacacatgtaagattatcaggaagcaatccttggaacatggacaagcttctccttccggcgaagcgtgaacccagaggactcgttcatggacacccatgctgcagagcccggaacctctcaatcaaaatggtacatgatattgggcaccatgatctacatggtcgcgaatactaagatcattccggggcatatcctccggccggagccctacgggatgaacc

SEQ ID NO: 66735 - DNA, 121 bp, Zea mays
  Clone ID: LIB3076-032-Q1-K1-D4
gtcatacatgcgagcacatgaacgcttcattacttgctttatgtaatctgagcacctgtcgagctattggcacacgaacacggcacatgtaatgaaatacggaaacaagcctacggcacat

SEQ ID NO: 66736 - DNA, 219 bp, Zea mays
  Clone ID: LIB3076-032-Q1-K1-D6
tcgaaaataaagcaagcaccagaatctcatatttcccaaactcgcaagtcgcaacggccatgtgtgcacttccccaccgacttggggttctagtccttctagacgccgtcgtctcttctcactgctttcgtcgcatacctcatctgcgcgtctaactacctgctgtccaattacggcctccctaaagggctcattcctgactctgtcacctcctacaga

SEQ ID NO: 66737 - DNA, 456 bp, Zea mays
  Clone ID: LIB3076-032-Q1-K1-E1
gttactaacttactattgttcacattaatgtgcattatgttgacttctaaattgcccaggcggaggctggagaagcgaatttatatcccacttccagatttcgaaagcagaaaggcacttatcaacattaatcttagaacagttcagatagctgcggatgttaacatcgatgaggttgctcggaggacagaaggctatagtggagatgacttgacaaatgtttgccgtgatgcttcgatgaacggtatgcggcgcaagatagcaggcaaaacccgcgacgagatcaagaacatgtcaaaggacgacatagccaaggacccagtggccatgtgcgactttggggaggctctggtgaaggtccagaagagtgtcttgcctgcagacatataaaagcacgagaagtggatggctgagtttggatctgcctgggacctcatcttcttcaacattggtttc

SEQ ID NO: 66738 - DNA, 308 bp, Zea mays
  Clone ID: LIB3076-032-Q1-K1-E10
aatatgccgctcgacccactcgtccgtccacgcgtccgcttctttaatttagcatttcacatgcatgattccatcttaggccttgttactttcatacgttggacatgtcatgtccaagataccacttacgtcttactcttcatttcttgcaaaactaatccattactattaattctcattacttagattgtaacattctcatactgtcttaagattctgcgttacatatatgtctatccatattatacatccttatcactttattgtcactaaccactatttattacatctatcgtctaataatacta

SEQ ID NO: 66739 - DNA, 307 bp, Zea mays
  Clone ID: LIB3076-032-Q1-K1-E2
tcctggtgttactaacttactattgttcacattaatgtgcattatgttgacttctaaatttctccatgcggtggctggagaagggaatttaggtcccacttccagatttcgaaagcagaaaggcacttatcaacattaatcttagaacagttcatattgctgcggatgttaacatcgatgaggttgctcggaggacagaaggctatagtggatatgacttgtcatatgtttgccgtgtatgcttcgatgaacggtatgctgtgcatgatttcaggcaaaacccgtttacgagatcaagaacatgtca

SEQ ID NO: 66740 - DNA, 460 bp, Zea mays
  Clone ID: LIB3076-032-Q1-K1-E3
cggacgcgtgggtaacacttctgcatatctgttaaataagtttcttgtgatctaacataaaggagttaccctatttctggatgcatcataggtgatgtgaagcgtgttggctttccaacatttgcttagtgcttctgcatagtgcattgagtagtactaaatttagttttgtgtggtctaggccacaccttatgctttgtacaaacaagcaagctaccatgatttctattggtgtgttgcagctggtctatgcatcacagttgttgtccttccattgaacgccgttgaattaattatgtcgatcaaatcaaaccctactcatgttcctgctgtggagctctgccataacgttgtatgtccatgtgatatattgctttcaagtccagttttggactgtccaatctctatctgtgctcaactcaagccgtgtggtttcatgttaattgatagcagcaaaaca

SEQ ID NO: 66741 - DNA, 186 bp, Zea mays
  Clone ID: LIB3076-032-Q1-K1-C12
ctgtggctcctttcttctcaacggcagcggccgcggcatggcggactactgcggcggcctaaccgtacccgtcgtcaggacctgtctcatggcgggctccggcggactcatcttcggctacgacattggcatctcatgaggtgtgtctgagatggaggattttctgaacaagattttccccgggtt

SEQ ID NO: 66742 - DNA, 404 bp, Zea mays
  Clone ID: LIB3076-032-Q1-K1-E4
gacagatcgttcatcgtagcctcgtccagtcgtctcccgggatcttctccggctataaatgtccgccccaattctccaatccagatgcgcaaacatcgaatcgtctcgctcgtggctgccctgctcatactgcttgccctcgccgtatcgtccacccgcaacgcacaggaggattccatggccgacaacaccgggacgttggcgggcggcatcaaggacgtgccggggaacgagaacgaccttcacctccaggagctcgcccgattcgccgtcgatgagcacaacaagaaggccaatgctcttctggggttcgagaagcttgtgaaggccaagacacaagtggttgctggcacgatgtactatctcactattgaagtgaaggatggccaagtcaagaagctcta

SEQ ID NO: 66743 - DNA, 168 bp, Zea mays
  Clone ID: LIB3076-036-Q1-K1-E10
ggcgcagatgtgtggaatccattggaaaagaaatctaagattatggtatacctcggcgactaggagtacagtcagattcttagcgttgatgcggctgctgtggagagagcaatcttgctgaaaccaggggaagagtggactgggaagcttgaactttctgcggtttta

SEQ ID NO: 66744 - DNA, 340 bp, Zea mays
  Clone ID: LIB3076-036-Q1-K1-E2
gtctgccacagagatattaagccacaaaaccttctggtgaacccacacacccaccagctgagactgtgtgactttggcagtgcaaaagttctggtcaagggggaaccaaacatatcgtacatctgctcccgatactatagggctccagagctcatatttggtgccactgagtataccacagcgattgacatttggtctgctggatgtgttcttgctgagcttatgctagggcagcctttgtttccgggtgaaagtggtgtggaccaacttgtcgaaatcatcaatggcctcagtacgccaacaagggaagaaattaaatgcatgaacccaaattacacag

SEQ ID NO: 66745 - DNA, 444 bp, Zea mays
  unsure at all n locations
  Clone ID: LIB3076-036-Q1-K1-E4
cccacgcgtccgcccatttcaaatccttcgatcgcacagcgccgcccgccctcacgcagctctctgcgatggcgcgcacgaagcagacggcgaggaagtcgaccggcggcaaggcgccgcggaagcagctggccaccaaggcggcgcgaaagtcggccccggccaccggcggcgtgaagaagccgcacaggtttcgccccggcaccgtcgcgctccgcgagatccgcaagtaccagaagagcacggagctgctcatccggaagctgcccttccagcggctggtgcgggagatcgcgcaggacttcaagaccgaccttcggttccagtcctccggcggcgccgcgctgcangaggccggcgaggcgtacctggtgggtctcttcgaggacaccaacctctgggccatccatgccaagagggtcaccatcatgcctaaagacattc

SEQ ID NO: 66746 - DNA, 373 bp, Zea mays
  unsure at all n locations
  Clone ID: LIB3076-036-Q1-K1-E9
caaaacctgttattatcaggtnatggttgttttctagtggtggaaggttgaagttggagctttgttcttggaggaatgaatggttattgtgaaaaagatctttatttttcaactatatcacgtgtaactattaacttggtcctttcaactttatctctgtgcttgaaagtgcccaacacccactcctgcagtacttttggtcaaactgccaaagtactacttggtacttagtgttagatgttaatagtgtgcatgtatttagtctctaatacaaggtgctgtttgcactttgtacttcatattttgctcttttgcccgttcaatatgcttagctgcacattcctagcacttaacacctttaaattttaatcat

SEQ ID NO: 66747 - DNA, 325 bp, Zea mays
  Clone ID: LIB3076-036-Q1-K1-F12
gcgcccacacgtccgcctccccctccggttcgtgttcgggttcgtgaggttctcctgagttcgggttcgtgtgaaatcggatcgagatggcggcatccgatgttgagtaccgctgcttcgtctgcggcctcacctgggccacggacgaccactccctacacaactccttcagcacctactgcgaggtcctctagtccaagatcatcctttatctggagacgcaaaagtcccgcagcttctgcttcttcaccttcttcactgacgatgcgattcataacgccatctaaggcattaacggcaatgagctttacagacgtaacatcac

SEQ ID NO: 66748 - DNA, 440 bp, Zea mays
  Clone ID: LIB3076-036-Q1-K1-F6
ggttggtggaacaagcttgggatgagacatctaaatctaaacccccaggtgctgttggtgtgagcattgcacttgagaaatgtcttcctaacaatccttcatctgatcttgggttgcgaaggttactgtccagggttgaacctagcatcagtgtacttgtctgttcaaggggtggtggcggtctgttgactgaacgcatggaacttgtcgcggagctttggaaagctaacataatggctcagtttgttcctcaggaagatccaagtcttcaagaacagtgtgaatatgccagtgaacatgatattaaatgccttgcaattattactgaatctggcctgtcacaaacagaccttgtgaaggttcggcatcttgattttaaaaagagaaggatgttgaagagagggactaataagtatctgtctgatgcaatgtgtttacaa

SEQ ID NO: 66749 - DNA, 423 bp, Zea mays
  Clone ID: LIB3076-036-Q1-K1-G12
ggaccatgtggttctggccgtggcccggaagaaggcagccaagacgctgcagaaagaggaaagggatctgcagaggtttgccaacgttctcacttcggcgcctgctgggaggaagtgggtgtcggatgagcttgctgtggtggctgagtcgaaggaggttgctggggatatgatcactgaggctgtgcttgatcaggttcttggtgagaaggcatttgagaaatttgggaagtggttcatctcgcttcgtttttcagaccagttggcaggatcttacaagaaggtccttgcattcaagtttgtattgccagatgcaagcaacatgtcagagatgacaagattagttgctcttgtgccatactacattgatttggttgggccgtataagctcagctctcatgctcgctctaaaactgatggagc

SEQ ID NO: 66750 - DNA, 343 bp, Zea mays
  Clone ID: LIB3076-036-Q1-K1-G4
gcgctgcccgttcaacggcccggcgaggctcaagctgggcccgatcagcctcccgctgggcaggaccgggcggcacgtcggggactgggagcacttcacgttccgcgtcagcaacctcaccggtgagctcatgggcgtgtactactcgcagcacagcggcgggcactgggtggacgcctccgcattggagtacatcgacggcaaccggcctgtggtgtactcgtccaggaacgggcacgcgagctacgcgtaccctggcgtgtacctgcagggctcggcggcgctcgggggcgggatccgcaactacgccgctcgtagcaggctattcgtggactccagcgcc

SEQ ID NO: 66751 - DNA, 209 bp, Zea mays
  Clone ID: LIB3076-036-Q1-K1-G6
gacgaactacatgtctgctgggcagatatttgttcctattgtcgttaggggtggaaatggtgctgctgctgtagagggtggccaacactcacagtgctatgcaacttggtatgcacatgttcccggattgaaagtattatctccatattctgcagaatatgctcatggctttctgaaagctgcaatcatggatccatatcctgttgtgt

SEQ ID NO: 66752 - DNA, 227 bp, Zea mays
  Clone ID: LIB3076-036-Q1-K1-G8
aggccaactccgaggctaccctcggcacctacaagggtgatgctgccgtcgacggctagtgccttcacgtcaaggactacaggtactgagttgcttctctttgcgatcccgttgttttggaactcctgcctgctattgggttgctgagtgttgtttgcttgttagagcttttatattcggacatgaaaaaaacatgcttcctatgtggatgattgttatctttatat

SEQ ID NO: 66753 - DNA, 277 bp, Zea mays
  Clone ID: LIB3076-036-Q1-K1-H10
gcgccacgcgtccgcaaacagtctgatccaagatcagaatttaaagcgaataatttcaggtgcgggtgggctacaaatgtatggggacgttctcacttctgcgcctgctttgaggaagtgtttgtcttatgagcttgctgtggtggcttattctaatgatgttgctggttatatgttcactgatgctgtgctttatcatgttcttggttagaaagcattttataaatttgtgaagtggttcatctctcttcgtttttcataccatttttcttgatct

SEQ ID NO: 66754 - DNA, 433 bp, Zea mays
  Clone ID: LIB3076-036-Q1-K1-H11
attttccaattgagttatgcagtcttgtgcctttacaaagatacactaaagctttgaacaggcttcataggtcatcaggcgtggagaaatctaggcagaaaccgcaggaaaggatgtctgttttatctgatgtgctgcaaagaagcaactatgatgcagagcccatgttgaaggcatgcgggattacaattgctagaaatttcacagaagttgatggtagggtattgcagccacctaagcttaaagctgggaatggtgaagacatttttacacgcaatggtagatggaacttcaacaataagaggctcattagagcttgtagtgtcgagaaatgggcggtggtaaacttttctgcacgatgcaatgtcagggatcttgtccgggatctcatcaagtgtggaggcatgaaaggcattatggttgatgctccttt

SEQ ID NO: 66755 - DNA, 383 bp, Zea mays
  Clone ID: LIB3076-036-Q1-K1-H12
aatatccgggccgacccacgcgtgcgggtaaacgcatgactcgttttaccatgcaatgcgggatcatgaacaacgctattctagaggcgaacgtagaaacagaagggggcactgaatcttggaagaatgccgttctaggtggacaacttattctcagctttcacccataagttccagtcccagatcttttctacggcagcaagaccaacacatcattacctccgctgcaacattaatctctgcttttgtttgtatcatactttggattttactacgcaaagagcgaagtctgcaatatgtaatatgttgtggaacagacatgaacggtaggatttttttggttggaatttgtggtgcgcatgttgctgatcataattatgata

SEQ ID NO: 66756 - DNA, 334 bp, Zea mays
  Clone ID: LIB3076-036-Q1-K1-H3
aaggaaatgcctgaagttgctcccatgagttcagagcctgaggttgagaagtggacatcgggtgagattgatagagccttagatttaacaaagtctggagtccctgtggaagatatgcagagcaaagtctgtttcaacaagcttgaagatgattcttctgcgactgcaggtccatgtctgactgggagttcaattgcagcttcatcctataatctgatcagacatcaaaaccaacgtagctctactgtgacatccaatcctgatggtcgctacgaaggtgcaccttcaaaagtcgtggatgcgccaaaatttgatgcggaaactctttctgtat

SEQ ID NO: 66757 - DNA, 466 bp, Zea mays
  Clone ID: LIB3076-036-Q1-K1-H6
attgcagtggcattcttcttcctgaacttcttttatgtgttcccaatagcatgggttcagtctcttgcaaatcttgaagggattgagaaggcagcgccatttctgaagcctctgattgaagagcatactattaaatcattcatccaaggtttccttccgggaattgctctgaagatcttccttatattgctcccaagcatattaatgtttatgtctaaggttgaaggattgacctcaatatcttcactggagagaagatctgcatcaaagtattatattttcatattcttcaatgtgtttctggcaagcattattgcaggatctgctttagagcagctaaaaagctatattcatcaagcagcaaatgaaataccaaggacgattggtgaagcaattccaatgaatgcaaccttttttataacatatccaatggttgaatggctggactggggtagctggtgagata

SEQ ID NO: 66758 - DNA, 295 bp, Zea mays
  Clone ID: LIB3076-036-Q1-K1-H9
agatcctgaggtctttttccttgcattttggcttcaactgccgaattgggaggggctttaagatgactgattgcacctgggatcatgtcattccttgctaccaacaaatgcaggaatgcagtttgcaagacggaaagaccaactctgggtaggtccaatccaaggcgttgtgtcatgataatgatatgaaagctgtctctgtaaatggaaaacccatttaccatttatgggacataacattaaccagacactgtgtcatgatgtcagtgttgcaaaatcaaccaaggcaccctta

SEQ ID NO: 66759 - DNA, 405 bp, Zea mays
  Clone ID: LIB3076-037-Q1-K1-A1
ggttttcagtttgattatgtctttgactggacaatattgaagtaccaacaagctcaaattgccactgctccaccccgtgcgggccatggcgctgggccttctgggttggcacctgcattacagaatgataggcaaccaggccctgaggaagcaaggactagtggttggtcatcaatggatcggcgtcgtgccccactaccaattacaagtgtggggacattatctaagcagaaagcaccggtagggaatgatgctattgtttctagagacgctgtgatatctggaccaaatttcttgggaaggtcaagtggatcttcaaggaggcctgttatctcgagtagccgcgatgcggtggtcaccgatagttccgagccttcacgagcgcgcacaactgatgcaagccct

SEQ ID NO: 66760 - DNA, 334 bp, Zea mays
  Clone ID: LIB3076-036-Q1-K1-E1
ccgatttgctccgccgagaacaacatggggagaagctataatcacagtccatcgccaccgagaggctacaggagaagaactcgcagcccaagtcctcgtggtcggtatggaggccgtgatactgatagggacctcccaactagtcttttggtgaggaatcttcgtcgggattgtaggcctgatgaccttcgtagaccatttggaaaatttggccccgttaaagacatatatctgccaaaggattactacactcggtaacctagaggatttgggttcatccaatactttgatcctgatgatgcttctgatgcaaagtactatatggatgggaaga

SEQ ID NO: 66761 - DNA, 222 bp, Zea mays
  Clone ID: LIB3076-037-Q1-K1-A10
ctacgctcacgccactcattcgtcgtgcctacgatatcctgtctccatggccgcaacgaggctcggccgtcttgatacgcatgaatgtgacactgctcaccaacttcatccattaccttctatactaaagatacttcaaactccttctggactgtaaccctatgcaaactaaatttcacaatatctgtaccaacacttgtacgagctgacaagttttgaaac

SEQ ID NO: 66762 - DNA, 456 bp, Zea mays
  Clone ID: LIB3076-036-Q1-K1-A8
gcgaccacgcgtcctaaaacgagctatcgtgcgagctctgaagtacgtagaaaatgggggttggcgacgatatccagcacatcggatgtgacatcggaactggtatggtcaacgctgactacgccggcaacgacgccttgaggaccatcttgcggagcatgctcgagagtgctctccacactggtatcatgcacaagaacgcgcacatggacgactacgtccatgacaagacgcatatcaagacgcttatgctgaccatcaagcaccgcatcgagcacggcatcgacaacatctagaacaacatgcataacatcttgtactacaagctctacaacgagctccacgtggatcccgaggagcacaccgaggtgctcatcgaagcgcacgttaacccgaaggataacacccagaacatggcccagatcatgatcgagacctttaacaacgtcgctatgt

SEQ ID NO: 66763 - DNA, 398 bp, Zea mays
  Clone ID: LIB3076-036-Q1-K1-B10
gggcccacgcgtccggggtcccccaacccagaacaaaaagaatgggtcgacgaccaagaaaacattattaagcggtgttgtggaccaatcaggtgccaactccgggctagaattgtcaggaaacgataaccctagctacaccaactcgagcagtgctgtgccagtgccacccgcaagcacccaaccagtcgagtctgctgccgctgctgtagacgttgattcggtcgagaaaggcccatgtacgacaccagaacagccggcgaagcgaatagcgaccaacgttcgacgaggacggataatggtgttgcgaatcgcaacgagagaatgaagagcgacgtatgggggggatattgttgctggatactaaatattaacggcccaaattaaatgggggccct

SEQ ID NO: 66764 - DNA, 391 bp, Zea mays
  Clone ID: LIB3076-036-Q1-K1-B11
gcggtgctgggcttgcagatatcaacccgctggaagctgtcgctggaaaatgcactgttatatgtactggaaaggataagaggaatcgtgaaccatcccctcaggaactacaaattgctgattatatcttctatagggtctttgatgttaaaagtctaacactttctgatcagttaccagataaaattgctgcatttacagttgatcttcttctgaatccaaaagatgagctagtcatacctgcaaatgttctggtgaatccaaatgtggatgacggtatggttgccacagttcctacacccccttcagcagttaaattggaggatcgaagtcacgctgctgcactttcccttacgcagacaggccatgtggatgaaaatctgtctggcac

SEQ ID NO: 66765 - DNA, 64 bp, Zea mays
  Clone ID: LIB3076-036-Q1-K1-B12
gcggtatcggcaccgttcttccccgcttctccagtccagctcaccagccgcccccacaataatg

SEQ ID NO: 66766 - DNA, 257 bp, Zea mays
  Clone ID: LIB3076-036-Q1-K1-B2
cccacgcgtccgcccacgcgtccggaaagcccatcaaaacatcaatactggtcaccgtcagatatgagataacatttcttgggaggctatcagtgaaaaattaaccactcgtagagcccaagaatgctgcacgaaatggtacgggcaattggcatcgccgctggttaaacaaggaatctgagcagatacagatgactacatgttagtggaagcgcttcaaaatgtcgatgctgtttgtgctgaagatgttgactggg

SEQ ID NO: 66767 - DNA, 338 bp, Zea mays
  Clone ID: LIB3076-036-Q1-K1-B4
cggacgcgtggggcatttcccttgctaaaaaaaaatgcatggatgtactagataaaccgtggcagagtggcagcagggacaagaacattgcggatctacactaaacatgatctagtctaactgcacggacgctaatggtaatattgatctaagacaggagatcactctacgccttcttgggggacttggcggccttcttgggctccttggccgccttctaggccaccttcttggtgaggagcacagtgtggatgttggggaggacgccgtcgtgggcgatggtgacgccggtcagcaacttgccgagctcctcgtcggtgcgaatggcgaggaacacg

SEQ ID NO: 66768 - DNA, 317 bp, Zea mays
  Clone ID: LIB3076-036-Q1-K1-B5
cccacgcgtccgcccactcgtccggccagtccttctgacaaactgtaactttgcagccacgtacatgtggtatctgctgaatccacgttgggatgcaacaatccatgtcgaaaatgtccctgacttctaatgcgacaaactcttgttactgtcctgttctcaaacagcttgcgtctgctgtcatcagagactattatctcaatgctgatcgtacgaaaacactctctgatggttcttctactctaaagtatcgcaacccagaatatttgctcacgctcaattatctaacattttacctctcactagtatatgctaag

SEQ ID NO: 66769 - DNA, 460 bp, Zea mays
  Clone ID: LIB3076-036-Q1-K1-B8
cccacgcgtccgcccacgcgtccgcccacgcgtccgcccacgcgtccgcggacgcgtgggggtaggtcacctatgtgaccaatcctcaccattggtttcacagcacttagtaagcatacgtttgaagaccgagttggttgatttggtctgtccattcgctctaggaggggctcgacttcctttgagctatgagaaatgggagcgccttcttcttttttttcagggatctccttggctacaaagagagctatggagcctagctgaaagcttgacaaggcctatttaagtgaattcggccacccaacaatcgcagaaagaaaggggcattcaaaaccttgcagggattccttctcctaaggttgctctgaagtaaccgctcgtcttgatgctggcagtcaagaaggcaaagagttgacttctacttttgaaagtgtaggagttgaccttccttcgcctatct

SEQ ID NO: 66770 - DNA, 211 bp, Zea mays
  Clone ID: LIB3076-036-Q1-K1-C2
aagcaagctgaggtagatcctctggttagtgcttgtggaagcattcatgatcgatatgcggatatgtggaaacatctaatggaaaggatggagcaattagcacagattggttctgcaacaggtatatataatacatttgttaggtatttggtctgtgttccacatgattcattgaattttagtcgacaaatatatgatcataatgggccta

SEQ ID NO: 66771 - DNA, 107 bp, Zea mays
  Clone ID: LIB3076-036-Q1-K1-C4
tccactcctgcgcccactcctcctgccactccttctttcaaactgaactatccacccacggacatgtgataacttctgaatcgcaccgtatcattcaacaatccatc

SEQ ID NO: 66772 - DNA, 313 bp, Zea mays
  Clone ID: LIB3076-036-Q1-K1-C6
ggcgacggttgcatcacaaccaaggagcttggaactgtcatgcgttcactgggtcagaagccaacggttgctgaactccaggacatgatcaatgaggtggatgccgacggcaatggcacgatcgacttccccgagttcctcaacctcatggcccgcaagatgaaggacaccgactccgaggaggagctcaaggaggcgttcagggtgttcgacaaggaccagaacggcttcatctctgccgcggagctccgccacgtgatgaccaacctaggcgagaagctgaccgacgaggaggtcgacgagatgatccgcg

SEQ ID NO: 66773 - DNA, 256 bp, Zea mays
  Clone ID: LIB3076-036-Q1-K1-C9
gcgtctacctttacaacccctcatacgtaccaacttaggtttacaattatgctttcaacaaaaccttcagtgaattcttaaacccttttgcgtcatcacacttcactacacattgtcagcttcaatttatctcaattctttccgttactactacattgaaccattatataacttcttatactacgaacaccaacaatattatactatattttaaacttgtattcatatcaaattactcttcttcataattcttccc

SEQ ID NO: 66774 - DNA, 298 bp, Zea mays
  Clone ID: LIB3076-036-Q1-K1-D10
ccccatataagtttcaactgaggttacaatcattttttcaacaaaaccttcaagtagtactttaaccgcgtttgcgtcatcacacttcactacacaattttatttataatttacgtcaattcttttctgttcctgctacaatgaatgaatatttaactgcttatatttttaagaccaataatatcatactatatgttaaacttgtattcatatcatatgactttcacttataatttttcccaaaatatttaatccttgttaaatgtcttttttactcaaaatacctttcattgaattt

SEQ ID NO: 66775 - DNA, 302 bp, Zea mays
  Clone ID: LIB3076-036-Q1-K1-D11
tctttgttctttaggaatcaattttattgtaaaaatatctttatttttaactatatcactgtaactattaacttctcctctaactttatctctgtcttaaagtcccaccacccactcctcactacttttgtcaaactgccaaatctactctgtacttatcttagattaaatagtgcgcatctattagtctctatacaaggtgctgtttgcactttgtacttcatatttggctctttggccgttgcaatatgctgagcttcacattcctagcacttaccacctttaattacaatcatcataaa

SEQ ID NO: 66776 - DNA, 152 bp, Zea mays
  Clone ID: LIB3076-036-Q1-K1-D12
gcgtccacacttccaacccctaacaagtcccaactcaggtttacactcatcattccaaccaaaggtacaggttgttcttttaccctgtggcgtcatcacactttactacacacattgacgtcgaacttatgtacaacattattcgtcctcct

SEQ ID NO: 66777 - DNA, 58 bp, Zea mays
  Clone ID: LIB3076-036-Q1-K1-D2
aaccaacctgagctcactcctccgtttagccctagttttaaccttaactatccatctg

SEQ ID NO: 66778 - DNA, 210 bp, Zea mays
  Clone ID: LIB3076-036-Q1-K1-D5
agccaaaccgagcggactcctccatggatcgctagtggggctccaagcccggcagctgcggcgccgtctacacacataatgagaccatcgacccgctgtagcgccttcgccgactggccctgtataccatcgaccttatcgaggacccctattttatgcgcatccacctcatcagctactagtgcaagctgtgcctgacactgtacaaca

SEQ ID NO: 66779 - DNA, 481 bp, Zea mays
  Clone ID: LIB3076-036-Q1-K1-A3
acgcgtccgctcgcgcatcgtctccggagcgcacgtcatatcaggtgtgccgcgcccccctcgcctaagctgcgacgaccatccatcgaacaggaaggatgacgggctccatggatctcccggccaagggcgggttcagcttcgacctgtgccgccggaacaacatgctggagaagaacggactcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctgtggagcaggaactgctgcggacacggaggccgttacagatatggtgagctcccagctacagcttcaccgttatgcaacgggccgcgaatcaagagttgtaactgctcttacactactgaagtcacacctcttcaagta

SEQ ID NO: 66780 - DNA, 288 bp, Zea mays
  Clone ID: LIB3076-036-Q1-K1-D6
gcaacggtggtaaccgcagcaggggcggcgcgaggttcgagctgcagctgcacgtgtcggcgccgccgcccgtggctaggagggtggaggtggacggcggaggcgacggcagcgactcgtcgtcgtccccgagctcgtgcgtgtcgtcggacggcagtccagggagcaagtcgccgatggtgatcggcgcctgcacgcggtgcatgatgtactgcatggtggccaagaaggacttccccacctgcatcaactgcaagcagtcctgcctcgtggacctgcttcactgct

SEQ ID NO: 66781 - DNA, 72 bp, Zea mays
  Clone ID: LIB3076-036-Q1-K1-D7
gacccacgcattcgctgacgcgtgggtcaacttcctgaatattgttctttgcataaagcagtggaagaggtt

SEQ ID NO: 66782 - DNA, 370 bp, Zea mays
  Clone ID: LIB3076-036-Q1-K1-D8
caaggatagatataaggtacatttcttccatttgccatactgggtcattatttggcgtggacgcgcatgagagctgcgcatcattaaattaagagaagaaaacagtccaaaatggaccaaagtacaatgccaaaatatgcaaaacacaagaccatcaattcctgctgcgcacagaactacagcctccttctgcgcatgaaaacaacagtacgcaaaataagaacaacagcataaagtgccagcagaccacacacacaactgctcttcactaatcacccaacagaacccttgacctaaaaattgcagcaccaggacccataacctcaagatgtctagcactgggtcattattctctgttgcaattatgttc

SEQ ID NO: 66783 - DNA, 269 bp, Zea mays
  Clone ID: LIB3076-036-Q1-K1-D9
tcgacccacgcgtgacgctttctgccacaccgaaaaccctatccttcttcaccttatcaacctgccaagtaagcactatcatcgagccctcctccgccaggaagcgcaatccccgcgtcactatctcccacctgaagtaccacatggcgcactttaccgcccctccctccgtccgccaccttctcatgtccatattgctgtcgactgaactccaacacaattacaacttgcgctccattccgatcccaaatgacgacaaggtgcatgtc

SEQ ID NO: 66784 - DNA, 368 bp, Zea mays
  Clone ID: LIB3076-035-Q1-K1-G2
cttctgcttgttctatgttatggctgagctctggggcagcgtcgtcatctctgtgctcttgtgggggttcgctaatcagattaccacagttgatgaagcaaaggaattctacccgttatttggccttggggctaatattgctcttatcttttctgggcgtactgtgaagtatttctcaaatttgcgcaagacattgggtccaggaattgatggctgggaagtatctttgaaaggaatgatgagcatagtggtactccttggacttgtcataacttccatctatttgggagtgaacaagtttgttttgaatgatccttcacttccaaaggctgatcgtaagaagaaaaagggaaagccctaacttggca

SEQ ID NO: 66785 - DNA, 438 bp, Zea mays
  unsure at all n locations
  Clone ID: LIB3076-035-Q1-K1-G4
ctctgtgtcataaggtgcttggtcaacaagtggtttttgattgctggtggtggtgctccagaaatagagatgtcaatgcaggtggctgcttgnncaaaggagcttcgagggatggagagttactgcattaaggagtttgctgacgcacttgaggtcatcccttacacactggctgagaatgctgggctcaacccaatctccattgtcaccgaactcaggaatcgccacgccagaggtgagaagaacactggcatcaatgtgaggaaagggcagatcacaaacatcttggaggagaatgtcgtgcagcctttgctggtgagcacaagtgccattacgctggcctgcgagtgtgtcaggatgatcttgaagattgatgacattgtcactgttaggtgagagcatgaagtcngtggtttggtcggattgctctgttctgtc

SEQ ID NO: 66786 - DNA, 381 bp, Zea mays
  unsure at all n locations
  Clone ID: LIB3076-035-Q1-K1-G5
gcggttgggtatgctctcaagctctgaagatggcatgaccgttgaagaatatgaancaagattgacttagtttgcccaggctgaggaatttattgatgagacaagcattgatgctctagcagtttgcattggaaatgttcatggaaaatatccacctagtggaccaaaccttaaatttgacttgctaaaggaccttcgtgcattaacattaaagaaaggagttagcttggttctccatggagcatctggtctatctcatgagctcgtaaaagagtgcatagacttgggcgtgagaaaattcaatgtgaacactgaggttcggaacaactacctggcgttcctcataaagccagaaaaggacttgattcatgtgattgcgtc

SEQ ID NO: 66787 - DNA, 432 bp, Zea mays
  unsure at all n locations
  Clone ID: LIB3076-035-Q1-K1-G7
ccggnnttgaatacccgggccggccgacgcgtacgcacagattgaaaaattaaaggttagaatagacatgattgggagtgcatgccaaactgctagtaaagttattgcagagggccgtgagagctatgggctgggaagccgtcatgggacaaatcttggtcctacattggacaaagcacaagctgcaaagatacaggagcaggaaggcctacttagagcagcagtaaattatggtgaaggattacgggtacctggagatcagaggcatccacaatctcttcctatccatctgatagaagtgcttcctttaggagacggtgcacaaaattttggtgatagttctggtagttatcccaaaaatatgtcaacatttgcacctaatagtgtcaacagccagggaaatcagattcaggcatccggaagacagttact

SEQ ID NO: 66788 - DNA, 404 bp, Zea mays
  Clone ID: LIB3076-035-Q1-K1-H11
cctgaacttcactgttatcggagacagtatggacatgtgtggacatggtcactgggtaaggagcaatgggaagatcgtccacatcaatcgggtaactggtgaagcacaagcacgtagtgaaggtgtagcggaagtaatcttcaaaggttcaaattttaagctgcaaacaactatcactgttctcaaggtgaaccagatagttgttgatgctcctgcggagacactgactaatgcagctggcctgccggatggatacatgttttctgtgagatttagtgattcaattgagcacagtattggatcctctgcgagcccaattaatgtcccctttgaatgcaaagttgacccttcttttgttgggtttgttgagccatggactgagcatgccacaaaaaaatcctact

SEQ ID NO: 66789 - DNA, 395 bp, Zea mays
  Clone ID: LIB3076-035-Q1-K1-H12
gtgaggtgtactccagtagtagacaatgcactctatgttccttggatcttcaacagttcaactagggatgaaggtcgtccacatcaatcaaactactgatgaaacacaagctcgtattgaaggtgtatcagaagtaatcttcaaaggttcaaattttaagctgcaaacaactatcactgttctcaaggtgaaccagatagttgttgatgctcctgcggagacactgactaatgcaactggcctgccggatggatacatgttttctgtgaaaattaaggattcaattgagcacaatattggatcctctgcgaacccaattaatgtcccctttgaatgcaaggttgacccttcttttgttgggtttgttgagccatggactgagcatgccacaaaaa

SEQ ID NO: 66790 - DNA, 280 bp, Zea mays
  Clone ID: LIB3076-035-Q1-K1-H3
cccacgcgtccgagcagagttacaaaacatgtcgatcatccatacatccatagctgtaggcgaggggtccgtcaatgccgcgcgcagcaagaatcgcgtcttggcaaccatgatcaagcgctgcacggacgggagcgccttcaccaaatgcgatgcctgcaacaaagacgtccaagacctcctaatacacatgcacactttcaaccgtcaagaaaagatcaggatgacgctcgaagcgcatgtagtacaaaagaccgaccatgtacccagtgctgaccga

SEQ ID NO: 66791 - DNA, 435 bp, Zea mays
  Clone ID: LIB3076-035-Q1-K1-H4
gcgattctcacagagaaaggcctcgagagcgtgtcctagttgcggtactggatggccgtgtcaggatggggaggccgacgacgtgaacgaacctggggaggaggagctagcctcgccagctaaccatccctcggggaagaagcgcaggagagtcaaagctgagctggtggaggaaaacgacatcgcaggcccgtcgacggaggtgcctaggactaggaggaccctgagaagcgctaaagccgaagcagtcgaggccgatcaagaggcgtcgtccaccgcagcttcgcagccaggcaggggttctaaaacaaggaagaagtgagtgatgactgatgatgcatgcttataaaggagggagattgcaaatgctcctcctttgccatgtgtagatactaccgtagacgtgctggtatggtatccggtgggtagtttttc

SEQ ID NO: 66792 - DNA, 332 bp, Zea mays
  unsure at all n locations
  Clone ID: LIB3076-035-Q1-K1-H5
nctggnnttnnnttnnnttnnaaacagtatttacatgtgtggacatnnnnnnnggggnagggtnnttttgaagatcgtccacatcaatcgggtaactggtgaagcacaagcacgtagtgaaggtgtagcggaagtaatcttcaaaggttcaaattttaagctgcaaacaactatcactgttctcaaggtgaaccagatagttgttgatgctcctgcggagacactgactaatgcaactggcctgccggatggatacaagttttctgtgagatttagtgattcaattgagcacagtattggatcctctgcgagcccaattaatgtcccctttg

SEQ ID NO: 66793 - DNA, 418 bp, Zea mays
  Clone ID: LIB3076-035-Q1-K1-H6
cggattcccgggcagagatgtccaagatggcggaggagaaggcggcggcagtgggcggactcggaggagccggggcggcggacgcggcgcagcagcagcagctggcagcaggggaggccgcggcggcgcgggtgcggcccgtggagacgctgcttcgcgcggcaccgctggggctctgcgtggccgccatgaccgtcatgctccgtaaccagcagagcaacgagtacggcgccgtcgcctactccgacctgggaggcttcaagtacctcgtctacgccaacggcctctgcgctgcctactcgctggtatccgcgttctacactgccgtgccgaggcctgccaccgtgtcgcgctcctggctcgtcttcctcctcgaccaggtgttcacgtacctgatcctggcggcgggcgcaacggc

SEQ ID NO: 66794 - DNA, 254 bp, Zea mays
  unsure at all n locations
  Clone ID: LIB3076-035-Q1-K1-H7
gaattcccgggcagaggtgtccaagatggcggagganaangcggctgcagtgtgctttctctgaggagccgtttcttctgacgcggcgcagcttcttcagctggcgggaggggaagccgcttcttctctttttctgcccgtggatactcttcttctcgcggcaccgcttgggctcttcgttgcccccattacccttattcttccttaccaacataacaaccaattccgggccctcgccttcttcgaccttggaa

SEQ ID NO: 66795 - DNA, 383 bp, Zea mays
  Clone ID: LIB3076-035-Q1-K1-H8
gtcacggactcgcgtccacaaaccacaaccagctcactcaagaacaaagaacccaacccagggcttctcccaagccgctcctcctgctcgccacctcgttcctgagctgcggcctcctggtggccgccgactacgccccaatgaccctgaccgtggtgaacaactgcccctacccggtgtggccgggcatccaggccaactccgggcacgacgtcctggagggcggcggcttcttcctcccgccgctctcccacaagtccttcccggcgccggcccacccctggtccggccgcatctgggcgcgcacgggctgcgcgggcgccggcgcgcagctccactgcgccacgggcgactgcggcgggcggctccagtgcggcgggctc

SEQ ID NO: 66796 - DNA, 314 bp, Zea mays
  Clone ID: LIB3076-036-Q1-K1-A10
acgattttccaattgagttatgcagtcttgtgcctttacaaagatacactaaagctttgaacacgcttcggaggtcatcactcgtggagaaatctatgcagaaaccgcaggaaaggatgtctgttttatctgatgtgctgcaaagaagcaactatgatgcagagcccatgttgaaggcatgcgggattacaattgctagaaatttcacagaagttgatggtagggtattgcagccacctaagcttaaagctgggaatggtgaagacatttttacacgcaatggtagatggaacttcaacaataagaggctcatt

SEQ ID NO: 66797 - DNA, 426 bp, Zea mays
  Clone ID: LIB3076-036-Q1-K1-A11
cggacgcgtgggctcgggcgcagcaattcgtcgagcatccgccgcgctcgacggccaccggcccacgagggcaccatggcgtccgccacgcgtgctctgggggcgctcctccacagggcctcgtctctgtcttcctccgctcccgctctccggggagcctcgctcctccgcggggacgggcctattggaagcgccggactgttccggaggcatgcggcgaggcggcggatttcgtcgttccagccgctctgcatgggaagacgctcctgcaaaatcgctggaaggaagggaggcaatcctttggatttcaaaatgtagttgatctaattcatgcatatgctgccaaagctgttactgaacaactagaccaaaatgagaaccttgtatcagtcaatgcagatgtctgccaattctgggaaaagatgt

SEQ ID NO: 66798 - DNA, 346 bp, Zea mays
  Clone ID: LIB3076-036-Q1-K1-A12
gcgcccacgcgtccgcccacgcgtccgccccactctcgcttcgatgagggacgcggtggtggtgatggcgttgcccggagccggaggcgggggcggaggatcggcctcgtcggcggcggcggcagcggcgccgtgcgcggcctgcaagctgctgcggcgccggtgcgcggccggctgcgtcttcgcgccctacttcccgcccggggagccgcacaagttcgccaacgtgcacaaggtcttcggggccagcaatgtcagcaagctgctccaggagatcccggcgcagcaccgatgggacgcggtgagcagcctggtgtacgaggccaacgcgcgcgtcatggacccg

SEQ ID NO: 66799 - DNA, 345 bp, Zea mays
  Clone ID: LIB3076-036-Q1-K1-A2
cccacgcgtccgagaaagaggacaccctggctcattgtgttgttgcacgtaccatggtacagtagcaattgggctcatcagggtgaaggcgacagtatgatggcttcaatggagcctttgctgtacgctgctcatgtggatatggtaatagcaggtcatgtccatgcttatgaacgtgcggagcgagtctacaattccagacctgatccttgtggcgctgtccacataactatcggcgacggtgggaaccgtgaaggcttggcccgcaggtaccgtaacccgaagccagcgtggtcggtcttcagggaagcgagctttgggcacggcgagctaaagatcgtgaac

SEQ ID NO: 66800 - DNA, 419 bp, Zea mays
  unsure at all n locations
  Clone ID: LIB3076-035-Q1-K1-G12
ctgtgatcgttgataggagttcatatggggtagttttaaggatagatttcaatgtgagctgtcctgcgctntcatgtgaatttgcatcagttgatgttagtgacgtgctgggaacaaacagattgaacataacgaanactgttcgaaagtattcaattgatcggaatttagtaccaactggatcagaattccaccctgggcctatccccattctcaataagcatggagatgatgtcgaagaggatcacgtggatggtgcattttcattgtcatctcgcaattttgatagcttttcacaccaatatcctgttttggttgtcaacttctatgctccctggtgttactggagcaatcgactgaaaccctcatgggagaagacagcaaaaataatgagggagagatatgaccctgaaatggat

SEQ ID NO: 66801 - DNA, 455 bp, Zea mays
  unsure at all n locations
  Clone ID: LIB3076-035-Q1-K1-D4
cggacgcgtgggcaaggtctagatattcacctcaactccagggtcacaaagatcatacaacggctataacaaggttattgtctgtgtggaagatggggcgagttttgtcgcagacgctgctatagtaaccgtccctctcggngtactcaaggcanacatcatcaagtttgagcctgagctaccgaaagagaagctctcggcaatcgccgaccttggcgtcggtatcgagaacaagatagctctcaagttcgacactgtgtttntggcccgacgttgaagtgataggtaggggtggccccgacgtcaaacgcctgtggctactttctcaaccttaacaaagccacaggaaaacccgtccttgtgtgcatgggtggcccgaaggttcgcgtacgagatcgagaagctgtcggacgaaaagtccgtgaacttcgtcatgtnccaactcangaacatgc

SEQ ID NO: 66802 - DNA, 421 bp, Zea mays
  Clone ID: LIB3076-035-Q1-K1-D6
ccttaagggattttttggattgtttatggtccaaatgcagcaacttcggaaaaaattcagagtcgtggattttacctatggatttgggacagctaatactgcacttatatatcatcatggtaaactcatggccttgtcagaagcagataagccatatgttgttaaggtccttgaagatggagacttgcagactcttggcttgttggattatgacaaaaggttgaaacattcttttactgcccatccaaaggttgacccttttacagatgaaatgttcacattcggatattcacatgaacctccatactgtacataccgtgtgattaacaaagaaagagctatgcttgatcctgtgccaataacaataccggaatctgtaatgatgcatgattttgccatcacagagaattactctattttt

SEQ ID NO: 66803 - DNA, 452 bp, Zea mays
  Clone ID: LIB3076-035-Q1-K1-D7
aggtgccaaccaagctggtgatgcttagaaaaaggaagatgctactgtcccctcggagagggtgacctccaagaggaggaaaaagaatgacaagagttcaaaggagggaagaaaagaaacacaagaagcagccgatgggtcataggagactgccagtgcatgacctgatgaagaagataccactgctgtggacgtgaaggagcgtttgaagaagatggcttcaatgaagaagaagagatcgagcaaagagactgacaccggtgccaaaatcgccgctgccgatgccacatcaaggagcgcaaggcttgcggcggccaacaagaaagataatagtcattacaaccagcatcctgtgcggtaaatgggcataaagttttggatttgggtgctctgaattttatatttccttgtagttggactcacaataatacttttttgatctgtcgtattta

SEQ ID NO: 66804 - DNA, 305 bp, Zea mays
  Clone ID: LIB3076-035-Q1-K1-D9
aattcccgttcgcgagcattcaacctttttttttttttttcccattaaattttaattttcttttcgaatttacttccccggttagtgtttatttttaaatagaccaagccccccaattctcctttttttttatcctcttttcattatcaatacaattttttttttattctttttctcctcaccatataaaattattattttctttaccatatttatttactactattcttttttatataaaattatttcttttatattttttatcatttaatataatcttcctacaacaattcattctaattttt

SEQ ID NO: 66805 - DNA, 454 bp, Zea mays
  Clone ID: LIB3076-035-Q1-K1-E1
cggacgcgtgggtggctgagcgcattgtaggtcaaggttcttttgggattgtcttccaggctaagtgtttggagacgggtgagactgttgccataaagaaggttcttcaggataagcgttacaagaaccgtgagttgcagaccatgcgccttcttgaccaccctaatgttgttgctttgaagcattgcttcttttcaactactgagaaggatgagctttatctgaacttggtccttgagtatgtgccggagacagttcatcgagttgtgaagcatcacaacaagatgaaccaacgcatgccacttatttatgtgaagctgtatatgtaccagatatgtagggcattggcttacattcatggcactattggtgtctgccacagagatattaagccacaaaaccttctggtgaacccacacacccaccagcttaaactatgtgactttggcagtgc

SEQ ID NO: 66806 - DNA, 457 bp, Zea mays
  Clone ID: LIB3076-035-Q1-K1-E2
cccacgcgtccgatccctgaaaacctcacaaaaccctcgctcgctccccaccaccccgccgcgccggcgcctgtaccagctgcgtcaagatgagtcggcaccctgaggtgaagtgggctcagaggatcgacaaggtttacatcactgtacagttacctgacgcaaaggatgctaaggtcaatttggatccagatggtgtcttcacattctctggcagtgctggtacaaacttgtatgaattgaaactagatctgaatgacaaagtaaacgttgaggctagcaaaataagtgtgggggtcaggtccatattctgtatcgtagaaaaagctgaagccaaatggtggaagaaactcgttcgagatgatcaaagggcacctcactttgtgaaagttgattgggacaaatgggttgatgaagatgatgatggtgctgatatcaacatggatgggatggactt

SEQ ID NO: 66807 - DNA, 393 bp, Zea mays
  unsure at all n locations
  Clone ID: LIB3076-035-Q1-K1-E4
caanacagatgaagtgaagctgaacacctgccactgaaaagcaggtcaagttgagagagtcgtttcangtaaaggaaaggaaaacaganggaaagacatcgtgagaaactcatacaaaacagaacttgcaaggcaaattttgctcagtttcattgtgaagtcagtgcatgacagtttaggttccgcccaagctgaaccagagaggaagccaagtggatcagatgaagctagtaataaacagagcagcaacttagtcaagaatgcttctggtcgcaaagattcagataaacaagagaaatccatggaggttcccaagggcctgaaggatacagagggatttacagtcgtttcaaaacgtcgaaggcggccccagccattcatgaaccccataaa

SEQ ID NO: 66808 - DNA, 433 bp, Zea mays
  Clone ID: LIB3076-035-Q1-K1-E7
gcgaccggctagcgccatatcccgcgccgccgccgccgccgccaacgcttaatgcgtagtggtcctccggcgaggcctgttgctcgtccggcagcccaccacccgcgtccttgccaaaccgtctctccgccctgcttgtctcttcgtccaccacttcgccgtcgacacgatgggtgagggttctgctgctggtaaggacgcgaaggggaaggggaaggggaagaccaaggccgccgccgcggattcggccctggtcgttcgcgacgactcctacctagaggcggtcactcagaagaggattcgcttcttcgaggagatccaggcaaggcaagccgtcgagcggctgaatatcggcggcgaagttatcaaggtaactttgcctgatggcgctatcaaggaggggtagaaatggataacaaccccaatggatatt

SEQ ID NO: 66809 - DNA, 404 bp, Zea mays
  Clone ID: LIB3076-035-Q1-K1-E9
gggacaaaggacattttatcaaatcccaagtaacagctgccacaggtgcaatagcgcttaggcagttgcaagatgacgggacgaagtatatgagtgctgagggccagtacacagaggaggaacttgaaatgtacatggaaaaccataagaaagtcatggttgattctctgtggaagcttaacgttgctgacatagaagccacattatcccatgtctgtcaaatggtacttcaagacagtagtgccagaaaggaggaattgcgcctccgtgctaaaggcttaaaaactttaggaagaattttccagggggctaaggtcaaccctagcgagggggaaacatcacaaacgaagaatatagacaacatggatggcaatgacggcagcttccctgactcgttcccaaat

SEQ ID NO: 66810 - DNA, 350 bp, Zea mays
  Clone ID: LIB3076-035-Q1-K1-F12
acgtcaagcccgcgttcacggctgttttcttcaacgtccactaccattactccaccgggggtgtgtgcccctaggcgtcggcgccgccctctctttaatagacccccctcaccctcaccttctctacctcccgtacatcctcatcctaaagaacctcgatggcacccctgaccatactgatctcatgcctggcctcatctttgacaaaaaggctagccatgctactgggggcccaactcaaatggagaatgctaaaatcgctgtcatacaactacaaatctgaccacccaatactgacattgaccagagagtcattttattcgactactcacacatggaccgcattctac

SEQ ID NO: 66811 - DNA, 369 bp, Zea mays
  unsure at all n locations
  Clone ID: LIB3076-035-Q1-K1-F2
attcccggtgtcgatcccacgtcgtctcgtcccacgtnnngtccggagaaagaaggannttgattctnatcgttcatttagcaataagaaaagggtctggcttcaggtgacgagatcatacatatccattccaacaatgttgggtacccatgataatcnncagggtggnngggtggggacctannggcttnnacttagtacccagtagcacaaaaaattaaagagggttctgcataaggtaaatagcnntttgtttcttaaccatttcannttcattccattatnntactgattgagaagaaacatgaaacgacgtgaattattgcaatccaagggcagaatggatggggatggatggagaatgaacta

SEQ ID NO: 66812 - DNA, 297 bp, Zea mays
  Clone ID: LIB3076-035-Q1-K1-F3
tacatgataatccacgttgggggtggcgactatgctaacttagtacattatcacaaaattaaaaaggttctgcataagtaatagctttgtttcttaccatttcattcattccattattactgattgaaagacatgaaacgactcaaattcaatccaatgcatattgattgatggattgatattactaccgaaaaaaaaggttcactccgatctggcggcttatctttccacctttgtgtccttttattttattcctaccattttcttccctatccctcttcttacttcaaccaatat

SEQ ID NO: 66813 - DNA, 428 bp, Zea mays
  unsure at all n locations
  Clone ID: LIB3076-035-Q1-K1-F4
gatcgcgggccgccctttttttttttttttttttttttttttttttttttttttttnggggaacaaataaatgcatctttccagcggggaaaagtcttcctgtatacagccatttcacagccaggctctcattatcatcttcttgggactcatatggaggaaagaatagacactccaaactaaaagttttgaaacacactatcagcctctaaacccccataagaaaataatctcaaaattgacgtctcggctttgactccgcagccgtgactcggatctgtctaccatccaagtcgatgccatcgaggtttgatatggcattgttgacctcttgggcggagccataggtgacgaaaccaaacccccttgacctgccgctatccctgtcgtagatgaccttagcatcaagcacttgcccttgctcactg

SEQ ID NO: 66814 - DNA, 446 bp, Zea mays
  Clone ID: LIB3076-035-Q1-K1-G10
ctcggccgagctcagcgcggaagacaaggctaaccttgtggcgtcgatcaaaagcgcgcggggagggattggcgtcggggcataccgacgtgctcgagaacctcgagcccaaggtcaggaagcgcgttgagaagctcagggagatccagggcgaacacgatgaacttgaggcgaagtttttcgaagagagagctgctctagaagctaagtatcagaagttgtatgaaccactttactcaaagcgttatgaaattgtcaatggtgtggtcgagattgagggtatcacaaaagaaagtgcagctgaaaccccagaggagcaaaaaagtggagatgagacctctgctgagcaaaaagaagaaaaaggtgtaccagctttctggcttaatgcaatgaagaatcatgaaattttagctgaggagatccaggaaagggatgaggaagctctc

SEQ ID NO: 66815 - DNA, 404 bp, Zea mays
  Clone ID: LIB3076-035-Q1-K1-D3
gtgtcaatggagatgcttgtggatttgagcagtctaatttgggcaaaaggggtagagatgagccatgttcatctggtctaaaatccaaagcttgccgtgaaaaaatgaggagggacaagctgaatgacaggttcctggaattaagtgcggttatgaatcctggtaaacaagcaaagttggataaagccaatatcttgagcgacgcagcccgtatggtggcacaacttagaggtgaggcagaaaagcttaaagaatcaaatgagaagctgcgggagaatatcaaggacctgaaggaggagaagaatgagctccgcgaagagaaagtgaggctgaaggtagagaaagataagctggagcagcaagtcaaagccatgagtgtagctcctacaggatatgttccccat

SEQ ID NO: 66816 - DNA, 406 bp, Zea mays
  unsure at all n locations
  Clone ID: LIB3076-035-Q1-K1-A3
cgcgtacgctactgcattcacggcaagttatggccagtcatggatgtttgtcgtccacacgccctccaggaacacgagagcgatgtgcgtgctggagtgcnnttttaagaggaagagcgcaagcacatgcggcattgcttgcagaataccatccagtgggtgaaacgcaagtccacccacgcgttcgcaaccgtccgtggcagccagctaggagaacgggggaacctaattaacagcagtcgcgtcggcagcccgcggcgacatgaaaatgaaaaaaaaaacacatccatctgtagctacgcgtaaaaactgatctactggacgctttgactaatgctagtgtaatgtaggtgtagtagccgtgtaggaaaagaaatgcagtccatcttgcatctggtgtgtacgt

SEQ ID NO: 66817 - DNA, 173 bp, Zea mays
  unsure at all n locations
  Clone ID: LIB3076-035-Q1-K1-A4
caaactcagctatagctatttgtgagggaaggacaccagcgcatggtcacgtcaacttctaccgcaactatnntaaaacnttcaataaaccaatgctttcttattataaatatcctctttatgcttaacttaagctttttggtgaatattttcttatgttcaatccttaactt

SEQ ID NO: 66818 - DNA, 361 bp, Zea mays
  unsure at all n locations
  Clone ID: LIB3076-035-Q1-K1-A6
cccacgcgtncggcccgacgctctcaccgctgtcaccaaaatcgcacgcgagccccaagagatccccaaaccctacacctgcgcgccggcgcactctgggaccgtcgaatcgagcaggttgacggaggagagggagcctcgaagatgttccggaaccagtacgacaccgacgtgacgacatggagcccccaggggcggctgttccaggtggagtacgccatggaggccgtcaagcagggctccgcctgcgtcgggctccggtcgagcacccacgccgtcttagccgccgtcaacaagcccgcctccgagctctcctcctaccagcggaaggtgttccgcgtcgctgaccacgccggggtcg

SEQ ID NO: 66819 - DNA, 258 bp, Zea mays
  unsure at all n locations
  Clone ID: LIB3076-035-Q1-K1-A7
gtcgtttcgccttctccttctacaccgactgcctccctcagcgagcggtttcantttcagagaggcgtgctagatnctatcnccagatcaataacaagccgtaccctaagtccagttactgccgtggtgtccctgaccccaagatcaggatctaccatgtctggatgaagaggaaaggttgttattacttcccctactgtgttcaccttgtttttttggaaaatgaaaatgtttccattttttctcctcaatcttccc

SEQ ID NO: 66820 - DNA, 63 bp, Zea mays
  Clone ID: LIB3076-035-Q1-K1-B10
cccacgcgtccgaaaaaataaaaaaaaaattttaaaaaaaaaaaaaaaaaaaaaaggaaaagg

SEQ ID NO: 66821 - DNA, 410 bp, Zea mays
  Clone ID: LIB3076-035-Q1-K1-B12
cccacgcgtccgcccactcgtccgtttacgcttgggctcagccaagctcgtgagagcagaggtactctcttggggaggcaccaaagcatcagtggcaaagctgcgctagaggccatcaggccataatagcccagagagcagacgaggcatggcgacgtccgtggcctgcgccttcttcttcttcgacgcggcggagccgctgggcgagaccgggcggcggcaagcgctggacgcctgcgcgctctgctccaagccgctggcccgcaacagcgacatcttcatgtacaggggcgacaccccgttctgcagcgaggactgccgctacgagcagatgcaccacgacgcggctgccacggcctacgcgcggcagcaggccatcagccggcggaagcagcaacggagcatgggcg

SEQ ID NO: 66822 - DNA, 381 bp, Zea mays
  Clone ID: LIB3076-035-Q1-K1-B3
cccacgcgtccgatgagaaggcgctcgcggacaggaagaaggcgctcgagagccgcaagaggatctgcgcccgcgccaagcagtacgccgaggagtaccacgcccaggagaaggagcttgtgcagctcaagcgtgaggcccggttgaagggtgggttctatgtgagcccagaggccaagcttctgtttgtggttcgcatccgtggtatcaatgccatgcaccccaagacccgcaagatcttgcagctcctgcgattgaggcagatcttcaacggtgtcttcctcaaggttaacaaggcaaccattaacatgctgcgcagggtggagccatatgttgcgtacggataccccaacctgaaaagcgttagggaagtgatctaca

SEQ ID NO: 66823 - DNA, 399 bp, Zea mays
  unsure at all n locations
  Clone ID: LIB3076-035-Q1-K1-B4
tcgcccacgcgtncgtccacgcgtncgtccacgcgtncgcggaaatctgcattgagggctcttgcgaaggcactgacgacagatcaactcttcaacctaagagagcagtttacattattcggtccaaacaagagtggccatatatcattgcaaaatatgaagacggccttgatgaaaaattcctcgggtgcaatgaatgattctaggattcttgactttgttaactcaatatgcaatatccaatatggcatgattgattttgaagagttctctgctacggccattagtgtatatcaaatggaaggcctggagacctgggaagaacatgctcaacaagcatatgaattgtttgacaaggagggcaaccgaccaattgtgattgaagaactngcatcggaa

SEQ ID NO: 66824 - DNA, 53 bp, Zea mays
  Clone ID: LIB3076-035-Q1-K1-B8
gcgccagttcgccacctcctttgccttctcctcacacactcccaccccccccc

SEQ ID NO: 66825 - DNA, 446 bp, Zea mays
  Clone ID: LIB3076-035-Q1-K1-B9
gtttgatgagaatttcaacaaggaagttcccaagcgcggcaaagggcgcagtcggggtggcggagggcatgggcgtggcaaccatcaatataacaatcaccatcacaataaccagcaccaccagaacaaccagccgcagtacaataaccatggcaacaaccaccttggtgggaaccgtggcagccttcactctgttggaactacaccgaataacctgataaccaagcttgagccgcatccgcagctgcctattggggccaacaagcttccaccaggcccccgcatgcctgatggcaccaggggtttcaccatgggcagggggaagccacaagctgtgctacctgggttgtgtgctgttggtgttgagtgaagcatgcagattgctgctcgtatgcttgtattgtatatctttggggtgagtatttgtgcgtcacactttgtggaca

SEQ ID NO: 66826 - DNA, 364 bp, Zea mays
  Clone ID: LIB3076-035-Q1-K1-C1
tcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcatgttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccaaggccgcaccctctacggtttcgg

SEQ ID NO: 66827 - DNA, 443 bp, Zea mays
  unsure at all n locations
  Clone ID: LIB3076-035-Q1-K1-C10
attaatgatgctgttgggacgctggcgggatcaaggtactatgacaaagatgttagcgggggtgtaatatttggcactggcgacaaacgcatcatatgttgagaaggcaaatgctattccaaaatgggagggtgagctgccccattcaggagacatggtcatcaacatggaatggggtaacttcttctcatctcatctccccatcactgaatatgatcaagaattagataaggagagcttaaatccaggagaacagatttacgagaagttaacgtcaggaatgtatttaggtgaaattgtaaggagggtgctccttaaaatatcattgcagtccgccatttttggtgatattgaccacactaagcttcaaacccatttccttctgcggtatgtgtcagcttggctttntttgtagctgcactctttatgttaaaatctggaac

SEQ ID NO: 66828 - DNA, 400 bp, Zea mays
  Clone ID: LIB3076-035-Q1-K1-C11
tggcgtcctcccttctcccggctcttctcttcctcgccgccgtcgccgtctccgtggggggggttgcctccgccgggggcggagaatgcggcctccgcctgccccgcgacgccacgttccctgcggcgcatgcggagcggctcatccgcgcgctcaacctcctgcctaaggagaaggaggcggggccggccgcgggcggcggcgactggcccagcgtggcgcccggggagctcctatagcgtcgcgtccggctgcccggcgcgcccgccggcgtctgggacctcggccaccacgccggatactttcgcctgccgcacacgcacgacgccagaatgttctacttcttcttcgaatcgaggggcaagaagaaggaagacgaccccgtcgtgatctggctcac

SEQ ID NO: 66829 - DNA, 241 bp, Zea mays
  Clone ID: LIB3076-035-Q1-K1-C12
cccacgcgtccgcccactcgtccgttcacttgtccgttttttgcaaataagttctgtgccgtaactgctggtcacgtgtaaggtggtgttgcccggtgtcaggaaacggcatcacaattatcaaaagctgttattgtattctgatggcttaagattaaaaaaaaaaaaaaaaaaaaaaaaaaaaaaataaaaaaaaaaaaaaaaaaaaaaaaaaaaaaataaaaaaaaataaatatttctt

SEQ ID NO: 66830 - DNA, 453 bp, Zea mays
  unsure at all n locations
  Clone ID: LIB3076-035-Q1-K1-C3
acgcccacgcgtnncgctcatacaagggtggcagcatattattgccactcccggtgcanngtgctggtggtgggcgatggcattgagcaacctgtgttcggtggntttttatgcctttcttcatccaccaggaaaaaaccgcccagctggaacccccaaaaccataacgagggtgcccgtcctgctagccggtgtgcttgctgtgcgatcgtttggcatgtgcttgttgaggggttgctaggggattgtgagagaatgagggntntnatncncttnaatccccctcaaaccactagtaaccgaacgtggcctgagggggcgggcgagtctttatattgaatgaaactacataaaatagcatgccgtctctgtcactggcaatggacggtggtgcctagcgcaactcatcgcacaactgtgtgtcttgatttttcttctggttatcacggcatt

SEQ ID NO: 66831 - DNA, 316 bp, Zea mays
  Clone ID: LIB3076-035-Q1-K1-C8
gttgtttttgtggatgcaaaaaaccagtgggcgttggcagttgtgccgtcccgggtagcgacggacttgtcttggggtaggagggaagtgatggagcacaagaaagctagagcagtggaggatcctgcccggttgatttgcgacgatgccctcaccgaggtattccgcaggctgcctgcccgtgcgctcgcggcctgcagactggtgtgcaagtcatggatgtccgtgctcacagatccacacttcatccatgagcacctgagccgtggccagcaaaagctgctgctctttgcgactgacaggggaaacgacaggt

SEQ ID NO: 66832 - DNA, 424 bp, Zea mays
  Clone ID: LIB3076-035-Q1-K1-D12
ctcatctcttgctgtctcttccgccgccgccgcacgtcttccttcccatcgctctctactggtgctggactgccgtggggtggagatcggcttggaccaactcatattttaggctctgttggtggtgcaaaaatgagtgacaacctgatggacaaggttagcgcctttggtgagcgcttgaagatcaccgggacagaagtcagcaaaaagatgactgccggaatgagctccatgagtttcaagatgaaggagttgttccaggggcagactccagctgacaagattgttgagggtgccacctcagaggatctggacgggcctgactggaactcaaacttggagatttgcgacatgatcaacacagagaaggttgacagtgtggaactcatccgtgggatcaagaagaggatcatgctgaaggatg

SEQ ID NO: 66833 - DNA, 400 bp, Zea mays
  unsure at all n locations
  Clone ID: LIB3076-034-Q1-K1-E2
tgatgatcaaaggaaagttgttctcacaattttggaggatgattcagatgaaaattctacacagctggtaaagattttgagatctgctgctagcgcanaccgtgatttggtgtttggatatgttggaatcaagcaatgggatgagtttgtggagacttttgatgtttccaaaagctcacagctgccaaagctacttgtgtgggatagaaatgaggagtatgagctcgtggatggttcagagagattagaagaaggtactgaccaagcatctcaaataagccaatttcttgagggatacagagcaggaagaacaacaaagaagaaaattagcggcccttctttcatgggtttcctgaattctctggtcagcttgacctcgctgtacatccttatattcgtc

SEQ ID NO: 66834 - DNA, 300 bp, Zea mays
  unsure at all n locations
  Clone ID: LIB3076-034-Q1-K1-E5
gcggaccgcacgccgtccggctcgtgccgcctgcnngaagtgnncggaagccgctctttgttannattgcntnnctccctttccagtgcnccgcgcaggtggcgcatcatngggttttaaggaagggggggcnngacaccggtattcgcnncattcgccagccattggannatccgcaacggcggcccgtcccgcanngcgcgtcgctanngcccgggcccggccccgcgcccgcttcgtccaacgggccgcgcgccgcgggnngcgggtcgcgtcgtgggccgcttggcctcgccgcgc

SEQ ID NO: 66835 - DNA, 383 bp, Zea mays
  unsure at all n locations
  Clone ID: LIB3076-034-Q1-K1-E9
caagtaccagaagagcacggagctgctcatccgcaagctgcccttccagcgcctcgtccgtgagatcgcgcaggatttcaagaccgacctccgcttccagtcctccgctgtcgccgcgctgcaggaggccgccgaggcctacctcgtggggctcttcgaggacaccaacctctgcgccatccacgccaagcgcgtcaccatcatgcccaaggacatccagctcgcgcgccgcatcaggggcgagagggcttgatctcccgttgttgtcgtccacgttgttgggcctttcctctgtgtctctgcttgtagaatccttgcttctgttcggttccttctgttcgcatgatggtgttcgtagtgttaagagtngcattttctaatct

SEQ ID NO: 66836 - DNA, 432 bp, Zea mays
  unsure at all n locations
  Clone ID: LIB3076-034-Q1-K1-F11
cggacgcgtgggagagaggcgaggaaggagggagagagcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgagctcctcgagttggcggggaacgcagcgcgggacaacaagaagaaccggatcatcccgcgacacgtactgctggcgatccgcaacgatgaggagctcgggaagctactggcctgcgtcaccatcgcacacggcggtngtctgcccaacatcaaccctgtg

SEQ ID NO: 66837 - DNA, 428 bp, Zea mays
  Clone ID: LIB3076-034-Q1-K1-F5
gccaaggcggcagcagtaggcagccaccatcaataaagaaggtccaagcatgtcgggggtgtgggtgttccggaacggcgtggtgaggctggtggagaacccgacgtcggggaacgcggcggcggcgccgggcaagcgcaaggcgctgctgcacacgccgtccggggaggtggtcacgtcctacgcctcgctggagcgcaagctggcggcgctcggctgggagcgctactacgccggcggcggagacggcggcggcgccggcctgctgcagtaccacaagcgcacctccgtcgacctcatctcgctgcccaaggacttcgcccacttcggctccgtccacatgtacgacatcgtcatcaagaaccgcgacgccttccgcgtcatcgacgcctaattataagctagcggatgcagcagatgacagatac

SEQ ID NO: 66838 - DNA, 429 bp, Zea mays
  Clone ID: LIB3076-034-Q1-K1-G1
ccaggtctccagcgaagcaggctcaggcgtaacgcaacaacacaaggcggcggttatggcctctgctgctgcgacggctacgatggggacggggaaggtggtttgcgtcaccggcgcatcagggtacatcgcgtcctggattgtcaggctcctactcgaccgcggctacaccgtccgcgccaccgtgcgagacaccgctgacccaaagaaaacattgcacctgactgcgttggatggtgctaaggataggctgcacttatttaaagctagcctgctagaagagggttctttcgatgctgcagttcatggatgcgacactgtatttcatactgcctctcccttttatcacaatgtcaaggatgctaaggcagagttacttgacccagcagttaagggaacactcaatgttctcggttcatgcaagaaagc

SEQ ID NO: 66839 - DNA, 350 bp, Zea mays
  Clone ID: LIB3076-034-Q1-K1-G11
agcggccgatggcttatcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcacctcctacggcgagatcctcgacttcaaggtcatcaccgaccgggagacggggaggtctcgcggcttcggcttcgttaccttctcctgcgagaactccatgctcgacgctatcgagaacatgaacggcaaggagctcgactgccgtaacatcaccgctaaccaggcccaatcccttggcggttgctgt

SEQ ID NO: 66840 - DNA, 308 bp, Zea mays
  Clone ID: LIB3076-034-Q1-K1-G4
cgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgcttacaaactccctcatgatgcacgggcgcaac

SEQ ID NO: 66841 - DNA, 379 bp, Zea mays
  Clone ID: LIB3076-034-Q1-K1-G8
ccgacgcatgggataagatgccatagtggttgccggggatctgctccacgcgcataggcgttcgcctggcctagaagcgcccatgtccgatcgtccccctcgccccattcgccgatgccgagctccaccccgcccatgttccgcccaggccgagctccgcctccactgtagctccgccccagcgtctggcccaagtggtctttgccacgttcttgagctcccccaacaacacgatggggcagttctacgtggccgcatacgccgctgtgtacgacaagctccggcgcagctgccgtttggacgcggtgcagagcggctgcaccgcgttgtccatcgtcaagcagggggacctcatggtcgtcgccaacgtcagcgactc

SEQ ID NO: 66842 - DNA, 206 bp, Zea mays
  Clone ID: LIB3076-034-Q1-K1-G9
cccacgcgtccgatcatgagtagtgtttcttagttttagtttgtcaaatgtcaagacctgaacgctttgagtttgagactacactacaacagttgctcagctcatctccctcccttttgacaccttgagtctggccatgtcgacaaactaaaactcagaaacattatcatgagtagtgttttttttcgtttctctttcctggattt

SEQ ID NO: 66843 - DNA, 271 bp, Zea mays
  Clone ID: LIB3076-034-Q1-K1-H1
cccacgcgtccgcggacgcgtgggcgagtgtggctacagcaaccgcgtcgtcgacctgagccgccacatgttcaagacccagtaggggtttttcccccctgcttctcatggatggttgctgcttgtgtatgccgagaataaatgtggatggcgcgtgcctctgggtcgccaggttcatgctgagtctggacatgttttgcacttttgtttcccttcctgctaccatctgtgacagatccgctcgctaatatgggacctgagattagcttga

SEQ ID NO: 66844 - DNA, 239 bp, Zea mays
  Clone ID: LIB3076-034-Q1-K1-H12
cggacgcgtgggcgcctggacagcggcctgatccgaaacctccaagatgccctgtaacgaaggcaaccaggagagcacgtgcagattatagactatatgatgttgaggtgactgtccaaagaagctacaagggtcatcatgcgccccttatttccctcatgagtaaatggacaggtaaaccaattggggggtaccctgtcacccttgaagttttggaggatagtcgtcacacaacaagt

SEQ ID NO: 66845 - DNA, 368 bp, Zea mays
  Clone ID: LIB3076-034-Q1-K1-H2
cggacgcgtgggcggactcgtgggcggactcgtgggtctagatcgcgagcggccacccgaaaaaaaaaaaaaaaaaaaaagaaaaaaaaaaaaaaaaaaaaaaaaaaaaaaaaaaaaaaaaaaaaaaaaaaaaaaaaaaaaaaaaaaagaggggaaaaaaaaaaaaaaaaaaaaatggggggggggtatataaaaaaaaaaaatttatttataggtgaaattaaaattaaatttaataaatgtggtaaaaaaaaaaaaaatattttaaacctttttttaaaactaaattaattgaaaaaaacaataaattacccaaattaaaaattttttaaaaaaaaataagtccccaaataatgcgtattacaaaa

SEQ ID NO: 66846 - DNA, 160 bp, Zea mays
  unsure at all n locations
  Clone ID: LIB3076-034-Q1-K1-H3
aaaaaaaaaagggcgcccaaaaaaaaaaaaaaaaaaaaaaaaaaaaaaaaacacataaaaaaaaaaaaaaacatattnntaaaaaacaaacaaaaaaacaataccaccaaaagcccaccccccctcaaaaacccaaacacacaatcaaacaaagaaaaac

SEQ ID NO: 66847 - DNA, 231 bp, Zea mays
  Clone ID: LIB3076-034-Q1-K1-H4
atctgagaattggcgcaggatggcatggcgatgtaaaaaaatgagggtactgttgtacatttctttttgtagccattttatggcggtagataacttgtttgaagcatcggtaatgacgtgtggggccaaatcattcttactcgagttcgcacggatttgatcatccgaacatcatggtcgatgttcttctgagtgggtgtgggtgtggggccaaatcatgtcagcgggcca

SEQ ID NO: 66848 - DNA, 422 bp, Zea mays
  Clone ID: LIB3076-034-Q1-K1-H5
gaaccctgcgagtgtgctagttctaccagcgcagttcaccaaactcaccttcggaaacctgtacatccgccgggccgggccgggcagcagggagataaccgaggagggcaggtgcgacctggacaggagatacgtgagtaacttccccgtctacgacggccgcggccccgacgccagccttgtggcccgcgtgcaggggattaccagcgaaatcgggaacgcgcaccaactgttcgtcgttgtgttcgacaccgacaggctcaagggctccacgctcgtcaccaatggcgtgataacggccgggtctgacgagtgggcgatctacggcggtaccggggtgtttgccatggcgaggggcgtcataaggagaaggtatctcgccgacaggggccgcgggaacactgatgagctcaacatggatg

SEQ ID NO: 66849 - DNA, 409 bp, Zea mays
  Clone ID: LIB3076-034-Q1-K1-E1
cccacgcgtccgcccacgcgtccgcccacgcgtccggctgatttgtggcgtcagctactgccactccatgcaaatctgccaccgagacttgaagctggagaacacgctgctggacggcagcccggcgcctcgcctcaagatctgcgacttcggttactccaagtcgtcgctgctgcactcgaagcccaagtcgacggtcggcacgccggcgtacatcgcccccgaggtgctctcccgccgggaatacgacggcaagacagccgatgtgtggtcctgtggagtcactctttatgtgatgctggtcggtggttacccttttgaggacccagacgacccaaagaatttcagaaagacgatcgggaggatcatgtcaatccaatacaagataccagagtatgtgcacgtgtcg

SEQ ID NO: 66850 - DNA, 123 bp, Zea mays
  Clone ID: LIB3076-034-Q1-K1-H6
tcacctaatctgcgatcaccaagcgcattatatttaggagatgcaaactcaggtatatgccctattccctagagtaaatgacaggtaaaccaattgtggggtaccctgtcaccctggaggttt

SEQ ID NO: 66851 - DNA, 438 bp, Zea mays
  Clone ID: LIB3076-034-Q1-K1-H7
cccacgcgtccgcccacgcgtccgcggacgcgtgggcgattgggagccactgatggatagttaccggcctttgggaataaaatctctgaggttcagcacattttctcttggaaatatgtcaccaaagatagaagagcaaaaaattcagtacaccattcataccattggaggaagcttaactgcagttcatggattttttgtccaacttggtgtcaatgtggatacgagtgactgggagcttcaagctctgggaagactttcggttactgtggcaaagcaagccaagctcgaccgcttccccatcaccattagtgatccaatctcagctacgttcggtgaaccatttgagaaagccaacccaagccattcctccacagcaatcgtttgtcgagctggttcaggaattgatatggttgttggccttgtttcttctagtct

SEQ ID NO: 66852 - DNA, 116 bp, Zea mays
  Clone ID: LIB3076-034-Q1-K1-H9
agccttccgccaacccttccgcggccccttggggtttttttttttttgcggtttgaagggtttgaatggggtggtttgtttccagttttccaaccgtttaagtaatgtggtttttc

SEQ ID NO: 66853 - DNA, 461 bp, Zea mays
  Clone ID: LIB3076-034-Q1-K1-C1
cccacgcgtccggaccgcctggttccacttccaccacggcgtgcactagcgctacgccgaggccaccttttcttggttccttcaatacgcctactccggcctccggatcgggcaccacgtctgccccctgctcccggaatctttgccaagcggcgccgctactgtccggcaaggcgaccccgtctctcggccggcgttgatctggcgggcggagtggcggcgcgatgggcatctcggcgaggtggctcaagtcgttagttgggttgaggaaggtggggcggcagcagcagcagcggcgaaaggatgatgcagatgttggtcgaatgaaaaccgatgtcgccgaccagtttcattttcagattcagcactctcaagatgacaatagcattgctgcacaagaaattccagaggtttcttatggaaatgatccacctgaagatgattctaatgtaccttcatgc

SEQ ID NO: 66854 - DNA, 321 bp, Zea mays
  unsure at all n locations
  Clone ID: LIB3076-034-Q1-K1-C11
cgcgctacacgcacggcacgcagatacatatatagagaggttagctatagcttgcacatcgatgtaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgccgggccgggccgggcagcagggagataaccgaagaaggcaggtgcgacctggacaggagatacgtgagtaacttccccgtctacgacngccgcggccccgacgccagccttgt

SEQ ID NO: 66855 - DNA, 246 bp, Zea mays
  unsure at all n locations
  Clone ID: LIB3076-034-Q1-K1-C12
acaaaaaaacaaaantataatcattctttctcctattatattctacccttctccaccatattataactacaaaaccatttatatattctattttttcaaatctacaatttatacttcctccttttacttcatccacttactttaatttctcaccaccatctcatacattactattccctttattcttaaccatacacatcctctattacataaaaaccacctactatatacaacatctatattcta

SEQ ID NO: 66856 - DNA, 441 bp, Zea mays
  Clone ID: LIB3076-034-Q1-K1-C2
gtgatttactaatggagcagaatgttgccctggatttagctcgaagagaggctgagatggctatccgtgctcgcgatgattttctagctgttatgaatcacgaaatgagaacacccatgaatgcaataatagccctttcctccttgcttttggaaactgagcttactcctgagcagcgtctaatggtggaaacagtactgaaaagcagcaatctgttagcaacactcatcaatgatgtgctagatctttccaaactcgaggatggaagccttgaactggagattaaagcattcaatcttcatgctgttttcaaagaagtgatgggtttcattaaaccaattgcatctatcaagaggctatctgtatcggttatgttggcaccagatttgccgttatgtgccattggtgatgaaaagagactcatgcaaactattctgaaca

SEQ ID NO: 66857 - DNA, 380 bp, Zea mays
  Clone ID: LIB3076-034-Q1-K1-C3
aaaacccggcccgacgcactaatgcagcagaacgttcccctctttttacctcgaatagaggcccacacgcctatccccactggcgatgattttctaactgtgatgagtcaccaaatcacaacacccatcaatgcaataatagccctttcctccttgcttttcgaaactgaccttactcctgagcaccatctaatggtggaaacagtactgaaaagcaccaatctgttagcaacactcatcaatgatgtgctagatctttccaaactcgaagatggacaccttcaactgaacattaaagcattcaatcttcatgctgctttcaaacaagtgatgcgtatcattaaaccaattgcatctatcaagaggctatctgtatcagt

SEQ ID NO: 66858 - DNA, 463 bp, Zea mays
  Clone ID: LIB3076-034-Q1-K1-C6
cgcactacacgcacggcacgcagatacatatagagagaggttagctatagcttgcacatggatgtaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgccgggccgggccgggcagcagggagataaccgaggagggcaggtgcgacctggacaggagatacgtgagtaacttccccgtctacgacggccgcggccccgacgccagccttgtggcccgcgtgcaggggatcaccagcgaaatcgggaacgcgcaccaactgttcgtcgttgtgttcgacaccgacaggctcaaaggctccacgctcgtcaccaatggcgtgataaccggccggtctgacgagtgggcgatctac

SEQ ID NO: 66859 - DNA, 432 bp, Zea mays
  Clone ID: LIB3076-034-Q1-K1-C7
aaaaagaataccaaagactggcgggaaccagtttatacagatgactgacggcagctgttgtgtgttcttttttggatcgtcgcagagagcaagatcttcatcgaactctttcattgtcttcacaaacgtcctcgcaccttgcattatcaacctttccaccatgaacagctgatagttgttcttgactatcggattcaatatgctgctgaagttagatgaatatgccagcctgtacttgtctgatagagatgaaaagaagcctggggtcctttcatttgaggaaatgaaaagagtgcgacctggtcgaatccactttgcgattcttttcttgataaactcagggcgagtatctctgtcaagatgaggatgaagacttcgctcaactccaaatctatctttcctattcttcagtaggtcacctcgtctcacatg

SEQ ID NO: 66860 - DNA, 374 bp, Zea mays
  Clone ID: LIB3076-034-Q1-K1-C9
atgcaagaggctgatggacacggtgactgtcaagtgcggccactgcaacaacctctcctgcctcagtccacggccccccatggtgcagccgctctcgccgactgatcaccctttggggccattccagtgtcagggaccctgcaacgactgcaggaggaaccaaccgctgccgctggcttcgccgtcatcaactgagctaagcccgagaatgcccttcgtagtcaagcccccggagaagaaacaccgcctcccatctgcttataatcgcttcatgagggaggagattcagcgcatcaaagctgcgaagccagatatccctcacagggaggccttcagcatggctgccaagaattgggcaaagtgtgacccgcgct

SEQ ID NO: 66861 - DNA, 566 bp, Zea mays
  unsure at all n locations
  Clone ID: LIB3076-034-Q1-K1-D12
tccggttgggcttcctttccacatgtctgtnnattctgttccatattaccaagcacaatgnnttgaagatcatgtggatactcggtggagttcttatgaacccaggagaaacccctctttccctttaaagaaatttgaagtcnncttggttctcaaattttaaaaccaggccattanntggcaactnnntctgtgggttattttccatttcctcttctacttttcagaaagtnngtcacccaacncnncttcaggcnncttaaannaagttgtnncagtggagaaaaatgtcaagactttagagnnttagggttgggttaattctgaacctnntctcacacagnnttgcaagaactggaaccagcncgactttaccattnncactgctgcnnaagtgatttcttattctcaaagaagctaccgagcccgaaaatttnntgtgtctcaaagccaatacccttggtaatacttcgagccatttcagagatcataaaagctttgctttccttttttggcttccatttacccagtcgagtcaaaaatattcacttcccaaataaacgtgt

SEQ ID NO: 66862 - DNA, 343 bp, Zea mays
  Clone ID: LIB3076-034-Q1-K1-D2
ctgatcaccctttggggccattccagtgtcagggaccctgcaacgactgcaggaggaaccaaccgcttgcgctggtttcgccgtcatcaactgagctaagcccgagaatgcccttcgtagtcaagcccccggagaagaaacaccgccttccatctgcttataatcgcttcatgagggaggagattcagcgcatcatagctgcgaagccagatatccctcacaaggaggccttcagcatggcttgcaaaaaattgggcaaagtgtgacccgcgcttctcgactggtgtctttaccgaaacttctaacagcgctcctgctgagctagagttgtgcccactcccca

SEQ ID NO: 66863 - DNA, 311 bp, Zea mays
  Clone ID: LIB3076-034-Q1-K1-D3
acccttccgcggccccttggccccacgcgttcgccctgttcgtggcggtgtcggtgggcccgaacatgtccggcgggcacgtgaacccggccgtgaccttcggccccttcgtgggcggcaacatcaccctgttccgggggctcctgtactgggtggcgcagcttgctggggtccaccgtgggcgtgctttcctgctccgcttctcgacgggcgggcaagccacgggcaccttcgggctgacgggcgtgtccgtgtgggaggcgctggtgcctgagatcgtgatgacctttcgggctgtgtacacggtgtac

SEQ ID NO: 66864 - DNA, 374 bp, Zea mays
  Clone ID: LIB3076-034-Q1-K1-D4
aagttcgtgtctgtagttgctaccatttctctactctctacgtatgtaatttattcgcgggaatatttattgaaatgttggtacggacgacagaaaaacaaagggagaatcaggggttgttggattggattgtagcctgcgccaccatattttaacttcaaatccgttgagatatgcttctttttcgggtctctttgtttccttcctccttttgctggagccactgactttgatgtctcaccaccatttcttcattgcattcccttttctctcaacttgaggcatccttgtgtacacaagatctgcctacgtgtttcaggttcttgattctgtttatatgcagtcggaagctttaggcggttaggcccagctga

SEQ ID NO: 66865 - DNA, 451 bp, Zea mays
  Clone ID: LIB3076-034-Q1-K1-D5
gcgccggcctcgccttcgctgagaatgacacgtccaaggccgacagcgggaagctcgggagcaccgacggctcgccggccggccggccgtcgtccgacgcgtcccaggacttcttcgggcaggtgccggagttccaccagtggtccgtgccggagctcccttccccgcccacggcctcggggcttcactggcagggcggcccgcgccaaggcgcggccaccaccaccgacgtggccgccgtgttcgtgccggacatctcgtccccggagaaccccttctggtgctacgccaccgccgctggccaggcgccgacgaagcgccgcaggagatgttgaagtagggaagatcgagattgtcttgttcagtactggagtggcgtaggcttgcaagaaacaaacacagttgctgtactgtgtactcccatggtgacgtactatctatatactccatg

SEQ ID NO: 66866 - DNA, 449 bp, Zea mays
  unsure at all n locations
  Clone ID: LIB3076-034-Q1-K1-D6
gcgcctncctcgccttttctgagaatgactcgtccaaggccgacagcgggaagctcnggancacttacagatcgccggccggccggccgtcgtccgacgcgtcccaggacttcttcgggcaggtgccggagttccaccagtggtccgtgccggagctcccttccccgcccacggcctcggggcttcactggcagggcggcccgcgccaaggcgcggccaccaccaccgacgtggccgccgtgttcgtgccggacatctcgtccccggagaaccccttctggtgctacgccaccgccgctggccaggcgccgactaagcgccgcaagagatgttgaagtagggaagatcgagattgtcttgttcaatactggagtggcgtaagctttcaagaaacaaacacaattgctgtactgggtactcccatggtgacgtactatctatatactcca

SEQ ID NO: 66867 - DNA, 430 bp, Zea mays
  Clone ID: LIB3076-034-Q1-K1-D8
cagaagagcacggagctgctgatccgcaagctgccgttccagcgcctggtgcgtgagagcgcccaggatttcaagaccgaccttcgcttccagagctccgccgtcgccgcgctgcaggaggcgtccgaggcctaccttgtcgggctcttcgaggacaccaacctctgcgccattcacgccaagcgcgtcaccatcatgcccaaggacatccagctcgcccgccgcatccgtggggagagggcctaggcgtcgtcgcggtggaggtggaagtagtagtcgcagtttctgtcatcactgtctggctagaagttgtagagatgtgccggtttatgtagtttgggttattggtcgaatcattatgtagttgggtcttcactgctgtaatttaactatgactatgcaatggcaatgaagttcttcgttatcactt

SEQ ID NO: 66868 - DNA, 245 bp, Zea mays
  Clone ID: LIB3076-034-Q1-K1-D9
aaaccccgcccgacgcacgcatccacacaataccacacaccttctcacccttattctcccgttccagcgcctcataacatggcacgcccctctttataacaagaccgcgccaccctaccacacctccaccctccaccatctacactatcctccgctcctaccttgtctgactcttctactacaccaacctcttccccactcactccaaccactttaccatcatgcccaagcacatccaactctcc

SEQ ID NO: 66869 - DNA, 433 bp, Zea mays
  Clone ID: LIB3076-034-Q1-K1-B6
gtggagtactaaatccacagaaccaaatgctgaagacaagcatctttgtctagggagtggcagcaatgggaaacctcagggaagtagctcctcgaagaaagcaggtaagaggaacagtcctgaaatggttggggaaacaagtgttctgcctgctgcggcccaaggaaaacccaatcaaaaccatggattggttgcgatggcgaagcaagcgcctgcgtctgtggaaggctacagtgatgcagaatcaccggggagacatacatcaaagaaagctggcaagcgacataagcctgatgatcttcagaaaagcagtgttctcccttctgtaccccagggaacaacaaaaccaaagcatgcgttggttgcgacagagaataaccctctctcctcagcagagcgccgcaacgatgcaaaatcgccaaaaaccaatacc

SEQ ID NO: 66870 - DNA, 357 bp, Zea mays
  Clone ID: LIB3076-033-Q1-K1-H1
cggactcgtgggcggactcgtgggttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcataggtcccgcggcttcggcttcgtcaccttctccacggaggaggcgatgcggaacgccatcgagggcatgaactgcaaggagctggacggtcgcaacatctccgtcaacgaggcccattcc

SEQ ID NO: 66871 - DNA, 59 bp, Zea mays
  Clone ID: LIB3076-033-Q1-K1-H10
cacacgcgttcggctctaccaattgacatcacttaaacatgcttcacacccctgggaaa

SEQ ID NO: 66872 - DNA, 402 bp, Zea mays
  Clone ID: LIB3076-033-Q1-K1-H2
gcaaacgcggctgctagcgcggcgcccctctcccactccgactccccagccgccgccagggcgcacacccctccctcgcgcgctcagggtttcggaatggaagccgaggcggcggccaagaggacgcgggagagcggggaggacgccgtcgcggcggggatctccgtcgtcatcccgggatggttctccgagatcagccccatgtggcccggtgaggcgcactctttgaaggtggagaaggtgctgttccaagggaagtcagactaccaaaacgttatggtctttcagtcctctacgtacgggaaggtgctcgtccttgatggagttattcaggttacggagagggatgagtgtgcgtaccaggagatgatcactcacctgcccctttgctccattaaagat

SEQ ID NO: 66873 - DNA, 333 bp, Zea mays
  Clone ID: LIB3076-033-Q1-K1-H3
gcaaaccctgctgctagcgctgcgcccctctctcactccgactccccatccgtcttcagggggtcgactctttctttgcgcgctcagggtatcggaatggaagccgatgcttcattccaaaatgactctgtagagcgtggaggactccgacgcggcggtgatctccgtctttattccaaggatggctctacctgatcagccccatgtggccctgtgaggctcactcttcgatggtggagaaggttctgttccaatggatgttagactaccaaaacgttatagtactttagtcttctactttcggtaaggtgctcgttctttatggatctattc

SEQ ID NO: 66874 - DNA, 405 bp, Zea mays
  Clone ID: LIB3076-033-Q1-K1-H6
gtcgttcccgctaatacgactacattcgatgcatatcagaacacgacaacttcgcattggatatatgatcttggccggaagaggaattctcctcacgccttcggatatgacacaaaatattggtccatccctgcatattcagaacacgatctcacaagaattccagctctacagggtcttgattattctgtcagtgacaccagattttgatggccaacaatcgtactggggcaattcataacagtgtcctcgtcagatacctcagtattggacatctactcatacaactgtcaacattgctgattgccctatgcaaggcatctagcgtaatgtgcacaatatgattgtagcactactaaccatgaattattcatgtcgcgcacttcatgtatgtgacgaacggga

SEQ ID NO: 66875 - DNA, 293 bp, Zea mays
  Clone ID: LIB3076-033-Q1-K1-H8
tcggcggcgagtcgtccaagaaggcggtcgtcgactcggagtggcggccggccactgcgacgtggtacggctaggcagagggcgacggctgcgactgcggcgcgtgcgggtactggacgctggtggacgtggtgccgatgaaggcgcgggtggggtcggtgagccccgtgctgttcaaggacggctagggctgctgcgcctgctacaaggtcaggtgcctggaccgcggcgtgtgctcgcgccgtgccgtcacggtggtcgtcacggactagtgccccggcgggctgtgctcg

SEQ ID NO: 66876 - DNA, 440 bp, Zea mays
  Clone ID: LIB3076-034-Q1-K1-A1
gccaagatttgcatcaatgatgacagattactacccaatggtgctatcaagtatactagtttaccatcagtcaccagtccacgggactcaagcctttcttctggcagtcctccatcgccggcaagtattgttcttcatcaaaggaatgaccatgagagattacacaataatcagcaaaatttgtctgacctcaaacctcaaaggtacataccacctggagggcgtaactgttcaagtgaaatgactacatcagtaaagcatatgcagcctattgagggtgcttggttgcacagctcatcaaatgagcatttgggctccaataacgacaaatctcaagcatcttcacagttaggaaacgataattcaaatcccaagcaaattacttcagcagaaaatggaacatctgacaccgtgcagcaaaagccacagtatgctgatgt

SEQ ID NO: 66877 - DNA, 326 bp, Zea mays
  unsure at all n locations
  Clone ID: LIB3076-034-Q1-K1-A11
agcgaaaccgaaagagatgcagagcttggtaatggagctcccgtggggaatgctgctgcggctgcttctggtcctctccgggtcgtcctcgtcatcgncgtcggctgctgccacgctcgccgtcagcgctccgcccccactgcctgttcctcctcctcgtcatgctcaagacgccgaaggcatgctcatcaacggcaacttcgagacggcgccgcggaagctgaacaagaccctgatcgtggggcgccactcgctgccggggtggacggtgcatggccacgtggagtacgtctcgggcggtccccagcccgggggcatgttcttcg

SEQ ID NO: 66878 - DNA, 309 bp, Zea mays
  unsure at all n locations
  Clone ID: LIB3076-034-Q1-K1-A4
cccacgcgtccggcaacagttgctgctacttggccgtttccaattagctgcaaccctgcatgggcgtgtgtttgctttgttttaacttgtttctcaattgtgtggtgttagatatgtactgtcgaactgctgtagttcaactttgacccatgcaatatccttttggatggaagtgaaaaaaaaaaaaaaaaaaaaaaaaaaaaaaaaaaaaaaaaaaaaaaaaaaaaaaaaaaaaaaaaaaanaaanaaaaaaaaaaaaaaaaaanaaaaaaaaaaaaaaaaaaaaaaaaaaaaaaaaanaaaanaaaa

SEQ ID NO: 66879 - DNA, 311 bp, Zea mays
  Clone ID: LIB3076-034-Q1-K1-A8
tggcgttgaccccagcacttcttaaagattacagacacatgctttaacttgcacctcgtcttttggaagaactggttaagattgcagttctaccaaggaatccccatggttttggatggctccggcctgcaattggtggtattgggctttcttaaaatattggccaagctggtccactcaacgcacgaaaaactagtggaggtaactccgaaagaatagcacatttcttgcagctgccacatttcacagaagcaactgtgaaaaagattgctcgcaagaaaatccgtgccttccaagaactttgtgacatg

SEQ ID NO: 66880 - DNA, 465 bp, Zea mays
  Clone ID: LIB3076-034-Q1-K1-B1
cggacgcgtgggcggacgcgtgggcggacgcgtgggaaatatttaagctttattaggacagtaggacctaggtcaccaactgaataggcttcacttttgagaacttgattatgcgggtattttgtacagaatttgacagctactcttcctaagtaaagcaatggtatgatcgtatgaggttgtgaaatgttaaagagaggttctataaatacttggcataatggtattcctcgtaggcagtctaattcaaggaacataaaaggcatatattgtgattacctccatgaccatcaaaaacatcgaagaacgttgtctcgctaccaagatctagcattgttgaatgatgtatggatgtatagattggtaaatattatgtcgtggaacaattttaagaaatagtctgaccgataaaaatggtaggcatctttaaaaaataaccatgcttgtagtgtgatgttgaacgta

SEQ ID NO: 66881 - DNA, 269 bp, Zea mays
  Clone ID: LIB3076-034-Q1-K1-B10
gtgcagtttgactacccaattttgtatcagctccgctggtggttacattgccggtgtctaatgtgctatgggttctcacccggctgacaaccttgtgtctttcctgaacaatgccaagggagctacagtgggagatgctgttaacaagcttggtctctggggtctctacactagaggacttcctcatcgtatccgcatgattggtacccttactggtgctcagtggggaatttacgatgcattcaaagtgatggttggacttccaacaa

SEQ ID NO: 66882 - DNA, 392 bp, Zea mays
  unsure at all n locations
  Clone ID: LIB3076-034-Q1-K1-B12
cttgatatttgcacccactaacanaatttatttctgtgtctcagtcctttgcgaatatcaaatggtactttgctgcaggtccttgacagattttgtttcttttttccttatcgtgcagtgacaaaggttattttcagggggcaaagctgatggttataatttttttccatagttggcaggtgtattttcaagggatgttgcttgagcccaaatggatgacagcagaagtgtgatatgacgtgcgctcagcttcaccaacacactgattcttgaatgcattaagcatagtgcacaagcagttattcatgataagaaatcttttgctcaaatacatagaaggtgctctcaaagacattgaaggacctctcagagatattgagggaactcttatc

SEQ ID NO: 66883 - DNA, 380 bp, Zea mays
  unsure at all n locations
  Clone ID: LIB3076-034-Q1-K1-B2
gaaaaaccgggccgacggacgcgtccgcggacgcgtgggcggactcttgggcggactctgttggaaatatttaagctttattaggacagtgggatctatgtcaccaactgagtaggcttcacttttgagaacttgattatgcgggtattttgtacagaatttgacagctactcttcctaagtaaagcaatggtatgatcgtatgaggttgtgaaatgttaaagagagggtctataaatacttggcataatggtattcctcngaggcagtctaattcaaggaacataaaaggcatatattgtgattacctccatgaccatcaaaaacatcgaagaacgttgtctcgctaccaagatctagcattgttgaatgatgtatgga

SEQ ID NO: 66884 - DNA, 414 bp, Zea mays
  unsure at all n locations
  Clone ID: LIB3076-034-Q1-K1-B3
cggacgcgtgggcaatttttgtaccataaattcttgcgatagagtattagaccatgtttgttgtttgaccttttctgtttcatgcatttctcctgtttccgttgttcggtgagttctcaaaactcttgacgctatgtatctgtatctgagttgattaacatttgcagtatgtttttttcttggctcataggaataggataattgaaacagctcatctcatgagggatatgtattacaaaaggaacccaccagcaagaggttcaagctctaatatttcagtaaaaagttactttgagatgcttgccatggatgagcatgcatctgctttctctagaggacctgctgaagcttttcagtggattgngcacccaatgagggctaccttgtgccgtatgaagagtggtttaatttaac

SEQ ID NO: 66885 - DNA, 446 bp, Zea mays
  unsure at all n locations
  Clone ID: LIB3076-033-Q1-K1-G9
caccggtgttaggttctaccaggagaccttcggcgtccctccggccacgcgagctcgccgggatggtcgcccacaggttccatcagtaccaggtggtgggtcgcgcgctgccgaccccaaccgatgagcaccccaagatctaccgcatgaagctctgggccaccaacgaggttcgcgccaagtccaagttctggtacttcctgagaaagctcaagaaggtgaagaagagcaatggccagatgcttgccatcaacgagatctttgagcgcaacccgaccaccatcaagaactatggcatctggctgcgctaccagagcaggactggttaccacaacatgtacaaggagtaccgcgacaccaccctgaacggcgcagtggagcagatgtacaacgagatggcctnccgccaccgcgtgaggtccccctgcatacagatcatcaagaca

SEQ ID NO: 66886 - DNA, 403 bp, Zea mays
  Clone ID: LIB3076-033-Q1-K1-F5
tcgcgaaggcgaccctcccttcttcgctccttccgcgccgcctcccggccgtcgccggcgtggtgaagtactcgcaggagccgggcaaccctaccaagtctgctaaggccatgggcagggatctgagggtccacttcaagaacacaagggagacagcctttgcgcttcgcaagttgtctttgaccaaggctaagcgataccttgaggatgttattgctcacaagcaggcaattcccttacggagatactgtgggggtgttggtcgcaccgtgcaagctaagtcgcgccactccaatgggcaaggcccgtggcccgttaaatcagacaggttcatactggatttgctgaagaatgctgaaagtaacgctgatgtgaaaggcttggatgtggacaacctttatgt

SEQ ID NO: 66887 - DNA, 463 bp, Zea mays
  Clone ID: LIB3076-033-Q1-K1-F6
tctcctcatatttttccagaaattcctttgtcttttttgtatctagacccttgccccaacattttttgggcttcagagaaggcaactgtatatttgctcaaatatttgttgtctcaaatgttcacatttgctctgtttgtagttgtgaggttaaataattaacaaatgtcaccttggtaggagatgcaatccatttattagctttgagaagcttctcattaagaagtcacgtgaacttggttgcattgttcttgcttattattgtaagctttggtgttacagatccttaatgaaaccaaagagctgcagcagataaccaacgacaagcataaaaatcaggttgtacgcatccaacattttactttcatatttgctgaagatgtcaacaaacaaaatagacaagcagtaagtgtggcactactttgcatgtgctaacagtatggctaatggtttttcaatctta

SEQ ID NO: 66888 - DNA, 467 bp, Zea mays
  Clone ID: LIB3076-033-Q1-K1-F7
tctactcatatttttacacatattcctttgtctttcatgtatctagacccttgcgccaacggtttttgggcttcagagaaggcaactgtatatttgctcaaatatttgttgtctcaaatgttcacatttgctctgtttgcagttgtgaggttaaataattaacaaatgtcaccttggtaggagatgcaatccatttattagctttgagaagcttctcattaagaagtcacgtgaacttggttgcattgttcttgcttattattgtaagctttggtgttacagatccttaatgaaaccaaagagctgcatcatataaccaacgacaagcataaaaatcaggttgtactcatccaacattttactttcatatttgctgaagatgtcaacaaacaaaatagacaatgcagtaagtgtggcactactttgcatgtgctaacagcttggctaatggtttttcaatcttaatt

SEQ ID NO: 66889 - DNA, 387 bp, Zea mays
  Clone ID: LIB3076-033-Q1-K1-F8
cgacccactcttccgtcttctcatatttttccacatattctctttttctaccttgtatctatacccttgcgccaggtttatttgtacttcagagaaggcaactgtatatttgctcaaatatttattgtctcaaatgttcacattcgctctgtttgtacttgtgaggttaaataattaacaaatgtcaccttgttaccatatgcaatccattcattatctttgataatcttctcattaataatacacgttaacttagttgcattgatcctgcttattattgtaagctttcttgtttcatatccttaatgaaaccaaagagctgcaccatataaccaaccacaatcattaaaactatgttgtactcatccaacattttactttcatatt

SEQ ID NO: 66890 - DNA, 427 bp, Zea mays
  Clone ID: LIB3076-033-Q1-K1-G1
ctgcctggtaccgtgctagtgccgcctgcgcatccgtcctccgcctgggtctccgccctccgcggctccgccttgcgactttaccctgcacggcccgccgccggccggtcgcccgtctggagccactgacccgagtttccgtccagcactccagggaccagcgcctgttcgtccagagtaccaacagatctcgtcaagaggtctgaaggatgaggaagggactgcatcctcagatgcaatggatttcatatgtgacgcacagtggtaggctgatcaatatcatgatgaccaaggtgaaccatactggcaaagtgtaccacatgagggccaagcggcaaatggctcaagcctcggccagattgcgaagttcaaacgtcgatatgagcaggaagcagagaaaagcctagacaagtaggatggtgttggg

SEQ ID NO: 66891 - DNA, 380 bp, Zea mays
  Clone ID: LIB3076-033-Q1-K1-G11
acggcctcgccttcccttccccaccagcccccgtctctctctctcttctctctgactctctatggggtaggcgaaaccacctcggggcagcaagcaagcgcgaccaaatggcgcctctaggagaccgctgagctgctgccgcggcggcgtccaacaacctggtggtgtcgttcggcgagatgctgatcgacttcatccccgacttggcctggctgtcgctggcctagtcaggcagattctcaaggcacccttcggctcgcccaccaacgttgtctgcgccatcgccaaactcggcggatcctccaccttcttcagcaaattctgcgactacgagttcaggcacatgttggtgaacatccttgaaacagacaacatgaact

SEQ ID NO: 66892 - DNA, 443 bp, Zea mays
  Clone ID: LIB3076-033-Q1-K1-G12
cccacgcgtccgccgttcgccatcaccaccacttaaaaaggcttcaccccctaggaaagtgtcgcctcctgctgaatcagctgttctctgcattgatcatttatcaaggaatgttaatgaggctcacttgaaagagatatttggaaactttggcgaagtggtgaatgtggagctatcaatggaccgaatggttaaccttcctcgtggctatggatatattgaattcaagaagagagctgatgctgagaaggctcttcttcacatggatggtggtcaaattgatggaaatattgttaagttgagattcactcttcaaccacgccaaagggctgcatcacctgtaaaagctccgccccctcctccaaaaagagatgctcttcagattgaaaaaagtgttagcagtgctgaaaaggatgctcaacagcgtcctaaggaatcatctc

SEQ ID NO: 66893 - DNA, 242 bp, Zea mays
  Clone ID: LIB3076-033-Q1-K1-G2
taccgagctagtgcctcctgttcatccttccttctcctgggtctccatcctgcgctggtccaccttgctacttggccctgcactgcccgtcgcctgccgatcgctcgtctggagccactgacccgagaatccgtccagcactccatgtaccatcacctgttctttcagagtaccatcagatctcttcaataggtctgaatgattactaatgtactgcatactcatattcattggattttata

SEQ ID NO: 66894 - DNA, 443 bp, Zea mays
  Clone ID: LIB3076-033-Q1-K1-G3
cggcgcactaccagtccccgtgaagcatgatctgcctgtggcggaagctgcagtccggtagggcccggtgcttcaacgtcagatgacgcattgcgagagaaagcctgattttgtactctttcttgatcaaagaggagagaaacagatggtggtggacgacgggtctgcagtccgtaagcgcagctcttctgcgatggacacagttgacgacgacccgttacgactgtgggtttgcatgatgaggttgctcttctggaccttgtgatgcgatgattctatcattcttttggtcggtggcccgtttgagctgcttgattctgacagccctggtcggtgttcatggtcggggattctcttatgctgctgctgctgcttccacctgttgatatttttaaggtgtagattccagtcatgaggctacttagttgggctccggatcatat

SEQ ID NO: 66895 - DNA, 487 bp, Zea mays
  Clone ID: LIB3076-033-Q1-K1-G4
agtttatgtacaacagaaatactgtatagaagtcaccatttaggtagtgtttggatggagggactaggaaggatgaaaaggaatgagataggatcattctaacttgacccgcgtttggtttggaggctttcaaggtagaaaagaagtcttttgttccatcatggccttaccaactccagcgcctattttggttgacgagaaccaacagataaatagaggtaagagggccaatggaccaagggccaaagggctgaagccatccgagaatcctggcaatcaagggaggagagctcttaaggatttgtccaacttctctaaaggcactggtttgaaggacactttcaccctgaaagagaagtcccagcagaaaactcgtagtaatgtggccaacactattaaaggcaatgctttgaaggacaagcccatcctgaaagagaagtccacccatgaacagaggtcaaaagctcttaagaacccaatgaaaatt

SEQ ID NO: 66896 - DNA, 470 bp, Zea mays
  Clone ID: LIB3076-033-Q1-K1-G5
gggcacacgcactacacgcacggcacgcagatacatatagagagaggttagctatagcttgcacatctatttaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgccgggccgggccgggcagcagggagataaccgaggagggcaggtgcgacctggacaggagatacgtgagtaacttccccgtctacgacggccgcggccccgacgccagccttgtggcccgcgtgcaggggatcaccagcgaaatcgggaacgcgcaccaactgttcgtcgttgtgttcgacaccgacaggctcaagggctccacgctcgtcaccaatggcgtgataacggccgggtctgacgagtgggcgatctac

SEQ ID NO: 66897 - DNA, 424 bp, Zea mays
  Clone ID: LIB3076-033-Q1-K1-G6
gggcacacgcactacacgcacggtacgcatatacatatagagagaggttagctagggctggcacatctatttaactgactaactaactggctagctagctcgatccgcatagcaaagcgaaagcagcaagaagcaaatcaatggagaaccctgcgagtgtgctagttctaccagcgcagttcaccaaactcaccttctgaaacctgtacatccgccgggccggtccgggcagcagggagataaccgatgagggcaggtgcgacctggacaggagatacgtgagtaacttccccgtctacgacggccgctgtcccgacgccagccttgtggcccgcgtgcaggggatcaccagcgaaatcgggaacgcgcaccaactgttcgtcgttgtgttcgacaccgacaggctcaagggcttcactctcgt

SEQ ID NO: 66898 - DNA, 463 bp, Zea mays
  Clone ID: LIB3076-033-Q1-K1-G7
cccacgcgtccgctcagccagttcggcgcaatgccaccgccggcgccgctcttcgtgtcggtcgactccacgccacctcctgcgcttatgcccgtacaccaccccagggccccgcaatccctaagcctagtccctgcggttgcctcctccagaaaggccgccgacgttctcgcgtgccccgtagcctcctcgcgccactccgactacttctatccgcgggctccgccgtcgtcgcgcggagaccgagggtacgggcgccctaccaacggcgctcatgacgggagggtcttcacgagctacagcatctacaagggcaaggccgcgctgtcattcgatcctaggccgacgctcttcgtgccgctcgattctggggcgtacaacgtggccaaggagggcttcgtgctgctgcagttcgcgcccgccgtggccacacgacagtaccactggactctcaagcatgtgt

SEQ ID NO: 66899 - DNA, 400 bp, Zea mays
  Clone ID: LIB3076-033-Q1-K1-G8
gcgacgcgttgtcgctctcctggtgagcgttgaggccatccacaacctgtgccgagcctgagcctactattgagcggtcatgctactcatacctgacaaggcttgtgtacacggtcatgtcatgcgtgattggctgcctaatgttatactggcgtgtcaaaggccatgttaggagtatggcatgccaaactggtgccgtgccgcatgatccagtaaatgctgcctgagctacgctccagacattgtctgatgcgaacgcggacatctagcatgctcctcgtctgctgatacacacaacaggaccgttctatccagattgcatgagggccatacgcaatgccatccatgtcctgatcatagcctgctgtctaatctcatcgacgggatctggtcatgctgg

SEQ ID NO: 66900 - DNA, 473 bp, Zea mays
  Clone ID: LIB3076-033-Q1-K1-F4
tcggcaagggtattgatgcctctgatgatgttagcctcagcatctcttgtgagactatccagcttagcacgatcctgaaggtcatccggaggaatgttgtctagaagtgcgttgagctgctttttgagattgcagcgaacaaggatgactacaacaagttctatgaggccttcttcaagaacctcgagcttggcatgcacgaggactgcacgaacaggaccaatattgctgagctcctgaggtgccactcgaccaagagcggggatgagctgaccagcctcaaggattatgtgaccaggatgaaagagggccagaacgacatcttatacatcactggtgagagcaagaaagctgtggagaactccccgttccttgagaagctgaagaagagggtctatgaggtgctgatcatggtggatgccattgacgagtattctattggacagctgaaggagcttgagggcaagaagctc

SEQ ID NO: 66901 - DNA, 324 bp, Zea mays
  Clone ID: LIB3076-038-Q1-K1-E7
cggacgcgtgggattcaccatggactacctgtacccgctctcggcgtgccaggccttcgggatctgtctgaccagcttcgacaccaagccagcgtgcgaataactgaaggtagcataaaagctggggtgggtatgttcgtcctgagcgacgtgaatttcttgatcttgccatgggggcctgtgcccaggcgaaatggtcgcttgtgatggggggtgtgaagaagagctatggcatttgtaccataggaacagatttgaacgaactggactgttatatgtatcgctgttgggatgtctggctgtgaaatatcactgctgcatcgt

SEQ ID NO: 66902 - DNA, 326 bp, Zea mays
  Clone ID: LIB3076-038-Q1-K1-E8
agcaagcaaaaattccccaatcctctcgtctccgcggctaagatgtcggggcgcggcaggggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcccttaagcgccaggg

SEQ ID NO: 66903 - DNA, 305 bp, Zea mays
  Clone ID: LIB3076-038-Q1-K1-E9
cccacgcgtccgagcaaatgaaaaaaaacatagtgcatagtctagttctaattgtacctagcagtggaatcagttgttgtacaacatgaagatgggcctatttgtacaatggtcatacatgttctttgatcatatactataaacaatgtaacctcatcggccgttatttgattgtttcaaaacaaaggaaaagccttttcaaaaaaaataaatacttaataatatactatagttacaaattgtatactatacttaatcataactatgtataattcttgtgatttatatatggattttctcgattt

SEQ ID NO: 66904 - DNA, 336 bp, Zea mays
  Clone ID: LIB3076-038-Q1-K1-F1
cacaggctcctctcccccgttgcgcaacgcgctttcccccacttcacccgcctcggcgccatggctaagctcgcgctggcgctcctcctcctgctggccgtggcggcgtccgcgtcggccagcagcgggagccacctggatctcgacctgggcttcctctcctctggggaccgccggagggagtgccgcgggacggtggccgagtgcctcgccgaggagtcggatgaggagggccttgacctggccggatcccaccgtcgcgcgctctacggcggcgggtacatcagctacggcgcgctgcggcgggacaacgtgccctgctcccgccggggggcc

SEQ ID NO: 66905 - DNA, 278 bp, Zea mays
  Clone ID: LIB3076-038-Q1-K1-F10
accacacgtacgcagaacttacacatgcatttgtcaacagatcgaatctaaataagaaacggcgtcatttgctgctgattgtgcttgacaagtagagacatggatggactcttaaaattccatccatgtgttaaatgacatattcgagacatccttttctcaataaactctgcatcatttggtgaaaaaaaaaaaaaaaaatattaattaatttaaaaatataaaaaaaaataatttatcttatttctaaaaataattacaaaaatgaaccatatttt

SEQ ID NO: 66906 - DNA, 382 bp, Zea mays
  Clone ID: LIB3076-038-Q1-K1-F11
cggacgcgtgggaaaaaaaaaaaaaaaaattaaaaaaaaaaaaaaaaaaaaaaaaagaaaaagaaaaaataaaaaaaaaaaaaaaaaaaaaaaaaaaaaaaaaaaaaaaaaaaaaaaaaaaaaaaaaaaaaaaggggcccccttttaaaaagccaaaatttaacatccccgtatttgcaacttaaaatctttttaaaagggccccaaaattaaatttaatggcccgtttttaaaaaactttaaaattgaaaaacccttggtttccccaaattaaatccctttaaaaaaaatccctttttccaaatttggctaaatacaaaaaagccccaaacaaatcgcttttcaaaaaatttgccaacccaaaatggaaaatgaaaccccc

SEQ ID NO: 66907 - DNA, 360 bp, Zea mays
  Clone ID: LIB3076-038-Q1-K1-F12
cagacacttcaaagtgatcaccgtgcagctttccctatttctggagaaagccctggctagggacatctcccacaacctggcgtgcatgctgagcttcttctgcgagttacactccgagcttcaatgccacatcggacttcttcagataccggcatatcctgtctgaaatggtttgaacagctttccgttgtgcaaacttgttgtcccgaaatgacttggcacgtcctctgtaacaagcaacgtcacctcggatggtactttcatttaattcttttggtccctcttgcataaaataatattttattgttgtgaataaaaaaacgttgcaattacctatgaaaaaaaattaaaaaggtcata

SEQ ID NO: 66908 - DNA, 58 bp, Zea mays
  Clone ID: LIB3076-038-Q1-K1-F2
agaacatgctaatgacacagcgtcaaatgctgcatttatagagcatgaggttcccaaa

SEQ ID NO: 66909 - DNA, 339 bp, Zea mays
  Clone ID: LIB3076-038-Q1-K1-F3
accactgctcgaaccgcgccgacgagcgacgacaagagctgctctattcttcaaaacaaatggcgaccgttccagttaacccaaaaccttttctgaacaacctgacaggaaagcctgttattgtcaaactcaagtggggtatggagtacaagggttatcttgcttctgtggactcatatatgaatctccagcttgccaacactgaggagtacattgatggtcaattctctggaaacctgggagagattctgatcaagtgcaacaacgtcatgtatctccgaggcgttccagaggatgcagagatagaggatgcacagtgagaagatgcgatcaatgttt

SEQ ID NO: 66910 - DNA, 331 bp, Zea mays
  Clone ID: LIB3076-038-Q1-K1-F4
gatcaacccgagaccttgcaggattatcgatctgattgcggcatgatccgcttcatcctgctgcagaaccggcaggggaagactcgactggccaagtattacgtcccgctcgaggactcggaaaagcacaaggttgaatacgaggtacaccggctcgtggtcaatcgggaccctaagttcaccaacttcgtcgagtttcgcacacacaaagttatctacaggagatatgctggactgtttttttcaatatgtgtggacataactgataatgaattggcatacttggaatgcattcacttgtttgtcgagatattggaccatttctttagca

SEQ ID NO: 66911 - DNA, 312 bp, Zea mays
  Clone ID: LIB3076-038-Q1-K1-F5
ggtcactggagtccagcagttaccaaaacacattaccatcacctgttgctccaagaataagtatggtccacgaagagctcgagagcgaggattttatattcctcacaaaccttgatgggttgtgagtggctgcttaaacaagcatctggctaacagcctaacacatcaaaagggtgaccaggccagcgttggtgaccctgcagtgatgtttttttcctgggctgcaaatgagaatgatgcctgtaaaatgtgtaatctacgatagatttaaaattctgagctttgctgtctcgtaatactataatactctat

SEQ ID NO: 66912 - DNA, 215 bp, Zea mays
  Clone ID: LIB3076-038-Q1-K1-F6
cccacgcgtccggatcgaatcactagctagctgagtgtggtgttggcgtgctgcaaaagtgtaccgctagcttcggctctgggtcaatatgatgcatggtttgttaggcttagatgtttgacttggtatacgcctacctattatacgtgacgtgtgtcttgtaaatcaagctagctccgtaatccgtatgctaccttagcttctttcgtttcatc

SEQ ID NO: 66913 - DNA, 297 bp, Zea mays
  Clone ID: LIB3076-038-Q1-K1-F7
gtcagatgccaagaaatcgtgtcgcgagctatctgctatggataaggagctgggagctgggcgcttgtagaaagagcaggataacagggcaagactttttggtagttcaagcggttctgacagcagttcgcagctaccacctaacaggactttacctacgagcggctcgtctcgcaacatgtgaaggcatgtcggtattgaccgaatatggctttgatgatccttacttggattaggactggtgactgggaaggaacctctcattgttctgcagaacatggcatcagatgaagagcc

SEQ ID NO: 66914 - DNA, 344 bp, Zea mays
  unsure at all n locations
  Clone ID: LIB3076-038-Q1-K1-F8
ccactcgtccgacgaactccaaccagccctcttacattcgagctagcttatatcccggattacatctcctgatactatgggacggtttcaatgagttctgctgccttcttcaatcattatctagctaatatatgtagtgatggatatgctcacgcattcgctgattacacaaaagcaggtggttacaccatcccataatgaactgatagctgtaggagatggtcattcacgtaccatatctgatcctgcagctggtaactaccttatcagaccatttgatgaagctgnagatgaacccacttgagctagacccctttccatggtgcacatcaaattgattatat

SEQ ID NO: 66915 - DNA, 222 bp, Zea mays
  Clone ID: LIB3076-038-Q1-K1-F9
cccacgcgtccgaaaaataaaaaaaaaaatttaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaataaaatagtgaaacaaaaaaaaaatccaaatggctaataattacaaaaacgtcaacaattagaaaaccaatggaaatacctaaatt

SEQ ID NO: 66916 - DNA, 320 bp, Zea mays
  Clone ID: LIB3076-038-Q1-K1-G1
cggaataagaatggatgtggctctaactctgcttctagaccggtgatggttcagcttagaagcaggggatcttcatcatcagaataaaaacgtgtgttgttgtgttgctgtgtctacgccactagtatttctgttgttacttatgttctaggtaaactgcgcagccagagcagagctgaagaatatgtactgcttgctcgctcttgtgtggttgtgtctacccctactagcatttcagctttgttgtaggtaaactgcgaacccagagttgcagaacccgtactgctcgtttaagttcatggtgaactacgagctaaaag

SEQ ID NO: 66917 - DNA, 413 bp, Zea mays
  Clone ID: LIB3076-038-Q1-K1-G10
agcgtattgctccggggtctagctgagcccatgtcactgcgagaaatcgcaaggacatgggatgcttgcgctcgcaaagtgatcacagagtatgcccagcaaaccggaggaggcagtttcagctcgagctatggttgctgggaaagctgcgtaggcgcttgttaattgcttatattgtatctattattattattataagtatttatgtgtcgagtaaaatagaaaaaaaaacagtgtgtctgctgtatactccatccttttgctattgggtcaatgttggcttgataaatatggtcgtgtacagtacagtgtatgcgtcagtccggttagtatcatgtatgctttgcctctatttacagaacttggttttataactttttttcgtcaccttttatatctaaatattttttaat

SEQ ID NO: 66918 - DNA, 432 bp, Zea mays
  unsure at all n locations
  Clone ID: LIB3076-038-Q1-K1-G11
cttggctcaccaatcgttccaaaggaaatggcaccaacagatgtcgtagtacttggcgaggaatcgcacaacgtacatgacatgtcatttgtcatatgcatcgcaaggtccaccccgattatttcaccagatcttctttctcatgcctcaggcaacagcaatcatgtcgaggcgttgagagtatatcttctgtcaaaatctctatccagattgaagaaccagttccaaagtggaaatggcgtgattacggtcgactgcatcgaaggttatccactaatcaggttacagctaggaaagcatgtttttctaagtgcaggggatttttatctggctagtcgatcctaatttttgtgtgcagcatcccaattttgactgattcacccatcattttgccgcaatcggcttanacagcttggttccatttatgcattc

SEQ ID NO: 66919 - DNA, 413 bp, Zea mays
  Clone ID: LIB3076-038-Q1-K1-G12
ctctcattatcaatcactcagactctgttcgcgcacacatgggctatcttctagtcctaggatgcctctggatgagactacgtcatattctactccaagcacggatcttctcgtcgtctcctccaagcacggatcaggagcactgaaattctatctcaaccggttctgccgactgggtaacttgaattctaaagatgggtgtgaaggaaatgaatcttcaatattacaatagttacatccagtacctacgaagaataagggttgatccaagcacgaagtgaatgcgtgatggaatggcattctgcatttcttctaagttgatgcatgacagatcatggagaatgctggtggttgtgatagctatcacacactcttttggccaataattagatactctttttgttcagcaatgt

SEQ ID NO: 66920 - DNA, 333 bp, Zea mays
  Clone ID: LIB3076-038-Q1-K1-E6
cccacgcgtccgcccacgcgtccgcccacgcgtccgcccacgcgtccgcccacgcgtccgggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaaccttttt

SEQ ID NO: 66921 - DNA, 330 bp, Zea mays
  Clone ID: LIB3076-038-Q1-K1-C8
cccacgcgtccgattgaagattctaaatgatttgattcaaaatgaatctgaaccaaagaggaagctttatgatttgaagatccagttgattgaggagatgggatggaaccatgtctcaacctacgaaaaacagtggatgcaagtccgctttcccccatgtctgccaccattttgattgtgaactcatttttacaatggctctatcatcctgggttcagtagttgtcattttcattgctgggtgcgtcagttcattatttcgatggcaaacagccaactaggcaagctactggatttgtgcgtttggggacacagttattccatagttatt

SEQ ID NO: 66922 - DNA, 137 bp, Zea mays
  Clone ID: LIB3076-038-Q1-K1-C9
cccacgcgtccgggtttctgttagcagagttgtagctattgacaagcaacgtcctttcacggagttgctttttttcgttgatgtatggaaaacgagacattgtagaaatcgaagttcgatctagccttttatgctgc

SEQ ID NO: 66923 - DNA, 277 bp, Zea mays
  Clone ID: LIB3076-038-Q1-K1-D1
aaagatcttgtgcctatatacggctctcatggttgagctctgtctctatatgttagagctgatatatgggtggagatcaaataatggccttgcaataatatgatcaaagactcgctctgttgatgataataacatcatatatattgaggatcttttcaaactgctgaacgagactgctctcctgaccttcggcttcaatctggatgaccccaacaccttcggaaaccggatccaacgggtgctcaaactcggggttcccatctttcaagaccagcct

SEQ ID NO: 66924 - DNA, 428 bp, Zea mays
  Clone ID: LIB3076-038-Q1-K1-D10
agctttaccgagttgacacggactacaccagatatctcgtcactggtaagagaactgcccggctgaagcgttccatgcaaaagtggcacaacttctccgagagcttcatgcataaggaaggctcagaagaggaccaatatgagaaacctacatggtggcaacagcctcagaaacttgtgcatcttatggaggagctctgcaggggaaactggcgttcccatgcccaggagtcgtagttgatggtgtaccatcacgcccctctttatttactttgacccattgcagaatgcaaaatacgaacgtgggctggtgcagaggagtaaggtcacctggaccagtggactctttagggctctttatcgggtatttgtctctgggttcttaaaagtatgtagagagtgaatgaattcccggcatttttgcaaatg

SEQ ID NO: 66925 - DNA, 216 bp, Zea mays
  Clone ID: LIB3076-038-Q1-K1-D11
accaccaccatcgtcgctgccaacagcgactacaagaagtactaataattttgcaagtaggctgtgtctgtgcaacacccagcgtactcttatctaagttggagttgtatcgtgtccgtgcgttatcctcatatgctgagtgtctgcaggagtatgttaatcatcatcctggtgttattatcgtaccttgctaccagtgaaaaaaaaaaattaaat

SEQ ID NO: 66926 - DNA, 287 bp, Zea mays
  Clone ID: LIB3076-038-Q1-K1-D12
gcagggctccgaggtcccagggtactgaccccccctgtcctcgtcacgtcagcgctgttggggggcttcgacacgctgtctgtctgctgcttccggcacacagcaatattttctatatttgtttctcggttcttgctgttgcctgctggtactaatagtatactgcgtataggttgtgggagtggccggtgatctgatctctgtgctggttgcattatgtgagtagttttatcgtacctgatatgtctccttgatactcaattggtatgtatataaaaggattttta

SEQ ID NO: 66927 - DNA, 337 bp, Zea mays
  Clone ID: LIB3076-038-Q1-K1-D3
ctcaggttcatcccgttcggctccggccggaggatctgccccgggatgaacttcggattggcgaccatggagatcatgctggccaatctcatgtaccattttgattgggaggttccgggctctgcagcaggggtgtccatggacgagtcctttgggctgacgcttcgccggaaggagaagcttctccttgttccaaggattgcttcctgataatcctacatctgtaaaacttgtgtcttgctagctgtaccgggaacaagattaaataatgcaaggaataaagtgactctgttcttcgtcagtaactatatattgtaggagtcctgatgatgaataa

SEQ ID NO: 66928 - DNA, 255 bp, Zea mays
  Clone ID: LIB3076-038-Q1-K1-D4
caaggtgctgaagcaggtgcacccggacattggcatctcctccaaggccatgtccatcatgaactccttcattaacgatatcttcgagaagctcgctgctgaggccgccaagctcgcgcgctataacaagaagcctaccatcacctcccgtgagatccagacctccgtgcgcctcgtccttcccggggagctcgccaagcacgccgtctccgagggcaccaaggccgtcaccaagttcacctcggcctaggctgc

SEQ ID NO: 66929 - DNA, 298 bp, Zea mays
  Clone ID: LIB3076-038-Q1-K1-D5
gctccctcctcctctccgctccgaatggcccgcacgaagcagacggcgcgcaggtcgacgggcggcaaggctccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatccgcaagctccccttccagcgcctcgtccgtgagatcgcgcaagacttcaagacggacctgcggttccagtcctcggccgtggcgg

SEQ ID NO: 66930 - DNA, 301 bp, Zea mays
  Clone ID: LIB3076-038-Q1-K1-D6
cccacgcgtccgggggcgggatgaaataatcgacgctctccgtgacggtcagacagaacgcgacactgtacgtcctggagaagctttcgcggctccacatctccaaggaagaagagtccaccatcttgaggttctccggggaccccgacaggctcgcccccacggaggccttcctactacgcctcctcctcgacgtgcccaatccgatcgcgcgcgtcaatgcgctgcttttcaaggtgaactacggtgcggatgtcgcgcagctcaagcactcgcttctgacgttggaattagctagcca

SEQ ID NO: 66931 - DNA, 201 bp, Zea mays
  Clone ID: LIB3076-038-Q1-K1-D7
gagctggtggctatcgggaggcagtggatgacggcctccaggcccaaaggcgcggctgctcacagcaagatctgaactgaagcttcttccttccttccttccttgggtttcctttcctacctcgaaaactactgctctcgagtgaattgaactggctgtaattactaattactggggaaaaacacggtttaggttgctgtg

SEQ ID NO: 66932 - DNA, 289 bp, Zea mays
  Clone ID: LIB3076-038-Q1-K1-D8
ccaggttatgagtaccagaactgtctacttgtttcttccataataacaaacggggcagctgtatttgtactcaaaaaaaaaaaaaaaaaaaaaaaaaaaataaaaaaaaaaaaaaaaaaaaataaaaaaaaaaaaaaaaaaaaaaaaaaaaaaaaaaaaaaaaaaacaaaaaaaataaaaaaaaaaaaaatgggagactactataaaggaccaaacctattaaccacggtaatgaaatgtaaaagacatttaaaagggtactcaaaatgaaattaactggcacaagttt

SEQ ID NO: 66933 - DNA, 334 bp, Zea mays
  unsure at all n locations
  Clone ID: LIB3076-038-Q1-K1-E1
aggaaacccacttattccgcgtgggtcaccagcatctcttcgaatttgaatcaagtaaagtgtcaaagagaaaacttgttctggggactgttcactgaacttagcagattatgcatctgctagataatcctaccattgtctgtgcctagcagtgcaacagacctggtcccatcactccatgtatgcctcttatcaaatatatggctccatgtattgggctatcaagatttattttggcttgtggttcttgttagataactacattatgtgacatttagtgttatnttctctttccagcttactttaagcctggcagaagtaagagtatctcaac

SEQ ID NO: 66934 - DNA, 345 bp, Zea mays
  Clone ID: LIB3076-038-Q1-K1-E10
atcacatattatgagagtgtgctggatggaaagcggaggactgctgcaaggctggtgcgccgtgacgatcctatacctttgcgttgtatgttaataatctgctaacgactgcaattctagagattcatttaccgtaaaattgtgaccgctgtagatgactctcgatttaacactgagaccattcatatgaaacagtgctccctctctttttggactacaaaattttggcacatagcaggtgtacaaggttaaaccttttaaaactttcatctatggggttcgtgatagagtagccatgtttacgggctcgtcttgatcacttgtgctactgcaacatttggtcct

SEQ ID NO: 66935 - DNA, 373 bp, Zea mays
  Clone ID: LIB3076-038-Q1-K1-E11
cgcctacgtcgagacacgtgctctctaggtgtacgactttgggcacgtgctgtagggccttgcgacgaacctgattgtggagaccgccctaaaggtgatagagtgcgaacagatgttcctccaaatgtgcatgatgtcagtcttccggggctctgcgaagctcatcgacaaacatagggcgctgtttttgcagcactacttaccatggtcaacacaagctggtctcacgtgtactgatctgatgtctgtatattacgataagcactttcacgaagacctgcatgaagagagaaggaactgatgaatcctttcttgccctagtcccaaaaagagcactgtatatgacggcattgtctgcgtgaactatctatct

SEQ ID NO: 66936 - DNA, 439 bp, Zea mays
  Clone ID: LIB3076-038-Q1-K1-E12
gacaatcaatcctatgcattgcatcttgctgaacggagaaagaacagcaatgcggaagttgggtccaacacagcagtacccggaaggtctcgattttgacgatatacagcgcgaccgggagtgcgtcatgtgcttgagcgaggagatgtccgtggtgttcctcccctgcgcccaccaggtcgtctgtgccaaatgcagcgacctccatgagaagcaaggtatgaaggaatgcccttcgtgccgggcctccatccagcgcagggtgcgcgcccggccagacggttgctagatttcacatataccatttggattttacttttcttctttctttcaccttgattgctcagcttaagttgatggaagattggagggaataatcatgtggtgtgagtggttgaaactgtgacaataatacatcgtttaacacctaacaagcccc

SEQ ID NO: 66937 - DNA, 335 bp, Zea mays
  Clone ID: LIB3076-038-Q1-K1-E2
gcggcggcggcggacgcgcagccgcggcgcggtaccacagcgcggcggccgtcgcgctggcggagcggatgtattcgtcgtcgacgacggcgtcgttcatcccagcagcgcggcagcagctcttcagcttgccgccattgcacccgcagagctccccgccgtcctcggagacgacgccgccgtcggtcgttagctcggtgactactacatcttttcagcgtgctaacgacggcgacgagctgtggcggacaggcacaggctacggctccggggtgtccgtggcgcagtcgacgtcaacgccaccatcagtgccttcgacggtcgtttcggatcag

SEQ ID NO: 66938 - DNA, 299 bp, Zea mays
  Clone ID: LIB3076-038-Q1-K1-E3
ctcgtgcgattacagccaatcttgaagagatgaaatcgcccactaagctttctggggcaagtggagacgccagtcgtgagggatcagaagatactgcacgccgtcctccttcagtgaaagcttctatggcagtttcctttggacagcgagctgcacatcgggcttccaccagggattcatctgcagctcgtcgaacagtcacccgtgatggtcatcgaagttcatactgaccatctcgccgtagtggaagccgtgagggtcctgatcatgaccgctctgaccgggaactggatcattct

SEQ ID NO: 66939 - DNA, 331 bp, Zea mays
  Clone ID: LIB3076-038-Q1-K1-E4
cccacgcgtccgcagttttccttctatgatgattacaagtcacctagagaattctcaattgcccttgtgtgatggttgaactgtctaacttgtctgcaatccatgaagttggacatgacggtcttcatacagtacttgagatgacagatgcattccctatgcaacgaagtactcttgacgttccccatcaatttaagcatcttgggctttatattggatgcagttggcttgaagtaaatttaatctttgttgcaggccttcgatgaggcgatctctgagctagacagcctgagagaggagtcctacaaggacagcactctgatcatgcaac

SEQ ID NO: 66940 - DNA, 328 bp, Zea mays
  Clone ID: LIB3076-038-Q1-K1-C7
cggacgcgtggggccctgagggactcgagcatggcgggctacatgtcgagcaaaaagacgatggagatcaacccagagaaccctatcatggatgagctccgcaagcgtgccgaggctgacaagaatgacaagtcagtcaaggatctcgtgatgctgctgttcgagactgctctcctgacctccggcttcagcctggatgaccccaacaccttcggcaaccggatccaccgcatgctcaaactcggtctgagcatcgatgaggacgagcctgttgaggcagaggctgagatgcctcagcttgaggacgacgctggtgaaagcaagatgg

SEQ ID NO: 66941 - DNA, 331 bp, Zea mays
  Clone ID: LIB3076-038-Q1-K1-E5
ggaaatgtctgtcttgggcttctcaacggaacggagattaatcatgggtcagcgatcatggtaagagatgtttctctgcgcggcaagttggttgtgtacgacaatcaacggaagcagattggatgggcagattcagactgcaccaaacctcaatcacaaaagggctttcctttcttcctctgacgaagcatcactcgctacataatacatgtgtaaagcgtaaatagtgaacgccattgtattgtagaatacattattaagtggagactgcctttgtgtatgggtatatcgttccattggaactgtcagaaatccttcactgtgttgtacc

SEQ ID NO: 66942 - DNA, 321 bp, Zea mays
  Clone ID: LIB3076-038-Q1-K1-A6
tccttcctttggcaaatccttggtggcaagcaagaaaaggctggttggagatgtggaagggcaacttgagccagataaaaacgatgatggggtgcaagcaacgcagcagcagctagagctcacaaaagagaacactgaagcaagagcttcaacatgttccaccttccaagagcttcaacatgttctgctccggtggctcaagaggcaagcgtcgcacccgccccgattttgattccaaggacgaatacaacattcccgccggactagcgatcaccgtaccttctgtgcctcgaggtggagccgcccgtctgcgactcgcgc

SEQ ID NO: 66943 - DNA, 329 bp, Zea mays
  Clone ID: LIB3076-038-Q1-K1-A7
gcaaggtctacttgtgtgagaaactgtctctcactaatgagatgtattttgccattaccgttgataggaaaactgctggtccgctcattattgcttgcagcaagggaggaaccagtattgaagatcttgcggagaagtatcctgatatgattatcaaggttcctgttgatgtatttaaaggaataacagacgaggatgcagctaaagttgttgatggtctagctctaaagtcagcggataggcagtcttctatagaacagattaagaaactgtatgaacttttctgcaagtctgattgcacattgctggagataaatcctctggcggag

SEQ ID NO: 66944 - DNA, 294 bp, Zea mays
  Clone ID: LIB3076-038-Q1-K1-A8
gatgctattgacactcctctaagccgcacctgatggattctatctttatccaggcattgggccgtcttggaaatgcacttactacgattacgtcaccactatctcttcgcatttgaatcatgtacaatgtcaaagagaaaccttgtcctcaggactgttcactgaacttagcatattatgcatttgcttaatcatcctaccattgtatgtgcctagcaagcccccatacctggtcccatacactccatcttactttaagcctgtcagaagtcacagtatctcaacatgaacctg

SEQ ID NO: 66945 - DNA, 208 bp, Zea mays
  Clone ID: LIB3076-038-Q1-K1-A9
acccttccgaattcccttgccgtccttgttgattggcctaagctttcccggcaaccaaacccggatggggttgaaaatgaagaacggcgacaaaatcaacccactccttaacaaaaccgaaggcatcgttcttagaacaacttaaaaccttcgtttggttttcggtcttccttattataaaccaaatggaaaaaatctttttaaagga

SEQ ID NO: 66946 - DNA, 436 bp, Zea mays
  Clone ID: LIB3076-038-Q1-K1-B10
cacgccgccactgatctgctctgttgctggtgactaggagcagtagcgagagggattctggatggccaagtcgaagaaccacacggcgcataaccaatcgttcaaggcgcacaagaacggcatcaagaagcccaagcgccaccgccagaccttcaccaaggggatggacccgaagtttctgaggaacttgaggtactcaaggaagggcaacaagaagagtggcgaggctgagtccgaggagtaagatgatggtgattgagtttgtggcgacaaatgcatctcttgtatcgctaagagtcttagctgtgaacttagttctcacttctgtgtgactgtgatcaaaggagatccatcagttggtaccgaagtgtattttatgtcttgttggttacctggaatttaattaaaaccatcagttgtatccttttgagaattg

SEQ ID NO: 66947 - DNA, 330 bp, Zea mays
  Clone ID: LIB3076-038-Q1-K1-B12
cggacgcgtgggaaaaaaaaaaaaaaaaaaaaaaaaaaaaaaaaaaaaaaaaaagaggaaaggaaaaaaaaaaaaaaggaaaaggaaaaaaaaaaaaaaaaaaaaaaaaaaaaaaaaaaaaaaaaaaaaaaaaaaaaaaaaaaaaaaaaaaaaaaacaacaaaaaaaaaaaaaaacaaaaagaaaaataaaaacgagatatacaaaaaaaaaaaaaaacaaaaaaaataaaataagaaaaaaaaaaaaaaaaaaaagaaaggaaaaaaaaaaaaaaaaacaaaaaaaacaaataaaaaaagagacacaagaaaaaaaaagaggaatgaac

SEQ ID NO: 66948 - DNA, 242 bp, Zea mays
  Clone ID: LIB3076-038-Q1-K1-B2
atacttcaagaagtgagtgagaagttaggcgacaaaattcaagttgtgaaaattgatactgagaagtgcactagcattgcaagtcgttacagaattgaagcattgccaacttttatcatattcaaggatgggaaaccttgttatcgctttgagggagcattacctgttgaccagatgatcgaacagattgaaaatgctttggcagtcacaaagtagcacatatggtgatgagcagggcagaa

SEQ ID NO: 66949 - DNA, 308 bp, Zea mays
  Clone ID: LIB3076-038-Q1-K1-B3
acccactcgtccgacgcctcctgccacacatacgaccactcgttctcccactcgtacggctacttaattattagagagacccttgtcatatttattatgctatttgcgttgtaactttatgattttttttttatgtacctgtatgccttttatactcttgtacataaactactagttttagttcgtttatactgtccattctgtatttttgatgtatcatctctcaactctgccactgctacaccaacttatttcatgtataagtgtactaatacatggtcatcatcatgatacattccttatattct

SEQ ID NO: 66950 - DNA, 309 bp, Zea mays
  Clone ID: LIB3076-038-Q1-K1-B4
gtttcggcgatgtcggggcgcggcaagggcggcaaggggctgggcaagggcggcgccaagcgccaccgcaaggtgctgcgcgacaacatccagggcatcacgaagccggcgatccgtatgctggccaggaggggcggcgtcaagcgcatttctgggctcatctacgaggagacccgcggcgtgctcaagatctttctcgagaacgtcatccgcgacgccgtcacctacaccgagcacgcccgccgcaagaccgtcaccgtcatggatgtctgctacgcgctcaagcgccatggccgcacgctctacggc

SEQ ID NO: 66951 - DNA, 314 bp, Zea mays
  unsure at all n locations
  Clone ID: LIB3076-038-Q1-K1-B5
cccacgcgtccgcccacgcgttcgcccactcgtccggctccttagttatgaagcaccccggtcatgagaatcaggctatttacgttgtaactttaggattttttttttatgtacctgtaggccttttagactcttgtacataagcttctagttttagttcgtttatacggcccatcctgtagttttgatgtagcagctctcagctctgccactgctacaccaacttatggcatgtataagtgtactaatacatggtcatcagcatgatacattctttagatgcttggtcaatnttttagatgcttggtggtggc

SEQ ID NO: 66952 - DNA, 74 bp, Zea mays
  Clone ID: LIB3076-038-Q1-K1-B7
cccacgcgtccgcccacgcgtccgcccactcgtccgcccacgcgtccgaccacgcgttcggccacgcgtccgat

SEQ ID NO: 66953 - DNA, 326 bp, Zea mays
  Clone ID: LIB3076-038-Q1-K1-B8
cccacgcgtccgcccacgcgtccggttcaatctcgagaagcctgttcttgttgatgttgagcaactgaagaaggagaagttctctactcggcttcatctccgtctctgtcttgatggaggttaccatgttcttgacgagtctacaaactacagcagtgacctgagaccaactgccaagcaactctggaagccgtctattggtttgcttgaacttggtgtccttggtgctcaagggattgttcccatgaaaactcgagatggaaaaggttcatcagacacctattgtgttgctaagtatgggtcgaaatgggtaaggacacggacca

SEQ ID NO: 66954 - DNA, 272 bp, Zea mays
  Clone ID: LIB3076-038-Q1-K1-C1
cgtgaccgtggtcacatgcatgagagggattcagactatggcaatggtgggacaaagcaggacaaagagctgtctagttaggggcaggattatggctatggtcagtatgagcaacacaaaggtcatgatgcatatggttacagtcaagatgtacgtggacatgaaactgaacactcaaagcggcatgagcacgaatattatcgagttgactcgtatggtaaaatggaagcctacaatcagatgccgtcaaacaatgctgagccagaaggccc

SEQ ID NO: 66955 - DNA, 430 bp, Zea mays
  Clone ID: LIB3076-038-Q1-K1-C10
cccacgcgtccgcccacgcgtccgaaaaaaaaaaaaaaaaaaaaaaaaaaaaaaaagaaaaaggaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggtacattaaaaaagaccaaagtacacgtacatgcaacgtaaaagctaaactatagagaaaggaaaactaaattaaatacaaaggacagcacaacaaaaaagactggaaaagaaaaaacctggcgtaaccaaatgcaaattgattagaataaaactccctataccaaactgggaataaaataaaaaagcaccaaacgaagacccaacaaaaaaatcagccagactgaaaaggaaaagggaccccccatt

SEQ ID NO: 66956 - DNA, 314 bp, Zea mays
  Clone ID: LIB3076-038-Q1-K1-C2
gagagggctaagaatgatcgcatgagtggccgtgagttgttcatggctgacgcaagtgtgtttgttggtgattctgtatcatatggagtatatcagagagaggagtctgaggccaatgaagaatcgaccaataaaagtcagaatccagtgccaagttcatcaacatctaatggcaaggaggttgacgagcctgacaaccatgatatcgatgatgacgatgacttatacattgatgaattgaatgaacttgaagcaagcctgtcgagaacttccatccaaattcgagagcctggctagggaacatcatcttgatc

SEQ ID NO: 66957 - DNA, 337 bp, Zea mays
  Clone ID: LIB3076-038-Q1-K1-C3
atccaccccgtggacatcctcctcatgctggcagcctccgagggcgaccgccccaagatggaggagctgctccgcgccggcgccaggttcgacgtcaaggacgtcgacggccggacggcgctcgaccgggccaccgacgagaccagagagttcatcctcggcttcgccgccaagaaggcctgaacgaccatgtgcaggtcaatcgtgcccggttcttctggacatttggctgcatgtaactaaattcttcgttttctggaattggtggagtgttcaaccgggggtgaacaagctgtttgcagaggtagctttccgtagtcagctgtattcttactga

SEQ ID NO: 66958 - DNA, 336 bp, Zea mays
  Clone ID: LIB3076-038-Q1-K1-C4
acattcgttccccttctcgcctccacgagccttcacaaattgccctctcagctcttctcggaatctcgctctagccctagccaaatgccagacccatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaacgagcagaagctcaaggtcaagaaagcgatcgagaagggcaacatggactgcgcccgcatctacgccgagaacgccattcgcaagcgcaacgagcacatgaact

SEQ ID NO: 66959 - DNA, 286 bp, Zea mays
  Clone ID: LIB3076-038-Q1-K1-C5
gtcatggacatcaaccagatccgcgagattctaccgcacaggttcccatacggtttggttgatagagtaattgaatacaaggctggagaatatgctgtggggatcaagaatgttacaataaatgataatttcttaccaggacatttttctgaacgccccataatgcctggggtccatatggtctatgctatggcccaggttgcgggtctggtgatgactcaacctgatattggtggatctctagacaacttaattttcgccgggattgacaaagttaggatcaaga

SEQ ID NO: 66960 - DNA, 329 bp, Zea mays
  Clone ID: LIB3076-038-Q1-K1-C6
cactgagagagaagaatcatgtctctggtgtttctacctgcgtggtgtctccccttcaaggtgtgccctcttccctgtggttctccctgattctcacagcgaaaacagtaggggaagccctaaacaaaccagttcttgaggcatttggcaatgcaaaaactatcaggaacaattcaagtcgttttggaattttttgttgagattcagtttgatgcaaatgggaagatatcaggagctgctataagggcctatcttgttgaaagatcccgtgtctgtcaaatatctgatccagaaagaaactaccactgcttttgcatgctctgttctgc

SEQ ID NO: 66961 - DNA, 329 bp, Zea mays
  Clone ID: LIB3076-038-Q1-K1-A4
gtgtcatcggaagtctgaggccggcagggacaccgtttatcctgtcaatgcaattgctttgcatcccgtatatggaacatttgccaccggagggtgtgatggatttgtgaatgtgtgggatggcattaacaagaaaagactatatcagtactcgaagtacgcatcaagcatcgctgctctatcattcagtaaggatgggcatctgcttgctgtggcatccagctacacttatgaagagggagaaagaacgcatgaacctgacgctatatttatccggacagtgaatgaagtcgaagtgaagcccaaacccaaggcattgagcagccccc

SEQ ID NO: 66962 - DNA, 417 bp, Zea mays
  Clone ID: LIB3076-037-Q1-K1-G11
gtcaagcatatttgatgccaaggctggtatcggactgagctcttctttcatgaagctcgtgtcttggtatgacaactagtggggctacagcaaccgggttctggatctgatcgcccacatggccctcgtcagcgcctccgccaagctctgacgtccgtgctcggtcctccagtagtagcctacgagaaaggctgcaattttgacggccattttatgctagctgttgtgtggaataaagatcaaatgctggaacacttataactcgcgcgagactggactcagatccatgggctgtattttagatgtagaagggggcaaatttgcaccgtactaccatggcatggctatatgcggaactgtcgattgatgagtccttgtacagtttgtcgacttgatgatatgttgatttgggagccc

SEQ ID NO: 66963 - DNA, 180 bp, Zea mays
  Clone ID: LIB3076-037-Q1-K1-G3
acgcacgcgtctcgcctccgccgacgccgcttcacccttcacctcgctccatttcatatctgcgatatgacgaaactcactaggaactcaggacttgctgacacatatagacccaggtatcatactcacttgcgtatacgaatcaagaacattgaagcatctcagcattccaagtacttt

SEQ ID NO: 66964 - DNA, 269 bp, Zea mays
  Clone ID: LIB3076-037-Q1-K1-G4
atgcgatgatatatttgaatttgaggacatgtgttttgtccaaattgaatatgaaagacttacagggttcgagccaaattcgcatacgaagctccttaatgatatagccaaatctaccaagacttaccaaaaggtggaaacttccactttaaatgaggttacacttaattgatattgcaataatattcagacaatgcttcatgtctatcatgtacaggaacctaaaagtcatgaaagtgtgcaaatcccatattctgaagaaatattat

SEQ ID NO: 66965 - DNA, 430 bp, Zea mays
  Clone ID: LIB3076-037-Q1-K1-G5
cggacgcgtgggcggacgcgtgggccgaggccaaggttccctcgtgccttctggaggcggcgcctacgccttcccgccctcctccaagtccaatgcctcgcggccaccggccccgacgcgcccgcgccgcggtggcacgcggcactgtccgccgcggcggggctgtacccggcctacgtcgcagccggcgcctgcgtggccttcacgcggtccgaggcgttccggtggttcgtggcgctggcgcctgggtcctacaccgctacgctcggctttatcatgctcgccatgggccttacgctccaacttagggacttcgacgccctactacgcgacaggcccctcgacattttgatccggtgtgccgaccaatacagcataatgcctggtgttggcgctatcattagccacgcgctggggctttccccgttgc

SEQ ID NO: 66966 - DNA, 434 bp, Zea mays
  Clone ID: LIB3076-037-Q1-K1-G6
cggacgcgtggggccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgtcgcctgagggagcagactgaagcatgatatagctctttatattattggggtttcctgtagttgctcttgtcaggcatgtttgtgggggccttatctagtggaaatgtggaatcactg

SEQ ID NO: 66967 - DNA, 418 bp, Zea mays
  Clone ID: LIB3076-037-Q1-K1-G7
cccacgcgtccgcccacgcgtccgagttgctgtgcccccaccagggaagatcgcgagtcaaagaaaagagcgtttggaacagaactcactaacattgacatgcatacaagtaatctagattcaaaaaataagaagaaagcaaaacttgtacagagtggtggtgatgtcttgacgaattgcaaattagctgtgcgtagtcggctggggcagggtaaacaaagtggctttgtttatggtcctttccacccttctggcgcaaggaaacatggacttgatggcggcaataagcctgggcaaagggagagggctgaggactgggagagcctttctgcttcatttcgaccacagtaccagaaccaagcactcagtgatctatttgtccattatgtcgacgcgtggaagacatggtattctgaat

SEQ ID NO: 66968 - DNA, 453 bp, Zea mays
  Clone ID: LIB3076-037-Q1-K1-G8
atgatatagttgaatttgaggacatgtgtgatgtccaaattgaagaggaaagagttacagagttccaaccaaaggcgcaaacgaagctccttaaggaaatagccaaatctcggaagactaaccaaaaggtggaaacttccactgtagatgtggttacacaaaatggaaagggcaataatattcagacaaggctccatggcgatcaggtacaggatcctaaaagtcatgaaagtgtgcagatcccagattctgaagaattattagcaactgataatagtaaaggttgcaatttagctaaactcaacaatgtccttgaagagtcagtccaagaggaaacaatagctaagtttcgttctgatttgcaaccaaagcccaggaaggcttcatcccatgttgctgtgattaaaattaatggtgctgcttgtgctccaatagttggagtttgtgacagcc

SEQ ID NO: 66969 - DNA, 423 bp, Zea mays
  Clone ID: LIB3076-037-Q1-K1-G9
gcacctccaatcccctcgcccccacggaccctcgccgccggggaagcgccgctcgctcaggaggacagccatggcgccggagccggaggatgatattatgaacgagaagaatccccgcccgctcgacgaggacgacatcgcgctcctcaagacctatgggcttgggccgtactctactagcattaagaaggtcgagaaggagatcaaggaaatggccaagaaaatcaatgacctttggggtataaaagagtctgatacagggttggctccacctagccagtgggatttggtttcagataaacagatgatgcaagaagaacaaccgttacaagtggcaaggtgtacaaagatcataagctctaatacggatgatgctaaatatgttataaatgtaaaacaaattgcaaagtttgttgttggact

SEQ ID NO: 66970 - DNA, 263 bp, Zea mays
  Clone ID: LIB3076-037-Q1-K1-H1
cccacgcgttcgcccacgcgttctagttgctgtgcccccaccattgaagatcgcgtcaaaggaaatagcgtttggaacagaactcactaacattgacatgcatacaagtaatctagattcaaaaaataagaagaaagcaaaacttgtacagagtggtggtgatttcttgacgaatttcaaattatctgagcgtagtctgcttttgcattggtaacaaaatggcttctgatatggtccttttcacccttatttcgcaaggaaac

SEQ ID NO: 66971 - DNA, 263 bp, Zea mays
  Clone ID: LIB3076-037-Q1-K1-H12
tcgatgagatctgcaagtacctttttatgaggtcgtgctggatgccaagaatgactgcaaccgagctaatcacccggagggggatgtgcccaaccttcatgtgatcaagctcatgcagagctttaagttcaacgagtatgttacggagaccttatactggcagtactactactggtatctcaccaacgatggcattgatcacctactcaactacctgaaccttccgtctgagatcgtgcctgccacgctcaacaagtctgtca

SEQ ID NO: 66972 - DNA, 271 bp, Zea mays
  Clone ID: LIB3076-037-Q1-K1-H2
ttgcaatcatatatttgaattttatgacatttgttatgtccatattgaataggaaagaattacaagattccagccaaattctcatacgaaacttcttatttaaatagccaaatctcgtatgactaaccaaaaagttgtaacttccactgtatattttgttacacaaaatttaaatgtcaataatatttatacaaagctccatttctatcatttacatcatcctaaaattcattataatgttcatatcccatattcttaataattattatca

SEQ ID NO: 66973 - DNA, 279 bp, Zea mays
  Clone ID: LIB3076-037-Q1-K1-H3
aaaaatgcacagagtaaaggccaaatctcatgagattccccgcctgacccttcacatttcgtgagaagtggatcttcccctggatctaatttcactgggaaacttgatgataatcacaacatagtgacatctgcagctgcatcaggggcacaggatcaggcagaaaccgaccacatggctagcggatgctacagatcagcagaaactacggcgaattttacaaataatgctatgtctcagtcccaacctcaatggaccggtccgtcccctgtggatgac

SEQ ID NO: 66974 - DNA, 431 bp, Zea mays
  Clone ID: LIB3076-037-Q1-K1-H5
cccacgcgtccggagagagcatcacatgacccgaagtcagtgatcacaacatatgaaggagggcataaccatgaagtgcctgcttccaggaatgcaagccatgagatgtctgcagctcccatgaagccggtggtgcatcctattaacagcagcatgccaggctttggtggcatgatgagaaccatgcgatgccagggccttcaacaatcaatattctcaggcagccgaaagtgacaccatcagtcttgaccttggtgtaggtatcagccctaaccacagcgatgcaacaaaccagatgcaggcctcagttccagaacctatgcagtatcagatgcgacacatggctcctgtgtacggaagcatgggacttccaggaatgcctgtgccagcaatacctggcagaatgtacggttccagagaataaaaaggaa

SEQ ID NO: 66975 - DNA, 427 bp, Zea mays
  Clone ID: LIB3076-037-Q1-K1-H8
cccacgcgtccgcccacgcgtccgggctctcctcattaatgagaagtttacttgtagagaggtgatgtgggcattctccatttatttggaagctgtcgcgatatttccacaacttgtgttgctacagcggacaaggaatattgacaacctgactggccaatatgtcttcttcttgggtgcctaccgtgtgctttatatccttaactggatttaccgatacttcactgagccccattttgtccactggataagttggatggcaggaatagtgcaaactctgttgtatgctgacttcttcttttattacataatgagctggaagaacaatgtgaagctagagctgccagcttaaggttgctgctcctgtccccaagatatagtagggtaatatatcagataggcaggccccatacacagcatgatcatt

SEQ ID NO: 66976 - DNA, 392 bp, Zea mays
  Clone ID: LIB3076-037-Q1-K1-H9
gtgttggcttcttctacccctccggttcgggttcgggttcgtgaggttctccggggttcggtttcgtgggtgagcggatcgagatggcggcgtcggatgttgagtaccgctgcttcgtcggcggcctcgcctgggccacggacgaccactacctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggctgcgggtacagtggtggccgtgga

SEQ ID NO: 66977 - DNA, 422 bp, Zea mays
  Clone ID: LIB3076-038-Q1-K1-A10
cccacgcgtccgctgggttcgctgaagccgacctattcgccgtggtcttgcaaaggctgggagagcttgaagagacggtccagatgcttcaagaaaagccttctgaaatgccttgcgagaaagaagagttgcttaacgctgctgtgcgtcgtgtggatgcattggaagctgaactaattgtaacaaagaaggctttgcacgatgctcttatcaggcaagatgaactgctcgcgaacatcgacagcaaggagattgccagggctcagagaaagaagaaaacaatgttctgctactaggacaacacctgcttccgtgaggagatgacaaacgcggcggacccattcattttactgacacttgtgaatcaacaggtttccgttgtaaatcaacaaaattctggcataaataaaatgttttttttt

SEQ ID NO: 66978 - DNA, 383 bp, Zea mays
  Clone ID: LIB3076-038-Q1-K1-A12
cccacgcgtccggcagcagatcctcgtgcaaagcaaagcgctagccttcctactgtcccgggggcccgcacgaagcagacggcgaggaagtccactggcggcaaggcgcctaggaagcagctggccacgaaggcggctcgcaagtctgccccggctaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggatttcaagaccgaccttcgcttccagagctccgccgtcgccgcgctgcaagaggcgtccgaggcctaccttgtcgggctcttcgaggacac

SEQ ID NO: 66979 - DNA, 428 bp, Zea mays
  Clone ID: LIB3076-037-Q1-K1-G10
gggaggatgagggcgatcacccctacacacagtacttcgaaaacgctcgtaagggcaaatgtccaggcagatctgctactcagaacgagcacagaactggagatccggaagcgctcttcaaagaagacacgacgccatcagctaaagcttctcccctgcggactgggtcggaggatcctgtggcgccaaagcccaaggacgcggcctttgctagaggcaagccgtatgctgagccagcaacccataaacacggtgctaataccagctatgaaagaaaaaccggcacggagagatcgcctctgcatcctcaccaccaagcaaggctcgtaaacagaggaggtgtttcgtctccttcatgggaacgcacgggttcgtcagaaggaaaccgtggagctgcgcccaccacacctgggaggtcgtccaagatg

SEQ ID NO: 66980 - DNA, 260 bp, Zea mays
  Clone ID: LIB3076-037-Q1-K1-D9
gcactacgttatattgtctaactacgtccttgctctttatgatggcaacaactgaactgagtgctggtctgatgcttctattgccatacccaatcatgtactaacttatgctaacaattattataccatgaatcacttgtttgaaagagacttcatcacgtaatcacatcataacgtaatttaactttaccaaaatatttatgacaatcatcctaaacttagaccctagacataatatccaacttatgcacaatcatgct

SEQ ID NO: 66981 - DNA, 376 bp, Zea mays
  Clone ID: LIB3076-037-Q1-K1-E12
gcctccactcctcgcgccgctgccgcatctcctctacaggtaagaaggagagaaagagggcgaaatggtgaagcacaacaacgtcatgcccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctgtggatcaccggcgcaagaacaaa

SEQ ID NO: 66982 - DNA, 409 bp, Zea mays
  Clone ID: LIB3076-037-Q1-K1-E2
gcgccagcacggcgaccaaccctctcccaacccgactagtcggactcgcagctccgccccaaagggcagggcgaagcatggaagtcgcggcggcgtcggcgaggcccgtcctgcgcgtggctgccatctgcggctccctccgcaaggcctccttcaaccgcggcctcctccgcgccgccgcggaggtgtgcgaggactccatcccggggctccgcatcgacgagctcgacatctccgacctgcccatcatcaacaccgacctcgagaccggcagcggcagcggcaccgtcttcccgcccgccgtcgaggccttccgcgccaaagtctggcaggccgactgcttccttcttcgcgcgcccgagtacaactacttcatcggcaccccccttgaaaaacgcgcttgactggg

SEQ ID NO: 66983 - DNA, 448 bp, Zea mays
  Clone ID: LIB3076-037-Q1-K1-E3
cgcggctcccgctcccacactcgcctccctcatcagtggcagctagtagcggcagcacccgcagctcgcaggagagagagagagagagagagagagagagagagcagccatgaaccacggaggcggagccgacaacggtgtgagccccggcaacgtcccggtgtgctactacggcgcggcggggcgcgtgccggcggcgctggagcggcgggtgcgcgccgcggagctgttcatgcggtgcgcggcgtgcgggctcgcggtgctcgccgcggcgctgctgggcgccgaccgtcagacccgcaccttcttctccgtggagaaggcggcccggttcaccgacatgcaagcgctcgtattcctggtgatagcaaacgggatggcagcgtgctacagcctgctgcaaggcgggaggtgcctggtgagcatcctcacaggtgggggcgtacta

SEQ ID NO: 66984 - DNA, 441 bp, Zea mays
  unsure at all n locations
  Clone ID: LIB3076-037-Q1-K1-E5
cggacgcgtgggcggacgcgtggggggcagctggacatgagattggaacaggaacattcgtgggactggttcctttatagctcctctccggcagcaactgagggtcctccctgccagaaatgtgggcacctagtcaagtccgatggggtcatcacctcttgcctcgattgcttcttagatgggggcagcctgtacctctttgactacgctgtgtcgcctgctttcttcctcgccaaagcacggggaggaacgtgcaccctggctgcctctgaccccagtgacgttgtgatccaccgtgcacggtacctnctggacaatgggtttggcatgtactccctgttcaagaacaactgcgaagacttcgccatatactgcaagactgggctgcttgtggagaccgctttcagtgttggccgtagcgggcaacttgcgtctctgact

SEQ ID NO: 66985 - DNA, 289 bp, Zea mays
  Clone ID: LIB3076-037-Q1-K1-E7
acgcccacgcgtccgggcacagtcgatacaccatgattctcaccgttctttcccatggaatgggaatcatatgcaacataatcttcatggaccacgggtccgtcactaggaccctgctgcacatattatgcgacaacacatgtccatgcctggaagatttcctccagaaggcttgccaagaggtgtacctccatctcagcctgtgcatcacatggctggatatagacctgaaatgggtaatgtcaacaatgttcatatgcaccctacgcagcccaactatggaaaattt

SEQ ID NO: 66986 - DNA, 438 bp, Zea mays
  Clone ID: LIB3076-037-Q1-K1-E8
ccctgctgaagtggcagaggatcattatttcatgacaccacatggtagccttggtcaggggcattgggatacagaacaagacatagagtatcggttctctcaatcacctacagggacagccaatgctactacaacagaagatgccattgcacagttgcgctctagaaggctcatgagtagaatggaggtcccatctggtgccaccaccgaagacaggactgatcgaactgagggtttcgatagtgatcttggtccctcttcatctagtgtatcaacagcaactcctcccaatggtcgcaacggaaggctgctgactccaacctctgatgatggcgagtatgtggagtactcatttgatagcttgtcagatatgcctcacaccgtggaagatgaagattgaatgctaatgcaagcaattcttgaatcactgaaagacta

SEQ ID NO: 66987 - DNA, 318 bp, Zea mays
  Clone ID: LIB3076-037-Q1-K1-E9
agcaccttaccaaaaaaatcccccattttcttcgaggcgaggagagcgtgaaagacagggcaccgggggcgacgatgtcggggcgcggcaagggcggcaaaggtctgggcaagggcggagcaaagcgccaccgtaaggtgctccgtgacaacatccagggcatcaccaagcccgcgatccgtaggctggctcggatgggcggcgtgaagcgcatttcagggcttatctacgaggagacccgcggcgtactcaagatcttcctagagaacgtcatccgcgacgccgttacctacaccgagcacgcacgccgtaagactg

SEQ ID NO: 66988 - DNA, 283 bp, Zea mays
  unsure at all n locations
  Clone ID: LIB3076-037-Q1-K1-F1
gctcaccgtgccggcgcaggagacccccgtagacaagttcctgacggcaagtggcacgttcaagggatgtgagctgangctcaatcagagncgcttgcggcttatctctgangaaaacggngatgaagatgaatctacaaagctgaangtggaagatgtgcagttatcaatggatgatcttgagatgattcaagtcattggcaaaggaaacggtggtgttgtccagctagtgaggcacaaatgggtgggcacattatttgccttaaagggtattcaaatgaac

SEQ ID NO: 66989 - DNA, 444 bp, Zea mays
  unsure at all n locations
  Clone ID: LIB3076-037-Q1-K1-F10
cccacgcgtccggcgccgggagatgaggacgcggtgcgatgcaaggtggtggcatacatgaaggccgacgagatcgacaaggcgctcgccgcgatccgcgccgccgagcgcctcccgattgatctcagctactacagggcctactgctgctacaggcaaaacaaactgcatgaggctcttgagcttttaagaggccaagaagaaacttcagctgttctccagctggaatcccagatcttttaccgactaggaagaatgaatgattgcatgagtagctatgagaagcttaaaaaaatttaaaattgactcaatggatctgaagataaatatcattgctgctctagttgctgctggaagggcttctgaggtgcaggcagctatgaaggcgcttaaggttgatcttaccacgagagcactcagggatactcgtagttntgagctcgc

SEQ ID NO: 66990 - DNA, 268 bp, Zea mays
  unsure at all n locations
  Clone ID: LIB3076-037-Q1-K1-F11
cggacgcgtgggcggacgcgtgatgaccgcgtaattcaatgctctgagaaaccataaattgcgtccttcgaatacatgaaagtgcttaccagctttctcaatttcgacattgtttccacagctgtatattcctatatggcttcaatgtgatgctacgttttcaaaatagatgatgctctagaccttctaaagtcacggaatgctctactgcatgactntagctctgatattatatctaatgctttgtatgaacaccatgtgcatgcat

SEQ ID NO: 66991 - DNA, 442 bp, Zea mays
  Clone ID: LIB3076-037-Q1-K1-F4
cggacgcgtgggcggacgcgtgggcggacgcgtgggcggacgcgtgggcggacgcgtgggcggacgcgtgggcggacgcgtgggttttcagcctcctacaccaattccttctaccactcaaagcaacctccagtcttccaacaatcctgaaaagccagcagctaaagcagatcctgccaaggcaaccgctaatggtgttccaaatggtactggtcacactcacagttacagtggaactgtaccaagccaacaaagttcagcactgacgcctgatggaacttatagggcgcccttgctaggtggagttccttctgctggttacctagacacgacatattatgggtatgacagcacaggggcacaatttgcatggtatgatggctctgcttatgcaaatggacagcaaagaacaaccacaactaaatcgtttccatcctcgtca

SEQ ID NO: 66992 - DNA, 396 bp, Zea mays
  Clone ID: LIB3076-037-Q1-K1-F5
atacgtccatgcgttcggcgtttcctaatgcagcactcactttcagcgctaaccctacggttaaggccatatcgaatgaccgaaatgtgcgaaagatggcaaggatcgcatgctcatttggtttgatctatgacatgatgctcaacaacatcctgatctcttattggacgttcaaagataactggcttatactccaatgaagcgatctgcggcttatctttgacgaaaactgggatgaacatgaatctacaaagctgaatgtggaagatgtgcagttattaatggatgatctagagatgattcaagtcattggcaaaagaagcccgtgtgttgtccaactagtgaggcacaaatgggtgggcacattatttgccttaaaaggtatttaaatgaaca

SEQ ID NO: 66993 - DNA, 317 bp, Zea mays
  Clone ID: LIB3076-037-Q1-K1-F7
caagagacgcgcgatttcaatgccaatttaaaagaagcaaagaagcatatcgttgtgctaaagctcaaggagatctggtatgagtatataattgaaatgaactacgagcaaatgttaaaagacatacagcttgacctcattcaaacttcttcaggccagaaaaccagtccgtttggtcaggaaaagaaaaatgtagcacaagtagatgacaagatggtaaactcacgcggttctattgggccgagccatggacatgtggctgacgacctaagaccgtcgcaaagtgagtcatttgggagagagaacaatttaatggt

SEQ ID NO: 66994 - DNA, 363 bp, Zea mays
  Clone ID: LIB3076-037-Q1-K1-F9
tggagttttaaaagttgaactcatgaaggcgccaggcttagatcgcaataagggttatggcgttattgaatactacaaccaggcatgtgcagagtatgctaagcagaagatgtctaccccagaattcaaactagatacgaatgctcctactgtcagctgggcagatcctaagaatgccaatgaagctacatctactgcacaggttaaatctctatatgtcaaaaacctccccaagactgttactcaagagcagctgaaaaagctgtttgagcatgttggagaaattacaaaagttgttgttccaccttgcaaatctgggcatgaaaatcggtacggttttgttcattttaaagagcggtacat

SEQ ID NO: 66995 - DNA, 423 bp, Zea mays
  Clone ID: LIB3076-037-Q1-K1-G1
caagagaggcttgatttcaaggccaatttaaaagaagcaaagaagcagatcgaggtgctaaagctcaaggagatcttggatgatgatataattgaaatgaactacgagcaaatgttaaaagacatacagcttgacctcattcaaacttcttcaggccagaaaaccagtccgtttggtcaggaaaagaaaaatgtagcacaagtagatgacaagatggtaaactcacgcggttctattgggccgagccatggacatgtggctgacgacctaagaccgccgcaaagtgagtcatttgggagagagaacaatttaatggtcgtgaaagagctcagcattgacaagcaagagttaccgaggtcgcttgctatggagccacacgaggagtggagaaacaaggtcgtagaaagggtggcttttgatgcc

SEQ ID NO: 66996 - DNA, 440 bp, Zea mays
  unsure at all n locations
  Clone ID: LIB3076-037-Q1-K1-D8
ccagcacggcgaccaaccctctcccaacccgactagtcggactcgcagctccgccccaaagtccaggtcgaagcatggaagtcgcggcggcgtcggcgaggcccgtcctgcgcgtggctgccatctgcggctccctccgcaaggcctccttcaaccgcggcctcctccgcgccgccgcggaggtgtgcgaggactccatcccggggctccgcatcgacgagctcgacatctccgacctgcccatcatcaacaccgacctcgagaccggcagcggcagcggcaccgtcttcccgcccgccgtcgaggccttccgcgccaaggtctgccaggccgactgcttcctcttcggcgcgcccgagtacaactactccatcgncacccccctgaagaacgcgcttgactgggcctctagaggaaagaacttgtgggcagacaaacct

SEQ ID NO: 66997 - DNA, 384 bp, Zea mays
  Clone ID: LIB3076-037-Q1-K1-A3
cgggcgacaccgagcgagacgttcacaacttctaccgttccactaacccttgcggccaccaccagcgaccgcttcggatagtcaagggtacagcgtgcaagcgggatgagcgccgcaagcgcaaggaccgcaagcggcagaggcaccttgttgacgagctcgtgcggtggcaacctctcggcgccccgacgccccttccagccgccaccggatccgtgtcccccttccaagcgcatcccgatacgccttggccgagtgacccgtcgccgtctacggaccccgcggaagccgacttctggagctggggcccgtccgccgtaccctcggcgacgccgacgcaacccacagtcgacgtggcgggcgcggtcccctttgcaccctaag

SEQ ID NO: 66998 - DNA, 288 bp, Zea mays
  Clone ID: LIB3076-037-Q1-K1-A5
gtgtcatcggaagtctgaggccgtcatggacaccgtttatcctgtcaatgcaatggctttgcatcccatatatgggacattggccaccggagggtgtgatggatttgtgaatgtgtgggatggcattaacaagaaaagactatatcatgtctcgaagtacgcatcaagcatcgctgctctatcattcagtaaggatgggcatctgctagctgtggcatccagctacacttatgaagagggagaaaaaacgcatgaacctgacgctatatttattcggacagtgaatga

SEQ ID NO: 66999 - DNA, 275 bp, Zea mays
  Clone ID: LIB3076-037-Q1-K1-A9
gttacgcgcaggccatctagtcgtcgcgctttcgatgacgcgtactccatgaccacactcggtgatagctcgttagtacgcatgaaagcgaatgtgctcaccaacttgatctcgtcgagctgcgacaataaagatactatggatgccatatgggctggaaccttgtgcagactaaatttcacagtatcggagcaacacttgtacgagtcgacaagtttggaaacatatactctgagaaactacatgacactcagtactgaaggcatacgtgggta

SEQ ID NO: 67000 - DNA, 437 bp, Zea mays
  Clone ID: LIB3076-037-Q1-K1-B10
aaaaaaattccccattttcttcgaggcgaggtatagcgtgaaagacagggcaccggcagcgacgatggttgagctcggcaagggcggcaaaggtctgggcaagggcggagcaaagcgccaccgtaaggtgctacgtgacaacatccagggcatgaccaagcccgcgatccataggctggctcggaggggctgcgtgaagcgcatttcggggcttatctactaggagacccgcggcgtcctcaagatcttcctcgagaacgtcatccgttacgccgtcacctacaccgatcacgcacgccgcaagactgttaccgccatggacgttgtctacgcgctcaagcgctaaggccgaaccctatacggcttttgaggctaagctggatgcctcttatccttgctgtcgtggattccagtccgttagtagggttatttcggtt

SEQ ID NO: 67001 - DNA, 191 bp, Zea mays
  Clone ID: LIB3076-037-Q1-K1-B2
cagatatcggccgccaccttcacctccaccgccccggcgcacgtgcgcgtcttgggcgtcggtcgcctgttctacttcggacacgactgacctgccactggcgcctacgaagaagacacatatgaagaagctcatcgtcaaacctcaaccagattcagtcgctacccttcgattgcctgatacggaacgtc

SEQ ID NO: 67002 - DNA, 360 bp, Zea mays
  Clone ID: LIB3076-037-Q1-K1-B6
cgacaccgagcgagacgtccacaactcctcccgctccactaaccctagcggccaccaccagcgaccgcttcggttagtcaagtctacggcgttcaagcgggaggagcgccgcaagcgcaaggaccgcaagcggcagaggcacctcgttgacgagctcgtgcggtggcaacctctcggcgccccgacgcccctcccagccgccaccggatccgtgtccccctcccaagcgcagcccgatacgccttggccgtgtgacccgccgccgccttcggaccccgcggaagccgactcctggagctggggccctgccgccgtaccctcgccgacgccgacgcaacccacagtcgacgtggcgggcgc

SEQ ID NO: 67003 - DNA, 409 bp, Zea mays
  Clone ID: LIB3076-037-Q1-K1-B7
ggtcaacagcacaagcacaggcgtcacattaaaataaaatgcaccaatgtgcaacggcaacgtccattgagacatgatgttatgcctagccttacacaaacattaagtccacctataaattaaaatcgtcactctagcaaatctcacaagcaaaagttataaggtagccagctatgcctgggtagcattttccagttgcagcaaaaaaaggatacattcccccgcttgcagagccaggggcgcattagcttcctacttcgtagcttagcgacagcaaaaccattgaaccatacagtccacaggcgcactcgcataattgaagagcaaccaaagtgccttgaatcccattatggtagtctgcttactgttgagcgcactggactttttgggcttcaacaggcattttatt

SEQ ID NO: 67004 - DNA, 340 bp, Zea mays
  Clone ID: LIB3076-037-Q1-K1-B9
cacaggcgtatagccatcgccgtcgacctttccgactagtccgcctacgccgtgcgctgggccatgggcaactacctccggggcggggacgccgtcatcctgctccacgtgcgccccacctccgtgctctacggcgcctactggggcgccgtcgacatctccctccccaaccctagcgccaccgccgactacgaggacggcgactgcgactgcgactgcgaaaccgccgtcgccgcgcgcacgatggaggacgactacgacgccttcacggccaccaatgtcgacgacttcgtcagcccgctcaaggacgccggcatcccctacaagatccacattgtca

SEQ ID NO: 67005 - DNA, 300 bp, Zea mays
  Clone ID: LIB3076-037-Q1-K1-C2
atcggcgcgaggttcttcctgacgggctatgaggcggccaagggccccgtggacacgtccaaggaatcccggtcgccgagggacaacgacggccacgggacgcacacgtccagcaccgcggcgggcggcgccgtccagggcgccgacctgctcggctacgctgccggcacggccaagggcatggcgccccgcgcccgcgtcgccacgtacaaggtgtgctgggtcggcgggtgcttcagctccgacatcctcaaagccatggaggtcgccgtgacggacggcgtcgacgtgctctcgctc

SEQ ID NO: 67006 - DNA, 423 bp, Zea mays
  Clone ID: LIB3076-037-Q1-K1-C5
agtcacttgatgtgaactatgtgcttgttgtatttggaggtgttactggatattcttcaggtgatatcaacaagttcttatggatggtacgtattggtggaggggttttccctgtaatcaaagagccagattaccttgttaacggggagtatcgtattgacaagggggcagcaccaaaaatgctgaactgcctaatgtacaagctttgttactaccgatttggagaacttaccacagaatatggaaaacctccagggtatgaccgtgtacgaggagtggagattggcaacaaagatataaagcttgaatacttggaagaagcatttacaacttcaaactggatagtgcgcatatacaaagtgaaacccccaaagaacaggtcctgaagcgtcatcgctagtgaagtggtttggagagctatta

SEQ ID NO: 67007 - DNA, 270 bp, Zea mays
  Clone ID: LIB3076-037-Q1-K1-C7
cccagagtgcaacaacctgaactacccattccgcacggtgtgtaacaggaaaggatgctggtacagcaagccagccccggcgaacaactgaacccaaccttcgcgcatcgtccagctattgttgtacccgtagattgtatcctagtcgtgtgcaatctttgaactgcacgaagatgtttgtgcctggagacgagagattcgattcgttacgcttaatttactattatacatttttattaaatgatgaaaactagggaagatcattatatc

SEQ ID NO: 67008 - DNA, 280 bp, Zea mays
  Clone ID: LIB3076-037-Q1-K1-D1
agagtgcaacaacctgaactacccattccgcactgtgtgtaacatgaaacgatgctcgaacagcaagacagcctgggcgaacaactgaacccaaccttatcacatcgtccagctattgttgtacccgtagattgtatcctagtcatgtgcaatctttgaactgcacgaagatgtctgtgcctgtagactagagattcgattcgttacgcttaatttactattatacatttttattaaatgatgaaaactattgaagatcattatatcaaaaaaaaaatat

SEQ ID NO: 67009 - DNA, 342 bp, Zea mays
  Clone ID: LIB3076-037-Q1-K1-D11
accaccaccatcgacgctgtcaacagcgacctcaagacgtactaatcattccgcgagtaggctgtgtctgaacaacactcagctactcttatctaatttggagcactatcgtgcacgcgcgttatcctgatatgctgaccagtctgcaagagtatgttaatcatcatcctgttgtgatcatcgcacctagctactagtgacaactactgaagagacaggagcaaagagttaacatgagatgaatgcccctgaccgttatgagcgtttcgtcgtgccaaaaggcaccaagaaagtgtcctatgaaaagggatacaaagattgtgaaaggctgcatcatttact

SEQ ID NO: 67010 - DNA, 349 bp, Zea mays
  Clone ID: LIB3076-037-Q1-K1-D12
cccacgcgtccggtgggtcacccaaggtcctgttgatgtagacattggtgccaatccatgggtcgtgggtggtgaggatgaaagcgttgatgacacagtcgtgaaggtggttgatattgttgacacattccgtctacaggagcaacctccttttgacaagaaatcatttgtcttttacataaaaaaatacatcaagaatctcactgctgtgttggagccagagaaagcggatgagttcaaaaagggtgtctagggtgcaaccaatttttttcttatcaagcttaatgacctttaattttttgtttgtgagagcttgaatgaccaagcgttcttggtattttactatttc

SEQ ID NO: 67011 - DNA, 426 bp, Zea mays
  unsure at all n locations
  Clone ID: LIB3076-037-Q1-K1-D3
cactcaccgccccctcggctctccgtcgatggaagggcgccattgacgccccgcgatcctcgctaccacccccacgaggccataccctccccccacacagatcttggaagaggctgccaccccgcccccgttcttggccccatcaccctccccatgcgatgctcgcctaccccacacgatgcaccccttccttgccttggtggcgagcttgtcgacgtcgaggcagatgcgggagatggacttggcggcctgctccgccttgtcggcgcgccgctgctcgaggaggcgcttggagcgatcctncccctccgncccgctctcgctcgcgctttcgtcgccgccgtggtccactggagcggtccttcccctccggcccgctctcgctcgcgctttcgtcgccgccgtggtcggctgtcgcacacgccc

SEQ ID NO: 67012 - DNA, 348 bp, Zea mays
  Clone ID: LIB3076-037-Q1-K1-D4
ggcaagaagtccaagctcggtttcaccgtgtacccatccccccaggtgtccacgtccgtggttgagccatacaacagtgtcctgtccacccactctctcctcgagcacactgatgttgctgtcctgctcgacaatgaggccatctatgacatctgccgccgctcccttgacattgagcgcccaacctacaccaacctcaacaggcttgtgtcccaggtcatctcatccctgactgcttccctgaagttcgatggtgctctgaacgttgatgtgaacgagttccagaccaacctggtgccctaccctaggatccacttcatgcgttcgttctacgctccagtcatttct

SEQ ID NO: 67013 - DNA, 346 bp, Zea mays
  Clone ID: LIB3076-037-Q1-K1-D5
attcccggacggacgcacacttacacaaggtccttgatcttctgctcccgaacatttccatttactccaaggcaatctggataccgaactcattaagtcacaatatgggcccataaactatcttctaaaaacgtctaactcccgctctataacaagactcctaccattacctaatgcaagatccacatctccatacgcatcaacctttcctttgatcttttcaaacactctttatcctaaggcaccaacgtcataaccaactttacctccttctacgcttttccatcgctctatatgatccaatattacttacacctacattctactttatagctcttctataatg

SEQ ID NO: 67014 - DNA, 215 bp, Zea mays
  Clone ID: LIB3076-037-Q1-K1-D6
gtgtcaggtgctgggacgattggcttcccaaatagcttttgtgcttcaaggcaaggataagcctacgtatactccacatgtggaaaatggagacatgtgcattgtacttaatgcacaggatatcagtgttacatgaaggaaaatgacagataagatttactactggcatacagggtatgttggccatttgaaggaaaggttgctcaaggtccata

SEQ ID NO: 67015 - DNA, 297 bp, Zea mays
  Clone ID: LIB3076-037-Q1-K1-A12
gcacatcacaacagcatccaccggcccattcttcctcatagccgactgttcaactcaatactgtccgcagtgcccacacgatcaacgcagcaacataatgcaccgaatctacatccccaagctagcaattcttctgctactctgcaccaaaacgtctcccgcctacctatcctctgcataaatccatgcgaacccacccaacaacctcgtgctcctcatgaaccgcaagaaccagacgagcacgctgcctgcgctgcgcaacatcacagtccatcgcctcatgcctcatgatctaca

SEQ ID NO: 67016 - DNA, 384 bp, Zea mays
  Clone ID: LIB3076-041-Q1-K1-C6
ggaaagtgagactcatttaatacgtctgctagatcatcagacgtttgagtccctgtgtggatatccgctagatcaatatgagtgtggctgctccatcattagctgttcgtttgcggatgatagtaatgtttattactgtgtgggaactgcatatgttatacctgaagaaaatgaaccgacgaagggccggattcttgtatttgcagttgaagatggaagcttgcaattgatcgtggagaaagaaaccaaaggagcagtttattcgctgaatgcattcaatgggaaattgttggctgctatcaaccagaagattcaattgtataagtggatgtcacgcgaggatggttcacatgagctgcaatctgattgtgggcaccattggca

SEQ ID NO: 67017 - DNA, 408 bp, Zea mays
  Clone ID: LIB3076-041-Q1-K1-C7
cggacgcgtgggcctggccatcagttgtagctgtaattccacttctattattgaacattgggtacaggaatctctatcttgcaacctgacgggagttaactcgacttgaaggagtgacaaaggcaccggttattgatcacttgtctgaaactgttcttggtgtcacaactataagatgtttcaaaaaggagaaagaatttttccatgagaatttagacaaaattaattcaagtttgcgcatgtacttccacaactatgccgcaaatgaatggcttggtttccgactggagctaattggaacacttctattgtcaataactgcatttctcatgatcagcctgcccaggaattttatcaagaaagaaatttgtggtatgtctctatcttatggtctctccctcaattctc

SEQ ID NO: 67018 - DNA, 449 bp, Zea mays
  unsure at all n locations
  Clone ID: LIB3076-041-Q1-K1-C8
gctggcgatccgcaacgatgaggagctcgggaagctactggccggcgtcaccatcgcacacggcggggttctggcgcaacatgaaccctgtgctgctccccaagaaaaccgctgtcgctgctgccaaggaaggcaaagagaagaagtcacccaagaaggccgccgccgccaagtcgcccaaaaaggtggccgcctcgtaggtccctggcaatgctgatgcactgtctctctctgtcctctctgaactgaaacgctcctaactgtcgttgtcggtcatggtcgttgttgtttgatgcgctnttattgtggttgttcgtgtgtaattgcttgcctttcggccatttggcatgcactgtgtaaggtcacactggtctaggttttcaatctgggaaacaccggtttagattcaaggagcgtgaactgggaaagcaggtgaaaaggtgggatct

SEQ ID NO: 67019 - DNA, 410 bp, Zea mays
  Clone ID: LIB3076-041-Q1-K1-C9
gaatacccggccggacgcactcgaccgcccacgcgtccgcccactcgtccggcgactagcccaccgccaccggcaagaccccttcggcgaccttcaataccggaagagggcgaggcgcccaaccgagagcaccaggggaaaggaagtgcgcctaggcatcgacatggaggacttctacgtcacgatcccctacagcctgctgctcgtagcctgcggcgtaaccggctacatgaagcgcggcagcaccgcgtctctggccgccggtggcggattccgtgctgcgctccttctcgctagtgcgctcagcgcccgggccttcgcgcacgccggaagtggcactgccgccatctttgccaccgtccttcatatcgaatgtgctgtgctattgactgtcgctatgggaataagat

SEQ ID NO: 67020 - DNA, 413 bp, Zea mays
  Clone ID: LIB3076-041-Q1-K1-D11
aagataactggcttccagtttgctcctgtaagctcctcggaagttctgatgacttctgcggattctagaatacgagttgtgaacggcgatgaatttgttcacaagtttaaagggtttcggaacacgagtagccaaatctcagcttctgtagctcagaacgggaaatacgtgatctgtgccagcgaggattctcacgtctatgtgtggagacatgacaacagttcccaccctagcaggagcaggagcacagttgacgttaccaactcatacgaacatttccactgccatggtgtgaccgtggctgtcacatggcctggtgctgaagcccgaagttcgtttggacctggaagcagcaggcacagtgattcagatggggcaatgaactctggccgggaccttccagttgagaacac

SEQ ID NO: 67021 - DNA, 325 bp, Zea mays
  Clone ID: LIB3076-041-Q1-K1-D3
acgcgtccgcagagcgaatacctcgagcgcgccggaggtttctacagcggggccctcaccgtcgatgtggttcctgtcaacacctacctgaccaggttcgtgtgggatgagggcaggtaccccacaatgtcgtcgctcaaggagatcgtcggcagcatccagtcgcaggtcgccaagatcgatgatgacatgaaggttcgagcagcagaatataacaatgtaaggagccagcttactgcaatcaacagaaagcaaagtgggagcttagcagttcgtgatctttccaatctggtaaaaccagaggatatggtctgctcatagcatc

SEQ ID NO: 67022 - DNA, 461 bp, Zea mays
  Clone ID: LIB3076-041-Q1-K1-D6
caaaggctctctaatgagaggcttaaaagcacaggcgatggacccactcaacgcgcctcggcactggctgccctatctaatgcattcgatccatccttaaaacccaaaacaccacttccatctcgctcaggtcaaggttcccaaagagcagctgccgtagctgcactatcctctgtgctgactgctgagcaatctggatcttcagaaaatctacgagccaaagctagcagcacaggagataagactgatgtcgataggcctgtcataactccagctggaccatctggtccatcttctcctcagtctgaaactggggagtccaatgtgtttcgccaggaaaaagatgctgcagtagatggggcaccatctgacactgatggagcagtggctgagacccgagaagaagaaacgacagaaaatgttggtgaagcgacatttagctatgaccgcttgatatctaa

SEQ ID NO: 67023 - DNA, 394 bp, Zea mays
  unsure at all n locations
  Clone ID: LIB3076-041-Q1-K1-D7
cagatcgaagacctcgagcgcgccggaggcgtcgacagcggggccctcaccgtcgatggcgttcccgtcgacacctacctcaccaggttcgtgtgggatgagggcaggtaccccacaatgtcgtcgctcaaggagatcgtcggcagcatccagtcgcaggtcgccaagatcgaggatgacatgaaggttcgagcagcagaatataacaatgtaaggagccagcttactgcaatcaacagaaagcaaagtgggagcttagcagttcgtgatctttccaatctggtaaaaccagaggatatggtctgctcagagcatctagtaacactttttgctattgntccaaagtactcccaaaaaggactgggtgtcaagctatgaatcactcgacacattt

SEQ ID NO: 67024 - DNA, 317 bp, Zea mays
  Clone ID: LIB3076-041-Q1-K1-D9
tcgcggactcgtgggcggacgcgtgggttggggagtaatgtcccattatgccagtactgtatggaggctagacatgcattaaggtctgatttagttaataaggtgcgagaatatcctatatgtgttggagtttttgcacctgttgcaaactgcgggctacagtatagtttttgcgtttctaagggaaactggattgagatttgataaggatgcggtttgtaggaatttgcatgaacagttgagaacagatggcaaaatttacagggtactgcatacatgattgagaatgtccgaaaaattgatgtgaaatgccaaat

SEQ ID NO: 67025 - DNA, 394 bp, Zea mays
  Clone ID: LIB3076-041-Q1-K1-E10
cgaaaaggcgcaggcgaagccagcggggagagaaaacgggcggctcgcgcgcagcggcggcggcggcggcaatggaggtcacctcctccccctcgccttccgcgccgccgccggcctcctcgaagccggcgctccagctcaaccccgcggccgtcctcctccgccgcctgccgaccccgaccccaacagcggcgacgcccgtcaccgcgacggcgccccccgcgcggcccgccaccgcgtccaacccgctcgcggccttgctcgtccccttctggcgcgggctgcggcgagcgccgaaacagccggtccaccccgcctccgccgtcgcggcgcggagggcggcggagcagcaggaagcggatgcggaagcgcggcagctggtggggtgcgcggt

SEQ ID NO: 67026 - DNA, 318 bp, Zea mays
  Clone ID: LIB3076-041-Q1-K1-E11
cgagaaggcgcaggcgaagcttgcggggatagaaaacgggcggctcgcgcgcgagcttcggcggctttttaaagggaggtgagctcctccccctcgccttccgcgccgccgccggcctcctcgaagccggcgctccagctcaaccccgcggtcgtcctccttcgccgactgccgaccccgaccccaacagcggcgacgcccgtcaccgcgacggcgccccccgcgcggcccgtcaccgcgtccaacccgctcgcggccttgctcgtccccttctggcgcgggctgcggcgagcgccgaaacaaccggtccaccccgcc

SEQ ID NO: 67027 - DNA, 455 bp, Zea mays
  Clone ID: LIB3076-041-Q1-K1-E12
tcgagcgcaaaccgagcggacgccgccatggatcgcgagtggggctccaagcccggcagcgtgtgcgccttctacgcgcagaatgaggccatcgaccggcgggagcgcctccgccgcctggccctcgagaccatcgacctcgccaaggacccctatttcatgcgcaaccacctcggcagctacgagtgcaagctgtgcctgacgctgcacaacaatgaggggaactacctggcccacacgcaggggaagcggcaccagaccaacctcgccaagcgcgccgtccgcgaggccaaggacgcacccgcgcagcctcagcccaacaagcgcaagcttgccccccgcaagtctgttaagattggcagacctgggtataaagtaaccaaacaatatgatcttgagatgaagcaacactcgtttctttttgaaattggttacccggaaatcgaagataattg

SEQ ID NO: 67028 - DNA, 336 bp, Zea mays
  Clone ID: LIB3076-041-Q1-K1-E2
cccacgcgtccgcccacgcgtacgaccactcgtaccgcacaagtcacaacggtggccagggcgcacccatcagtcccgggttgccgacacactcctcctatagtacaatctgcttctcaatcatttcaacaactatatctcttctatctagctgcgacgccagagcacctatggaatacgaacggatcatccaggatgttgtggatagacaacaaccgtccgaaataccctagacaaacgcacctgccacgaccaattccccacaacctaacaaagttcgcgtcgcagcaggattgcccacgaatgacgctatatggaccgacctggtccgcgaag

SEQ ID NO: 67029 - DNA, 459 bp, Zea mays
  unsure at all n locations
  Clone ID: LIB3076-041-Q1-K1-E6
ttcccaaccgactcccagttccactctcgcttccttccctccctccctcccacgcaaatggtggccgctcgcctccgcctctcgctgctactctccgtctgcctctcctccgcgtgggcgcgcccacgcctcgagccggccatccgcctgccgtcgcagcgcgccgcggcggccgacgaaacggacgacggcgacgtcgggacccgctgggctgtgctcatcgccggctccagcggctactacaactaccgncaccaggcggacatctgccatgcataccagatcatgaagaagggcggactcaaggatgagaacatcattgtctttatgtacgatgacatcgcgcatagcccggagaatccgaggcctggtgtcatcatcaaccatccccaaggtggcgacgtctatgctggggtgccaaaggattacactggtcgagatgtcaacgtcgacaatttc

SEQ ID NO: 67030 - DNA, 430 bp, Zea mays
  Clone ID: LIB3076-041-Q1-K1-E7
gcagcggcgcccccaggccaggccccacccgctcagcctcctcagctgcccaaccttctgcccatctgctcagcctcagctgtcattcccgcgaagcgccgtctcccggctctatcgatggaccgagtcgccgccctcgtcgtcgcgctcctcgccctcttcttcgccgccggggccacggcgcaggccccggcctcgtcgcccaagcgcactccagcgccagcgccacccaggacggccttcctcccgccgccgccggccagggcgcctatggcctccccgccctcgcctcccgcgatggcgccggtgcccgcgccctccgccggcgtgccggccacgagccccgtcggcgcgggagctggtgacgacgcgatggcccccgccggagccgcggcggctctgactccggctgccgcgcccgtcacggaga

SEQ ID NO: 67031 - DNA, 425 bp, Zea mays
  Clone ID: LIB3076-041-Q1-K1-C11
acgcgagctagatccaacccaagtcccgtttccgcgggcgaggccgaccggatccacctgctaagtcgtctcggatggcggcagcatcgacgtcggtacgggtgctccccgacggcggtgctgacgacgaggagcgctggctcgccgagggcatcgtcggcgtccagcaaaacgctttctacatgcaccgtgccctcgattccaacaacctcaaggacgcactcaagtactcggcgcatatgctatcagagctgcgcacctcgcgactatcgccgcacaagtactacgagctttacatgagggcgtttgatgagatgaagaatctggagatgttctttatggaggagactctccgatgcaactgctctgtggttgatctgtacgagcttgtgcagcatgctgggaatgtcttaccgagacttcta

SEQ ID NO: 67032 - DNA, 394 bp, Zea mays
  Clone ID: LIB3076-040-Q1-K1-G8
gcgcccacgcgtccgcccacgcgtccggcccggtaaaaggttaccggcagctgttattgtttaggaggatagtgtttagtatgttcttcaggatacactgtcttgttggattctgtaggaggatgggttctagtatgttcaggaatcaggatgcgctcgtcttgttgggttttgcttctgatgacttcgatatgttccatggcaaatgcgactttaaagtttgggagacttataattctacaaaaaaaatttatattatatataaatatataataaatataattaaatattataatttttttttatattatatattttttttaattatatattttttattttttttattattttaatattattttttttatttatatttttttttatatttttt

SEQ ID NO: 67033 - DNA, 422 bp, Zea mays
  Clone ID: LIB3076-040-Q1-K1-H1
actcattggcctagatgctcatttgaaactgccagctataacttacaatatccaggacttggcttttcttacatgtatttttcttacaggtcttcattgaagtagccttcctaactgatgtgtcactcttcatcaacaagattttgaatgcttttgtaacttgtttcaaaccatgcttgttcctttgatagccattagtcaagatgtatccttaatgggagtgaatagacccactcatcttataacctacaaactctttggaggcagagcgctccagtattatcgcggagctgaagcaattgagtgataatattttactgttgatggagataaaatttcaagatatttcatcgtttcgtatcgatttcaggttgtaatggaagttgtttttaatctacgcaattttcactgttaaggtgttg

SEQ ID NO: 67034 - DNA, 61 bp, Zea mays
  Clone ID: LIB3076-040-Q1-K1-H10
cccacgcgtccgcaaacagtctgataaaagatcagaatagaaagccaaaaatttcaggtgc

SEQ ID NO: 67035 - DNA, 433 bp, Zea mays
  Clone ID: LIB3076-040-Q1-K1-H11
acgattttgcaattgagttatgcagtcttgtgcctttacaaagatacactaaagctttgaacacgcttcagaggtcatcactcgtggagaaatctatgcagaaaccgcaggaaaggatgtctgttttatctgatgtgctgcaaagaagcaactatgatgcagagcccatgttgaaggcatgcgggattacaattgctagaaatttcacagaagttgatggtagggtattgcagccacctaagcttaaagctgggaatggtgaatacatttttacacgcaatggtagatggaacttcaacaataagaggctcattagagcttgtagtgtcgagaaatgggcggtggtaaacttttttgcacgatgcaatgtcaaggatcttgtccgggatctcattaagtgtgtaagcattaatggcattatggttgatgcttc

SEQ ID NO: 67036 - DNA, 398 bp, Zea mays
  Clone ID: LIB3076-040-Q1-K1-H2
gcgtcacgcgtccgcccacgcgtccggcccggttaaaggtataccggcagctgttattgtttaggacgatagtgcttagtatgttcttcaggatacactgtcttgttggattctgtaagaagattggttctagtatgttcaagaatcaagatgcgctcgtcttgttgggttttgcttctgatgacttcgatatgttccatggcaaatgcgactttaaagtttgggagacttagaattctacaaaaaaaaattattttaaattaatatattatttaataatattaatttaattattatttatttattttttatttttttttttctacttttaattttttttttattacattttttttattctttttatttattttttttattttttatattttttattt

SEQ ID NO: 67037 - DNA, 435 bp, Zea mays
  Clone ID: LIB3076-040-Q1-K1-H4
ctgtagaaccaacgtaaagctatggtaaaagggctacgagcaatgctagcaactgtcaaaataccagggtacaagcagtgaccaatccactattctgtccgaagataatggatgacgtttgtttcttcagaatcagatagacagcttctactcatgaggcagcaggatgaagaacttgatgagctcagtgaaagtgtccaaaggattggtggcgtgggactaaccatacacgaagagctgtctggacaggaaaggatcctaaacgacctaagcttggagatggagactacttccaacagacttgatttcgtgcagaaaagagtggccatggtgataaagaaggccggcatcaagggtcagatcatgctgatcgtgttcctggttgttctgttcatcattcttttcgttttggtgttcttgacatagccaagtgca

SEQ ID NO: 67038 - DNA, 257 bp, Zea mays
  Clone ID: LIB3076-040-Q1-K1-H5
cccacgcgtccgcccacgcgtccggcccggttaaaggataccggcagctgttattgtttaggaggatggggtttagtatgttcttcaggatacactgtcttgttggattctgtaggaggatgggttctagtatgttcaggaatcaggatgcgctcgtcttgttgggttttgcttctgatgacttcgatatgttccatggcaaatgcgactttaaagtttgggagacttagaattctacaaataaaaaaaaataaaaa

SEQ ID NO: 67039 - DNA, 235 bp, Zea mays
  Clone ID: LIB3076-040-Q1-K1-H7
ggcgcttacaatgaaccttattcgtcagctgaaataactatttaaggtggcaaataacagcactggaatcggtatgctcttcagcacaacaggcgtttcaaaacgcgagctccgcttaacacgataacctactgctggatcacttaacgggcacctgcttctcaatgactactaatctatattgccgctaagtactctatgcttcccttgcggtctggctttatctacctctccc

SEQ ID NO: 67040 - DNA, 426 bp, Zea mays
  Clone ID: LIB3076-040-Q1-K1-H8
cggtacagtcaagagagctattgaaaagggctagagcaatgcagcaacttcaaaataccagggggcatgcaggaccaaccactattctgccgaagataatgatgactttctttcttcagaatcagatagacagcttctactcatgaggcagcaggatgaagaacttgatgagctcagtgaaagtgtccaaaggattggtggcgtgggactaaccatacacgaagagctgtctggacaggaaaggatcctaaacgacctaagcttggagatggagactacttccaacagacttgatttcgtgcagaaaagagtggccatggtgataaagaaggccggcatcaagggtcagatcatgctgatcgtgttcctggttgttctgttcatcattcttttcgttttggtgttcttgacatatccaagtgcacc

SEQ ID NO: 67041 - DNA, 394 bp, Zea mays
  Clone ID: LIB3076-040-Q1-K1-H9
cgcgtccgattttgcaattgagttatgcagtcttgtgcctttacaaagatacactaaagctttgaacacgcttcatttgtcatcactggtggagaaatctatgcagaaaccgcaggaaaggatgtctgttttatctgatgtgctgcaaagaagcaactatgatgcagagcccatgtttaaggcatgcgggattacaattgctagaaatttcacagaagttgatggtagggtattgcagccacctaagcttaaagctgggaatggtgaagacatttttacacgcaatggtagatggaacttcaacaataagaggctcattagagcttgtaatgtctaaaaatgggcggtggtaaacttttctgcacgattcaatgtcaaggatcttgttcgggat

SEQ ID NO: 67042 - DNA, 312 bp, Zea mays
  Clone ID: LIB3076-041-Q1-K1-A10
cccatctggacccactcgaactcataaacacatatttcatttattcatacattgtctccaagcttacatcacggaacaatgggactgttaaaacagcgatctggcataaaaaaacaaccatacaatgctatcaaggcaatgcttctagtaagcacctcgcaatggccacgatcaccatgaacaccattcatcctaaagagaccgtagaaaagatgcaaccctacatgaccaatacacaccatggagaacagcacacacactcaacacatcaagactctaaacatgacaaccaaacacaccgtacaagtccac

SEQ ID NO: 67043 - DNA, 457 bp, Zea mays
  Clone ID: LIB3076-041-Q1-K1-A4
atgaaattgatgccattggaacaaagcgttttgacagtgaagttagtggtgagagataggggcaaaggacaatgttggaattgctgaaccagcttgatggatttagcagcgatgagaggataaaggtgatagctgcaacaaatcgtgctgatattcttgatcctgctctgatgagatctggtcgtctggaccgtaagattgagttcccttatccatcagaggaagcaagagctaaaatcctgcagatccactcgaggaaaattgaatgtgaatcccgatgtcaactttgaagagttggcgcgttcaaccgatgatttcaatggcgctcagttaaaggctgtttgcgtaaaggctggcatgctcgctctacgcccagatgctacagaagttacccacgaagattttaacgaggggatcatccaagtgcatgcaaagaagaagttcagcttgaattact

SEQ ID NO: 67044 - DNA, 236 bp, Zea mays
  Clone ID: LIB3076-041-Q1-K1-A5
atatagtattcacaatcttttaattacctcaaaacatggattctttgaaatttttgaaggccttatgaattccattgttccatatatcaatcaacattgactcactgaacaacaaaattcaatacacctaattttgctaatcaccacaaacttatttttacattaattcaacctataaattatatctttaaccaccatattattcaattcattttaatctcctaacttataataac

SEQ ID NO: 67045 - DNA, 332 bp, Zea mays
  Clone ID: LIB3076-041-Q1-K1-B1
acccactcgtacggcgccatactggcttcaggcattctcgactccggtggcaggaatgtcaccatgaagctgaggtagatgtcgaagcacgacaggctcaccgctgttgtcaggctagccgtcttcacccagttctggtactggtacccgctcacctacttcataagcctggccttctccccgacggccctcatcggcctcaactccgacctgaaagtgcccaagtttgagttcctgtcgaacgcgaagccgtcgctgttcgattaccccaagccagtgacccaacagaccacagtcacgtcagtcaatgtgccggcggtcatcctgtctac

SEQ ID NO: 67046 - DNA, 453 bp, Zea mays
  unsure at all n locations
  Clone ID: LIB3076-041-Q1-K1-B10
cccacgcgtccgcggacgcgtgggctccgtcgcgctgggcgcagtgtttgcgtccgtgggggggcaccacgtacctgggcggcgtctagtgttcctcctcacctgtgctgcgaggggcgctaagagactcacagggttcacgttcctgcggtgggccacgcgggacgccgttgtgcagatgctctgcctctggttctttgcggatgtgcacgatcaggcccagctgttcaggctctttgtggtcgccaaactgatgccattctccacatccgttaacccgtggcttggtgcagtcgttgcaggcccagagctcgatggtttctttgttgcctgggctgttcttgatgcagtggtgtcagtnttgttcactgtggtgccttgggtggttgtcatggaccgtgatccacggtcgtctgggcacaatgctgtgaaggaagggtgctatcttgtgtc

SEQ ID NO: 67047 - DNA, 66 bp, Zea mays
  Clone ID: LIB3076-041-Q1-K1-B6
gacccacgcgtgcgcccacacgtccgcccactcgtccgcggactcgtgggttctagatcgcgagct

SEQ ID NO: 67048 - DNA, 191 bp, Zea mays
  Clone ID: LIB3076-041-Q1-K1-B8
gcgatattctccgcgtgacttcaggtgtcgtcttcgagttttctccggccgatggcggcggggcgacctgtaaccatcgaaagcgtgagtgtgacaggcgacatgactcgcggcaaccagcgtgaccgcgatcgtgagcgcgcggcggcgcggaagcccaacggcaaggggccccatgactggctcacccc

SEQ ID NO: 67049 - DNA, 340 bp, Zea mays
  Clone ID: LIB3076-040-Q1-K1-G3
gactcttacgcttttgttgaaagtcgttcgagcttttgcttttagtatggcagtgtttacatacggcaatgttgatttttaaagtttgttaggcctttatatttccttttttttatttttttttttatatctttttttttttttttatctttttttattatctttttttttttttttttttttttttatttattcttttttttttatatattttattttttttatttttttatattttttttttttatttttttatttattttttattttttcttattcttaattctattatattttattttttatatattatatttattttctttattttttttttttt

SEQ ID NO: 67050 - DNA, 389 bp, Zea mays
  Clone ID: LIB3076-040-Q1-K1-A3
acgcggacgcgtgtggtggccgctcgcgatctataactagagcgcctgtgtggaaggagagggggggcgcggcctcaaccgggggttcgagctcgcctgctgcttgttcccgagtgcctgttcccgtcctagtttacatagggccgatctcttccctggattgactgccgccgccggtggcggtcggtcttagcgtcatcagagatcccgtctccagcagcaaccatctgggctgcccaccatcaccacgtcttcgactaacatcctttctctttataccatattgccaatgttttccgatgctgttgcaatgagcatgtcatcgaggatcttagcttttccttttagatcctatcttcttctaattattccgtcaggttacctatctt

SEQ ID NO: 67051 - DNA, 319 bp, Zea mays
  Clone ID: LIB3076-040-Q1-K1-A5
acgcggacgcgtggggtggccgctcgcgatctataactatatcgcctgtgtggaatgagagcaggtgcccggcctaaacccgccggtcgatctcgcctgctgcttgttcccgagtgcctgttcccgtcctagtttacatagggccgctctcttccctggattgactgccgtcgccggtggcggccggtcttagcgtcatcagagatcccgtcttcatcagcagccatctgggctgcccaccatcaccacgttgtcgtcaaacatccttcctctttataccatattgccaatgtcgtctgatgctgttgcaaagagcaag

SEQ ID NO: 67052 - DNA, 388 bp, Zea mays
  unsure at all n locations
  Clone ID: LIB3076-040-Q1-K1-A9
ggacagcaatgtacaggaagcagcacaagaaggatatccatgctgaagcagtaaagaagaggcgccgcgccaccaagaagccatactccaggtcaattgtgggtgcttccttggaagtaatccagaagaagagagctgagaagccagaggtccgcgatgctgctagagaagctgctcttcgtgagatcaaggagcgcatcaagaagaccaaggatgagaagaaagcgaagaaggcggaggtgagcaagtcccagaagacgcagacaaagggtgcggtccagaagggttccaagggccccaagttgggcggcggtggtgggaagcgctgaaagaacttagntgtcgttctcgacattgcagtcgttccttagccaaagccactttcgta

SEQ ID NO: 67053 - DNA, 156 bp, Zea mays
  Clone ID: LIB3076-040-Q1-K1-B1
tctaacgcatgatcagtactcttttaccgactcttgctttcttatactcctcttaatctctcgttctcttttataattcggatggtgctcattcacattagtccaccttctccaaagtcatcaatgctttcgatgtccattatgtcacctccaact

SEQ ID NO: 67054 - DNA, 384 bp, Zea mays
  Clone ID: LIB3076-040-Q1-K1-B12
gccgactcatacgtgcagcctccaatataatccgcaatttcgcttttatgccagaaaatgagattatcatggtggaacatattcattggttggaagctatatttcattgcttataaaaccagaatatataatatgatgagctcataacaaacatgctggatacccttgtcaatttagcacctttgctggacctgaggatcttcatctcatctaagccctcgttcattaaaatgaccgataaaggtgcaattcatgccataatgggtattctttcttcttccgtaaagccattgcactgtgctgctgctgaattgattttccgtcttataataaatccatactacgatccatttcttcttcctattattccacatatatacaaac

SEQ ID NO: 67055 - DNA, 441 bp, Zea mays
  Clone ID: LIB3076-040-Q1-K1-B8
gaagaaacagaaaagtcaagaaaaggcagttgctgcaccttcaaaatcaagtccggattccgggaagagcaaggatgacgacgattctgatgaggacgagactgatgattctgatgaggatgagacggacgattctgatgagggtttgtctcctgaagaaggcgatgatgattcaagtgatgaagatgataccagtgacgatgaggaggaagacactccaactcctaagaagcctgaggtaggcaagaagagagctgctgaaagttccgtgctgaaaactcctctatctgataagaaagcaaaggttgccacaccgtcatctcagaagacaggtggcaagaagggcgccgccgtccatgtggcaactccacacccagcaaaaggcaagaccattgtaaacaatgacaaatcggtcaagtctccaaaatctgcgccaaaatt

SEQ ID NO: 67056 - DNA, 291 bp, Zea mays
  Clone ID: LIB3076-040-Q1-K1-C12
cccaaacacgttttaactgaggttatcaacctactatcaagaaaaccttcaaggagtactttaacgctttagcatcatcacacttcactacacaaggtgaggatacaatttaagtcaattcttttctgttcctgctacaatgaaggaagatataactgcttatattacgaataccaataatatcatactatatgttaatcgtgtattcatatcatatgactttgatggagaattgttcccaacatattcgagctttgtcaaaggtgttgttgactcaaatgaccttccatt

SEQ ID NO: 67057 - DNA, 272 bp, Zea mays
  Clone ID: LIB3076-040-Q1-K1-C6
gctcccacgcgtccggagagagagagagagaagattagagttaagagagatagagagagaggagtgagatagtcgctattggctgccgtgtagttaccttatactcatctacttctaatgatggataatgtgattgcctgtatctgacctatcatgcattacttgtatcctttcttttttcttaataatgctcctaccttcttctcctataatgtttataatgctctttaattcttttctcctttccttttcttaaatttataccattaata

SEQ ID NO: 67058 - DNA, 387 bp, Zea mays
  Clone ID: LIB3076-040-Q1-K1-D10
gacccacgcggggcgttaacttctgaaccccaaataggtttcaactgaggattacaattattttttcaagaaaaccttcaggcattactttaaccctttggcatcatcacacttcactactataggttaggtacaaattacgtcaaattctttatgttctgctacaaagaaagaaaaattaacttcttataataagaaaacccacaatattatactatatgttaaacctgtattcatatcataataccttttattgataaaatttcccaaaatattttaactttttcaaatttattttttactctaaatacccttcctttaatgtttctctttagatttttcaataaaatccaattgttcttataattaaaaaaaagcttattctta

SEQ ID NO: 67059 - DNA, 429 bp, Zea mays
  Clone ID: LIB3076-040-Q1-K1-D11
cccacgcgtccgcccacgcgtccgcccacgcgtccgaaaacctgtttattatcatgtgatggttttgtgcttgtagtagaattttgaagttggagctttgttcttggaggaatgaatggttattgtgaaaaagatctttatttttcaactatatcacgtgtaactattaacttggtcctttcaactttatctctgtgcttgaaagtgcccagcacccactcctgcagtacttttggtcaaactgccaaagtactacttggtacttagtgttagatgtaaatagtgtgcatgtatttagtctctagtacagggtgctgtttgcactttgtacttcatatttggctctttggccgttgcaataggctgagctgcacattcctagcacttagcacctttaattttaatcatcataaatgacatcctttaatc

SEQ ID NO: 67060 - DNA, 404 bp, Zea mays
  Clone ID: LIB3076-040-Q1-K1-D3
ctgaggttaaggccccaaagattgaagaagcttctcaatctggagatcgcatatttgccaggcctcttgcccgtaaactggctgaagataacaatgtcccactatcaagtgtgaaaggtactggtcctgatgggcgtattttgaaggcagacattgaagattacttggccaagggtgggctgagggaggcttttgcagctccagggttaggttacgttgatattccaaatgcacagataagaaaggttaccgcaaaccgcttgctagcatctaaacagaccattcctcattactacttgacagtagatgcacgtgttgacaaacttgtcaagttgcgaagtgaactgaatccactgcaagatgcttctggtggaaagaaaatatctatcaatgatcttgtcatc

SEQ ID NO: 67061 - DNA, 155 bp, Zea mays
  Clone ID: LIB3076-040-Q1-K1-D7
acgcatccaaacaaacctaagcttttcaattctcctatctcacattctccaagcctatttcccattaactctctccatataacaacttaccactatcaactttcaaatctactatccctaattttcatctttataaatcacacatttaacattac

SEQ ID NO: 67062 - DNA, 432 bp, Zea mays
  Clone ID: LIB3076-040-Q1-K1-E1
cccacgcgtccggatccaaacaaacctctgtgttggggttctccggggttccttgcgctggagggaggtttcgttctcgctggccatggtttggctgagaagcagcagcggcagcatcttgatgccaaatctctgagctttatgaagatcgccactcacctgcgccgctcctgcttcctccactccttctcggttgtcttcctctactggttttatgtgatctcataacttgccctcccccggatccgccattcccccgtgccctctctccgtcccctcaaccttctccctcctttcttgcttccctcaacaatcgccaaataacagcactagcggcagcggtagaggatcttttcgaggtaagctaggccggccggttccctgcgggaaaaagaaaagaaaaggaacctgtcttgatgtcgtcgtcgtcgc

SEQ ID NO: 67063 - DNA, 438 bp, Zea mays
  Clone ID: LIB3076-040-Q1-K1-E3
cggacgcgtgggcggacgcgtgggcggacgcttgggcgctcaaggtcccagccactgttcgtcccggggccgatgactgcgaccagctgcgcaaagcattccaagggtggggcacgaacgaggcgctcatcatctccatcctcggccaccgcgacgccgcgcagcgccgcgccatccgccgcgcttacgccgaggcctacggcgaggagctcctccgctccatcacggacgagatctccggcgacttcgagagggccgtgatcctgtggacgctggacccagcggagcgcgacgcggtgctggccaacgaggcggcgcggaagtggaagcccgggaaccgtgtgctcgtcgagatcgcctgcacgcgcaccttcgcgcagatcttcgcgaccaggcaggcttatcacgagcggttcaagcgctcgcttgaggaagaca

SEQ ID NO: 67064 - DNA, 149 bp, Zea mays
  Clone ID: LIB3076-040-Q1-K1-E7
ttgctctgacactttggcagactcttttgcatacttttgggctctcaatttcccaaccactgttccgtcctggtccaatgactacgagcagctgctcaaaacattccaaggctatttcactaactatgctctcatcatctccattctct

SEQ ID NO: 67065 - DNA, 120 bp, Zea mays
  Clone ID: LIB3076-040-Q1-K1-E8
gactctacacttgggttgatactgggcatcaagtacagtttataaatgtgttctaaagaattgcgaaccagtggcatttaaaaagctgtatgcccactaccctcatagccttaatgaatt

SEQ ID NO: 67066 - DNA, 234 bp, Zea mays
  Clone ID: LIB3076-040-Q1-K1-F12
cctcccactcttcctttccgtttctgctttgattctaggactacgtgccgcgcgtactttctaacttgtcaggccttgatatttgttgaactagcgcctcatcctccaccttcaccactaactctccgaagaccatgcctagatccaatggcaactattctcctcttcttacttctcatcactcacctctttacctcaatactactgccttcttctaagctaattgctctcacc

SEQ ID NO: 67067 - DNA, 462 bp, Zea mays
  Clone ID: LIB3076-040-Q1-K1-G1
cttactcttgggctacttcgttcattagattcatgtctatgggttctagatatctgtcaatgttaaaatttaaagcggccaggacccaatatttcttcttttttttttcctttttattcttattatttactttttttattattttgttttatttttatattttttttttttttatttttatttttatatatttttttttatttattttttatttttttttttatttcttttttattttttttttatttttttttatttattttatttattttattcttctattttttattctttttattatttatttttttatttattattttttatactatatttttatattactttttatttatttttcatacttttatttttttttatttttattttttttatattattattatttttttatattttttattttttttctttatttcattttttattatattatttatt

SEQ ID NO: 67068 - DNA, 444 bp, Zea mays
  Clone ID: LIB3076-040-Q1-K1-A10
cggccagcttcctccccgctagctcactagccaggcccgggcgccttaccgccacggtgaccgccgccttggttgaggcctgcggcctgcgctaacccggaagtctctcagtgcgtgtttggccgaaatccacggggagggcttgtcctcgcctttgctgagctgctccggagcggagccgtgcctacttgagttcaggtttgtttcgccatccgaggccaagattcggagcgtcgccgaagggaggcgatgaagggcaaaggcgggccggtggacaggaggtcctccgccaggtggaggttgctggtgctctgcgcattcagcttcggcatcggcatgctcttcaccgaccggttctggacagcaccggataccaatagccataccatgtctcaacgcttgatgcaagagcaagagcttcaacttgtatcagaagattgcatc

SEQ ID NO: 67069 - DNA, 336 bp, Zea mays
  Clone ID: LIB3076-040-Q1-K1-G12
tcaagacacttcttaaagatgcgagggaggtgcataggttagcggacgggctcacttcaacgcctgctgtgaggaagtaagtgtcggatgagcttgctgtggtggctgagtctaaagatgttgctggggaatttatcacttatgctgtgcttgatcaagttcttggtgataaggcattttgaaaattatggaagtggttcatctcgcttcgtttttcataccatttggcaggatcttacataaaggtcctttcattcaagtttgttttgccagatgcaattcaaatgttatagatgacaatataatttgcttcttgtccatactaacattatttgt

SEQ ID NO: 67070 - DNA, 285 bp, Zea mays
  Clone ID: LIB3076-039-Q1-K1-C7
acacgtctccactcatcaggaatattcgttctcgccggcgtctacggcctacgggtcaagtaacttttaaacgttcgtccggccaatgaacggtatggaggcatagatgatcgatgtggtgctcaacgaccgcctgttgaagaatgtgcggttcaagtgcaactatgacgacaccatctgctacctcaataatctgtttacatcacatactgtgactcgcccctataatatcctcattcataattgttacaacatctacaattaccacatcaccctcaaagacta

SEQ ID NO: 67071 - DNA, 461 bp, Zea mays
  Clone ID: LIB3076-039-Q1-K1-D4
tcccactcgtccgcttacatacaaacctgttagaatcttaggacattcgtgagcctgcttcggttcggtaggattatgcaccaggtgaagagcctgttctggtaccacctgttactgaagttgtttcacctcccaagtccgaggtgtccgatactggtgacttactgggcttttatgatccaaatccttctgtatcatctatatattaattgcaatttctctttccttgtctatttttcctacatatttttcttttctcattctctttttctctttattttaattatttttttttttttttttatttttttttatctattttcttgttttttttttttattatttttcttttttttttattttttcttttttttattttatttttttttatttattttattatttttttttatttattttttttatttttttatttttatttttttttatttttattattt

SEQ ID NO: 67072 - DNA, 430 bp, Zea mays
  Clone ID: LIB3076-039-Q1-K1-D5
gcagcggagcaggtagaacgctgcacaatccccttcgccgccgccaagatggggaactggcctaataccaagaagacgtagtgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattggtggagacaagaagggcaagggcacatctcttttctaagcttctcgtccacctgtctggttgttgagttgaagctgtgggtctactactactgttataaaaa

SEQ ID NO: 67073 - DNA, 444 bp, Zea mays
  Clone ID: LIB3076-039-Q1-K1-D6
gcgggccgtacgccaccacggcaacggataagaggactttcagctgcgacggcggacctgcgcaacaacagggatgggggatggacgaacaaacagtgcaagaagcacacactccacaagatgactcagtataaaaagggcaaagatagcctgtctgcccatggaaagcgccgttatgaccgcaagcagtcaggatatggtggtcagaccaagcctgtcttccacaagaaggccaagaccaccaagaagattgttctgaagctgcattgccagagctgcaagcactactcacagcacgccatcaagagatgcaagcattttgagattgatggatacaataaaggcaatgtcacatctcttttctaaacttcatgttcacctgattggttgttgagttgaagctgtgggtctactactactggtataaaaacattgtttcaaaat

SEQ ID NO: 67074 - DNA, 383 bp, Zea mays
  Clone ID: LIB3076-039-Q1-K1-D7
cagcccacagctacaacgcttcacatttccattcctcgccgccaagatggggaaccgtcctaataccaagaagacgtactgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattggtggagacaagaagggcaagggcacatctcttttctaatcttcttgttcacctgtct

SEQ ID NO: 67075 - DNA, 367 bp, Zea mays
  Clone ID: LIB3076-039-Q1-K1-D8
actccaataacaaatattccaataatcacacactccacaacatcactcattataataatttcaattatagcctttctacccatctaaaactcctttattacctcaatcattctattatattctgttcataccaatcctctcttccacaataattccaataccaccaataatattattcttaatcttcatttccatatcttcaatcactactcacatcactccatcaatatattcattcatttttatatttttttatacaaaatatactaattcacatctcttttctaaacttctctttcacctttcttgttttttattttaaacctttatttctactactactattattaaaacatttctcaaattt

SEQ ID NO: 67076 - DNA, 444 bp, Zea mays
  Clone ID: LIB3076-039-Q1-K1-E3
gaaggatgcctttgtcctctgccgtgttactaaaagaaatgactggtcattagataatggtaatggggtgggcaacaggagctctcatctggaacaaccagatgctgctacatcagttgtcagcactgtaaagccagaagatgttgctgcctcagtcatctgtccagaagaatcgaaccatgcaactacaccaattggcagtgctgaactatctaatgatgttgctcaggcagctatcactcctgcagctatcactcctgattcaacaactccaaatggtggtaatgaactggaaacatggctgcaagaactgttggatccttcacctccatttaaccttgtagctgatactggttctgctgacgtgtgtccgactgaacaatatgctgaatcatcaaatttgcagaatcctggttccatggctccgaatatcaaaccaggcca

SEQ ID NO: 67077 - DNA, 360 bp, Zea mays
  unsure at all n locations
  Clone ID: LIB3076-039-Q1-K1-E4
taaggatgcctttgtcctctgccgtgtttttaaatgaaatgactggtcattagataatggtaatgttgntatcaacaggagctctgatctggaacaaccagatgctgctacatcagttgtcagcactgtaaagccagaagatgttgctgcctcagtcatctgtccagaagaatcgaaccatgcaactacaccaattggcagtgctgaactatctaatgatgttgctcatgcatctatcactcctgcagctatcactcctgattcaacaactccaaatggtggtaatgaacttgaaacatggctgcaagaactgttggatccttcaccttcatttaaccttgtatctgatactggttctgc

SEQ ID NO: 67078 - DNA, 193 bp, Zea mays
  Clone ID: LIB3076-039-Q1-K1-E9
cttaatgcctattaactgatacttaatccttaaacccttactgctgtctttcttgccaactgttacatcttcctcttttatcttttaatctgcatccacctctttcctctatttcttcatatcatacaattcataatctaaatatatatatataaatactattattacccttttctttctatttactatttat

SEQ ID NO: 67079 - DNA, 432 bp, Zea mays
  Clone ID: LIB3076-039-Q1-K1-F1
ttcccggtcgcccacgctcgcccgacctcccaaaaatctggcggtatcaatattgccaaaggaatagcgagggagaatggacattcaaactggatgggcactctatttctctgctgactcattcgacaggtattgttcacagaatataaaacctcaaaatgtgatatttttatagttatcactaacctttaattatttaccttttatattatcttactcatttttttttattaatctaattcttatttaattttttattttttatttctttcttttttatttttttattttaattccttctttattaatttttctatttttttttttttttctaatcttttatattattctttatctttcttacatatttctattttcaatcacttttttttttttatttttttttttattattctttttttttttttttta

SEQ ID NO: 67080 - DNA, 367 bp, Zea mays
  Clone ID: LIB3076-039-Q1-K1-F10
cggacgcgtgggcgcgtacctcttcggcggtttgtgcgtgtcgagcatggggcgaccgttggcgaactagcagggggtggcgtggaaggtcctgagcgacgacgacacgccgcactgcctcgccttcatgttcgtcaactggtccttcgtgtgagtgaggaccttccccctagcagagccagccagtcgcgcgcgcccgcccgcctagcatttgcagctgttatttgttgaactctgtatccaagtactggtcgctcttgcctttgtccaggcaatcctgtgaaacgcacctgccccccagttcatccgtggaacaaacgccttttgtagttgcttgcttgctatgttatgatggatcctggtctgc

SEQ ID NO: 67081 - DNA, 444 bp, Zea mays
  Clone ID: LIB3076-039-Q1-K1-F2
cggactcgtgggcggacgcgtgggttcaagggagcgccgccctccaagaagccaaagtggaggtgaatgctgccttcggcgattcgctcgtgccaaagtgcagcagcttcaagggagcaccacctccaagaaggcagctctggttaatgggactccttgaagctttggcccccggagtagacgtgtctgtaggagtgtggtttgttatatctagattatctgcagtagcttagtccatctaaatgaaatgtgacagctgaactttggaagtcgcatcattggggaaacgaaatttaagtcgattgatttgttaatgccctcgttgatgtaatatttcccttgttcggtggatttccggtctgtataatatttatgcacgcttgcactttatccatggtatttgtatacccgtataaggcagcatggaggatgtttcttgcatgt

SEQ ID NO: 67082 - DNA, 436 bp, Zea mays
  Clone ID: LIB3076-039-Q1-K1-F5
ttctgaactacaagccctgcaaaaggaaaagagtactaggctctcaaggattcttgaatgcgtgagttcagtgcacgatcgctgttctgtacttggcatggattttgtgggcactgttactaaagttcatccaagtcttgatgactctgttggtgtccaatccaagagcattagtggcgaaacaatatccaagctgtctaaaatggtgattgtacttgaagaagaaaaatcgaagaggtttgcaaagattcaagctctagcttcccagctatctgatctttggaacttaatggattctcctgtggaggaacagcaaccttttcgtcacgtaacatgcataatgtcctcaacattggatgatgtgatagttccaggagctctggctcttgatgtaattcagcaagcggaactcgaagttgaaaggcttgatcagcta

SEQ ID NO: 67083 - DNA, 348 bp, Zea mays
  unsure at all n locations
  Clone ID: LIB3076-039-Q1-K1-F7
aactacaagccctgcatatggattatagnactaggctctcaacgatggggaaatgccagatttcaaagcaggatggcccttccatactttacatgtattctgtcggacactgttactaaagttcatccaactcttgatgactctgttggtgtccaatccattatcattagtctcgaaacaatatccaaactgtctaaaatgattaatgtactttaataacaaaaatccaatacgcttgcaaatattccaactctatcttcccaactatcctatccttgtaacttaatgtattctcccatggaggaacatcaaccctttctttacctaacattcataatctccttaaca

SEQ ID NO: 67084 - DNA, 267 bp, Zea mays
  unsure at all n locations
  Clone ID: LIB3076-039-Q1-K1-G2
cccactcgtccgctccttcccttctcggttcgtgttcaggttctggttganttggtagatttaagagatggcggcgtcagacgttgagtaccgttgcttctttggcggcctcgcctgtgccaccgactaccactccctcaacaactccttcagcacctacttctaggtcctcgagtcgaagatcatcctgtatcggtagactcatatgtccctcgtcttctgcttcttcaccttcttcacggatgactctattcgcatctccatcta

SEQ ID NO: 67085 - DNA, 193 bp, Zea mays
  Clone ID: LIB3076-039-Q1-K1-G7
gtactcgatccaaggatcagtaaacataccagacacttgttatcacaacaatacatgctcaacctatactgttaattctcaactggtgcgacagcgattctactatttgtgcttgaataatgctttagcatttcgaggtgctgcacacttctcattgtccatctatcataatatcttacatgcacgcactgat

SEQ ID NO: 67086 - DNA, 434 bp, Zea mays
  Clone ID: LIB3076-040-Q1-K1-A1
cggacgcgtggggtggccgctcgcgatctagaactagagcgcctgtgtggaaggagagcagctgcccggcctcaaccccccgttcgatctcgcctgctgcttgttcccgagtgcctgttcccgtcctagtttacatagggccgctctcttccctggattgactgccgccgccggtggcggccggtcttagcgtcatcagagatcccgtctccagcagcagccatctgggctgcccaccatcaccacgtcgtcgtcaaacatcctccctctttagaccatattgccaatgtcgtcggatgctgttgcaaggagcaagtcagcgaggagctaagctttgccttcggctcccgtctccgccgaagcatccgtccgggtcaccgagctttcaagactgacgaggtcatccacatatttctcattcatcacctgcgaag

SEQ ID NO: 67087 - DNA, 324 bp, Zea mays
  Clone ID: LIB3076-039-Q1-K1-C6
accgtctcgactcgtggggaatattcgttctcgccggcgtcgacggcctaggggtctatgaacgttcttacgtccggccggggaatgagcggtagggaggctgagatgatcgatgtggtgctcaacgaccgcctggggaagaaggtgcgggtcaagtgcaacgatgacgacaccatctgcgacctcaagaagctggtggcggctcatactgtgacgcgccccgagaagatcctcatccataagttgtacaacatctacaatgaccacatcaccctcaatgactactatgtccactacagcatggtccttgagctctactacaac

SEQ ID NO: 67088 - DNA, 264 bp, Zea mays
  Clone ID: LIB3076-039-Q1-K1-A5
atcttgatgatcttcttggacctataagagaggaacaacaccgaatggaatctgtacacctacactacggggtaccgcatgctgtgtgggaaagatgtggtctttgagtaccctatggccgaaaatgcataaatatgacgcccggatatccccattttattttgttgaatctgtatgattctttggggtcttaactatactgctccgtatgtacttcaaaatcctatatttttattccaaagttgttgcctatgaattttgtac

SEQ ID NO: 67089 - DNA, 396 bp, Zea mays
  unsure at all n locations
  Clone ID: LIB3076-039-Q1-K1-A6
cggacgcgtgggcggacgcgtgggggatggtgtgccttagcctcctaaacacgtggactggcagtggatgtgagaagtggaacccggccaattcaactatgctgcaggtcctggtctctattcaagctttggttttgaatgcaaagccttatttcaatgagcctggctacgctatgcatgctaacacagcccacggggagaagaaatccctgacatataatgaagacacgttcctgcactcctgcaggacgatgctgtattctcttcgaaatccaccaaagaatttcgaggattttgttgctggccatttccgcaagtatgggcgcaacatcctcgtggcttgcagagcctacctggagggtgcccaggttggatgcctctncggtgacggagtgc

SEQ ID NO: 67090 - DNA, 357 bp, Zea mays
  unsure at all n locations
  Clone ID: LIB3076-039-Q1-K1-A7
acccactcatccgcgggcaccttgacggactccttggactttttgtaccttaacctcctaaacacgtanacgtacactttatatcagaagtggcacaccctcaattcaactattctgcacttcctgttctctattcaagctttggtttttaattcaaagccttatttcaataagcctttctactctatgcatgctaacacatcccaccttgataacaaatccctgacatataatcaagacacattcctgcactcctacacgactattctctatactcttccaaatccaccaaataatctccatgatctttttactagccatttcctctaatattatctcaacatactcatctctttc

SEQ ID NO: 67091 - DNA, 441 bp, Zea mays
  Clone ID: LIB3076-039-Q1-K1-A8
ccccgtcggcgcctcctcagatttaatttggacgccgccgccgccgctgacccaggttggcttgatggcgcccgctgtagaagccgtgaaggagacaggctcgttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactgatcaaggtggaccgtgtgctgtattcgtcagttgtttaccctcacaactatggattcattcctcgcactctttgtgaagacagtgatcctttggatgtactggttataatgcaggagcctgttatcccaggctggttcctacgtgcgaaagctatcgg

SEQ ID NO: 67092 - DNA, 379 bp, Zea mays
  Clone ID: LIB3076-039-Q1-K1-A9
cgacccacgcggactccccgtcttcgcctcctcagatttaatttttacgccgccgcctcctctgacccgtgtttttgtgatatttcccgctgtagaagccgttaattatacatgctctttccataaggttccttccttgaactaaaggatactgtcatccatgtccagtaggtctgttgctgcacacccttggcatgatctgtagataggtcctgttgctccaaccatattcaactgcgtcattgatataccaatgtgcagcaaggttaaatatgaacttgacaagaaaactggactgatcaatgtggaccgtttgctgtattcttcatttgtttaccctcacaactatggattcattcctcgcactctttgttaatac

SEQ ID NO: 67093 - DNA, 300 bp, Zea mays
  Clone ID: LIB3076-039-Q1-K1-B10
gtgggttggcttctcctccccctccggttcgttttcaggttcgcgaggttctcctgacttcggtttcgggggtcagcggatcgagatctcggcgtctgatgctgagtaccgctacttcatcagcggcctctactgagccaccgactaccacttcctacacaacgccttcatcacctacagcgacgtcctttagtccaagatcatcctggatcgctatacgcataggtcccgcggcttctgcttcatcaccttctacacggacgacgcgatgcggaacgccataaagggcatgaactgcaa

SEQ ID NO: 67094 - DNA, 412 bp, Zea mays
  Clone ID: LIB3076-039-Q1-K1-B11
gaacgacccactcgtcccacacgtacgaaaagtccaactaacagacccattacaactctatcctcctctaacactctcacggtatactgcaccatttaacattgaaagacctcatctgcatcactttatgcagccaatattcaacatctcctaactgccatgtacagtctacaccaaccaactcaatgacattacaataatgatagatacatgcatcactgacaagactatgatctatactatagaagcttgctaactagctaattaagtcatttatctgagataatcgactaccaatctttcacgaatcagcatatgtaatacagttaccttgacctattacccttttcaaccatttacattaacatagacaactattactacaaacacttcaactgatccactaacattc

SEQ ID NO: 67095 - DNA, 453 bp, Zea mays
  Clone ID: LIB3076-039-Q1-K1-B12
tgccgacgaggggtactgcctcaccgtccgctacggcaacgtggtgctggcccgggccaaggcgagcgactagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagcggcgacgtgggcaagggcttccgctgcatccgcatggtgaacaacatccgtctcaacttcgacgccttacacggcgacaagggccacggcggcgtgcacgacggcaccaccgtggtgctgtgggagtgggccaagggcgacaaccagagctggaagatcctgccctgaggcgacgaggcctacgccgcggg

SEQ ID NO: 67096 - DNA, 314 bp, Zea mays
  Clone ID: LIB3076-039-Q1-K1-B2
tcctcctcacatttaatttttacacctcccccatcacttacccgatatggtttaatttaacactcgttaggaaccctttaattacacatcctctttccaaaatattcctacctttatctaaatgatactctcatccatttcctataaatcttattcttcacaccctatccatcatctttatatatatactattactccaaccatattcaacatcttcattcatatacctatttacatcaattttaaatatcaacttttctatataactctacttatcaatgtttactctcttctttattcttcatttttttacc

SEQ ID NO: 67097 - DNA, 361 bp, Zea mays
  Clone ID: LIB3076-039-Q1-K1-B3
tcatacctcacaccaaaccctcacattctacttctcatcaccctacaaaattcccggccaagttcaatttaaaaaccttctggccaataaattcatccttacccactaacacctcaataatttcatcttcttttttattctacctcaatcacatctctttcctactattatacttctcaccctacaaacacatcataccatatctcaaccttcataatcacattcctttccaaaatacaactctcaaaacctccatttactacaattactccttcttctacaaatttatcaactacttcattaacatatcttcatctatccatacatcctttcccaatttcatacttcttcttttctaccc

SEQ ID NO: 67098 - DNA, 356 bp, Zea mays
  Clone ID: LIB3076-039-Q1-K1-B5
cggacacgtgctctgacacgtgggattcgttcatcacctctacaaaattgcccaccaggatcaaactatagcctttctggcatagacattcaaccttcccctgttacacctcaatatgatgatcttcttgatggtacttcctcaatcacatctcttccctattagaatactgcttaccatacaatcacagcattccatattgcaacctacatgatcacattccttttcaaaaagcaacctggaaaacctcaggagactacaagtaatgcttcttctacaaatctagcaactactgcattaacatatttacacttccatgcagcccttccaaagttcatacagcagcgtatcgaccc

SEQ ID NO: 67099 - DNA, 278 bp, Zea mays
  Clone ID: LIB3076-039-Q1-K1-B6
cccacacgagctctgacacctccgttccattcaccacgcccccataattcacagccttcgcctaactaccgagctggtgattatcaatgtcattcttaccaactatgattaccataagatcaaattcttatcgacactgtcagaatcacctgcaaaccctgataactcactgcgcaacatacctaactttcccacctaatccaaagttacctactatccatgcttgctgctgtatcatcaacaattcaaactgtatctgcttgagctccaaggtctcc

SEQ ID NO: 67100 - DNA, 286 bp, Zea mays
  Clone ID: LIB3076-039-Q1-K1-B7
tcatcctcccacacgacctctgacacctccgctcctattcaccacgcccccatacttcacagccatcgcctatttaccaagctggtggttatcactctcattcttaccaactttcattaccataagaccaaattcttatcgacactgtcagaatcacctccaaaccctgataactcactgcacaacatacctaactttcccaccttatccacagttacctaccttccatccttgcctctgcatcatcaacaattcaaactttaatcgcttgaactccaagatcacc

SEQ ID NO: 67101 - DNA, 254 bp, Zea mays
  Clone ID: LIB3076-039-Q1-K1-B8
cccacgcgtccgggcaaatgtttcttgcaagtcagcaatgtgattatcttgctgtgagcgctttactatcatatcaggaagataagttatcacattcctgcctatttgagaataaaggacattgtccttcattctactgaaactatctccagcattctctaacccctcactcattaacatgcatcaatattcgccattatcaattattacgtctttcttatgcttattgctcgctatcatccatatctgatgat

SEQ ID NO: 67102 - DNA, 326 bp, Zea mays
  Clone ID: LIB3076-039-Q1-K1-C10
gggttggcttctcctccccctccggttcgggttcgggttcttgaggttctccggggttcggtgtcatgtgtgaactgatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaagaggcgatgctgaacgccatcgacggcatgaacggcaaagaactggactgccgcaacatcaccgtc

SEQ ID NO: 67103 - DNA, 422 bp, Zea mays
  Clone ID: LIB3076-039-Q1-K1-C5
gcgccgtctcgactcgtggggaagattcgctctcgccggcgtcgacggcctagggttcgagtaacgttcgtacgtccgtccggtgaaggagcggtagggaggcggagatgatcgaggtggtgctcaacgaccgcctggggaagaaggtgcgggtcaagtgcaacgaggacgacaccatcggcgacctcaagaagctggtggcggcgcagacggggacgcgccccgagaagatccgcatccagaagtggtacaacatctacaaggaccacatcaccctcaaggactacgaggtccacgacggcatgggcctcgagctctactacaactgaaccggcggccctctcttcctctcgtcaggttggtctgaattctgaagtcattggtgcaattcgcttcgcggtgatctcttaagctcatcacat

SEQ ID NO: 67104 - DNA, 321 bp, Zea mays
  Clone ID: LIB3076-039-Q1-K1-A4
cccacgcgtgcgcccacgcgtccgaccagttgtcttatcccgccatggttagctcttacgccacctgtcgcgcctcgccaagcggttcactctgcttggtccctgctatggctcgccatcgtttttcccagctcgaatcttgcccgacccaagctgaacttcatccatggccactatctattcttcctagacggactcaagcgccctagacttcggtggttttagcttgacaccaactattctagtcgtgcgtgctgatgtccgagctcgtcctaaatgaactacattggtgtccgtaccatgcccgtgcttatccatggt

SEQ ID NO: 67105 - DNA, 331 bp, Zea mays
  Clone ID: LIB3076-038-Q1-K1-G3
cggacgcgtgggttctacaaaagctattgcagttcctgaggaggccaatttgggtagcaggtctggcagcaactgcaagttaggagtggatgtgaatacaatgccagctattacagataaaagtgagccttttttcatgtctaaaggttggagggagacactatgcaggtgtgaaacatgcatcaacttgtatgcacaacgaggtattgcatatcttattgacaaggaggattctattgaggaatacgagaagattgccaagcagaagagggagatgaaactggagcagcagcaagggagctagacaaattttctgaattcacttaatcat

SEQ ID NO: 67106 - DNA, 337 bp, Zea mays
  Clone ID: LIB3076-038-Q1-K1-G4
caccagccgccgtcatgtcgaagcgaggtaggggaggttcggctgggaacaagttccgcgtgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatcc

SEQ ID NO: 67107 - DNA, 330 bp, Zea mays
  Clone ID: LIB3076-038-Q1-K1-G5
gcagaaattcggacaggccaatggcaaggcagagatggtgaaactgggacaagaggcatcgcttatggatatttccggttcccagtccctttttttgttctgaaaagatgggcaaaataagtcgttacttatttgtttgtcgtgtttgcttggtctagaagattgttgaggattgagataactccacatgaagttattggtttgtcaactctatgccgtaggatgttttgcatttccctttttgccatctaccatgtcaaaacgatatcttagcaacctgcgatactaactgttatgcttactggattccagttcatcatatgtcactag

SEQ ID NO: 67108 - DNA, 334 bp, Zea mays
  Clone ID: LIB3076-038-Q1-K1-G6
gcgatgcactccaaccaggcctcttaagttagatttagcttatatcccgaattacatgtactggtagcatgggaatgttctaatgagttctgctttgtttttcaattattatatagttaatatttgtggtgatggatatgttcacgcatttgctgtttacagaaaagcaggtggttacaccaacatataatgaactgatagttgttggagatggtcattcaagtaccatatctgttcgtgcatctggtaacgaccttataagaccatttgatgttgctgttgttgtacccacttgagcttgaccccttttcatggttcacatcaaaatgattat

SEQ ID NO: 67109 - DNA, 238 bp, Zea mays
  Clone ID: LIB3076-038-Q1-K1-G7
cggacgcgtgggcggacgcgtgggtgcttaagaaggcatcaagtattactggctcagctggcatcagaatatttgctcatcttcttggaactattttaaggaatcttttactaatgcttttgttgtgatgtctattcttgttattatttgagattactctgtgttgtcactttaatgctctgttctttgtgacatgtgttaatctcactttattattcatatatattattcttcatct

SEQ ID NO: 67110 - DNA, 292 bp, Zea mays
  Clone ID: LIB3076-038-Q1-K1-G8
cccacgcgtccgggatgaccgtgttggaggaggaggaggagaagaagaccgggctgccggggtacgaggtgaagcacaccaggttcatctacaacagtgacgacgagatcgagcgggtagatgaggctgatgcagctgaagctactgcggagcttcgcgcattgatgttcatgggcctgctggtgccggatgggaggcacctgcgcttccacgacgaggatgccgactaataagaatctcagttgtgttgtcaagtggttggttgtctttcgctgacaccagccaaaattct

SEQ ID NO: 67111 - DNA, 433 bp, Zea mays
  Clone ID: LIB3076-038-Q1-K1-G9
cgtttggcgagggatgtcattcactgcactttgcccctggtggctacccggcaggggcagggatgctgaatctaagtagctgtgctgtatctgcaccatcaagaactcatgtggatcatgccgctcttaccggggcctatcattcatcttctaccgtcaacacacgcatgtgcaccaagtacaacactacacaatgctgcaagttcggtgatcagtgccatttcgctcatagcgaaagatagcttgctaatccagactacatgtctcaagaaagacctcctatgggtggtcgatatgcacgagctgaacctatgcaaccagcttccatgggcccttcagcaggaaactttggtgccatagagactgccaagatcaatgtggacccctttctggccagtggcataatcagcaatgatggggtcaacactaaaca

SEQ ID NO: 67112 - DNA, 119 bp, Zea mays
  Clone ID: LIB3076-038-Q1-K1-H10
atgagatctgcaagtacctcttcaaggagggcgtgctgtatatccaagaaagagcttaaacggtggaaaaacacccggagatatatgtgcaaaatctacaggagataaatcttatgcag

SEQ ID NO: 67113 - DNA, 364 bp, Zea mays
  Clone ID: LIB3076-038-Q1-K1-H11
atgacacctgcgaagtcctcttaacggatgccgaactgcatgacaaggatgacttctaagggttgaactacccggtgatggacgtgaacaacctggatgctatcaagaatgctcaaactgttaacgccaagaaagctgtccggcacacgccgtcctggggacactactactactgtctcatcaacgaccttattcagcacttacacaactaactgaaaactgcttctgacatcgggaatgccactgtcaaaataactcacaagatagctaccgccctatatgattctgacccatcgtggatacctgcccagggctctcaatgcgaaatgacaagagacttgaccaagcttcggtgacacggatg

SEQ ID NO: 67114 - DNA, 315 bp, Zea mays
  Clone ID: LIB3076-038-Q1-K1-H3
gagttattagccttggcggcaaacaaggacctgcagttcacctacgcgaagcaggaaccagaactgagccccatgggagatgctcctggggaggtcgttgctcccgagcctgcaaagcttactgcggctccaaagcctttggtcaagctggggtccgaggagaggtcaggctggtctcgtcaggaagatgaaatgcatatgaggttatcatgaggatgattagatgctttcgctctgtatagttcctaggttcttggtgtgtacaagttgtagcttgccatggtagcagagtgcacgcttagattttttacatgt

SEQ ID NO: 67115 - DNA, 55 bp, Zea mays
  Clone ID: LIB3076-038-Q1-K1-H4
ttttttttttttttttttttttttttttttttttttttttttttttttttttttt

SEQ ID NO: 67116 - DNA, 321 bp, Zea mays
  Clone ID: LIB3076-038-Q1-K1-H5
ggaagagatcagggaggcgcccaagcacgactcgagcgaggggcagtaaagggggctttaggtgcctagaagctagtacctagtgtttgctgctgtctaatgacactatgcaatgtgatctggaccctggtttcttgggtgcgacgcttgtagcagccgtgttatgattattagtcgggaaaatttgggggctccccatatgagatgctgccgggcaagacctctacatcccacctcgtttcaggcgggggacgctggaacgtgggccggttgtgttgggaagccccttaaactgttgtcgcttgcattttaaccttttca

SEQ ID NO: 67117 - DNA, 332 bp, Zea mays
  Clone ID: LIB3076-038-Q1-K1-H6
gcggcagcgctgacaatatcacatgcatcgtggtccaatttcaccatgacaagaaccggatgagccgtatggctgccaatttcagttgtaccctgcttcagtctattattatcctgcaagctgggtggtggcctggtgggcttctcccagatttaccctgcttcatgctattattatcctgcaagccgggcggtggggtttctcagatctatcgctcatgtagcaactttcaagcactcgtccattgattcttttgttgtcttgtaggaaacatttgttccgacaggtgtagtagacacttttaaactgataaattcaataacgtatgttta

SEQ ID NO: 67118 - DNA, 328 bp, Zea mays
  Clone ID: LIB3076-038-Q1-K1-H7
cgcgtttagaacctctaaaatttcccccactcgccagtcgcagcagcacctgtagccatggacgccagcggagccggtagcaaggggaagaagggtgcggccgggcgcaaggcatgcggccccaggaagaagtcggtgacgcggtccgtcaaggccgggctgcagttccccgtctgccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatca

SEQ ID NO: 67119 - DNA, 65 bp, Zea mays
  Clone ID: LIB3076-038-Q1-K1-H9
aaaaaaaaaaaaaaaaaaaaaaaaaaaaaaaaaaaaaaaaaaaaaaaaaaaaaaaaagaaaaggg

SEQ ID NO: 67120 - DNA, 323 bp, Zea mays
  Clone ID: LIB3076-038-Q1-K1-G2
gtgaactccaaccaggcctcttaagttagagttagctaatatcccgaattacatgtactgataggatgttaaggttttaatgagttctgctttgtttttcaattattatatagttaatatttgtagtgatggatatgttcacgcatttgctgtttacagaaaagcaggtggttacaccaacagataatgaactgatagttgttggagatggtcattcaggtaccatatcttgtcgtgcagctggtaacgaccttattagaccatttgatgttgctgttgttgtacccacttgagctagacccctttccatggtacacaacaaa

SEQ ID NO: 67121 - DNA, 451 bp, Zea mays
  unsure at all n locations
  Clone ID: LIB3076-039-Q1-K1-A11
cccacgcgtccgcactaatcaaatgggaggtctaataacatctttgagtagcaggactatgcggccagtcttcacatcatacatgagttctcacggatcattggtgagctcccctaaagatgttattagtaaaaggaatacatatagaaggtcattttccatctagggtgaatgagcgttctatatgtttgcatagtgtgccatcacacttatcttctggtgctctaaattctgggaacttgttagttcacgatcagctcaggattcccttggctccttgagggcaatgtaatgttagttgaacaacacctttacgccgaaagtttcagcccacgcgtccgctttgaccgccgnctcccttcccctccgctactgctcctcctcaccccactcccccgcaggagcggcggcggcggcggcgaggtcgtaccccacatcggcgagcggcggc

SEQ ID NO: 67122 - DNA, 455 bp, Zea mays
  Clone ID: LIB3076-039-Q1-K1-A12
gcctgatttgtcagcgagcacggtggacaatcagagattgtattgagggtgaaacaaggagagaatccaacatttggattcttgatgcctgaccatcatctccacagctacttccgctaccttgttgatcatcctcaactgctgaaagatggtgctgatactgttggcacgaataaaggcaatactgagagtgagcatgcttcatctggcagggctatatcattgcttgggaccacatatgactcatgagacgagaatgaaggcacactcccgcgtagttcggaaggcatgaatcctgaaaatagcacgactcttgatgtgcagggccatgtaaaatctgcatcaattatgcctgtcaaaaaagaaataggcaaaaatcagaatgctcctcctcctgcagttaaaagaaaaacaatattgatgaagaagaatccgattcttactggcaatagcat

SEQ ID NO: 67123 - DNA, 241 bp, Zea mays
  Clone ID: LIB3076-039-Q1-K1-A2
tcaacacggtaacgcgcctataatgtcacctatagtcaattcactatccaactattcacaacgtcctggactgtaaaaaccctttcgttacccatctaaatcctcattcaaatcatcctcctttcgctatctatcctaacaccgaacacgcccacaccaaacgcccttcatatcattaacacaccctgcttcactaatgcaacacgatccttaactgtgcattaaacccaccaaataattt

SEQ ID NO: 67124 - DNA, 449 bp, Zea mays
  Clone ID: LIB3076-044-Q1-K1-G6
ggggagctcgccctcgtgccccagtccccagacaagtcgctcgcgcgccacaggtgcgtggatgactgcgagggcgccctcaacgagcagatcaacgtggagtacaacgcctcgtatgcataccactccctcttcgcctatttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggccctggaaaagctggtcaatgaaaagctgcacaacctgcatggtgtggcaacaaggtgcaatgatcctcaactgacagacttcatcgagagtgagttcctcga

SEQ ID NO: 67125 - DNA, 447 bp, Zea mays
  Clone ID: LIB3076-044-Q1-K1-G7
caatgatttggcctccgtcagagaggggagaaagacccgttcgaggcggcggcgatgtgggggcactgcaagggcggcaagggtctaggcaagggtggagccaagcgccaccggaaggtgctccgcgacaacatccagggcatcaccaagccggcgatccggatgctggctcggaggggcggcgtgaagcgcatctcggggctcatctacgaggagacccgcggcgtgctcaagatcttcctcgagaacgtcatacgcgacgccgtcacctacaccgagcacgcgcgccgcaagaccgtcaccgccatggatgtcgtctacgcgctcaagcgccaaggccgtaccctctacggcttcggaggctaagcgcctcttcgtagctggggaatgcttagggtgatacgtctctgtcgctaggggtcgtactgttgctgcattcctggatgt

SEQ ID NO: 67126 - DNA, 370 bp, Zea mays
  Clone ID: LIB3076-044-Q1-K1-G8
cccacgcgtccgctgactcgtgttcgggccctgccctttccccgccccaaggggacacggtcgccctcacctgccctagccgcacgagggagcgttcgccgccccgccccgctcctccgtctaccgtcgcctcgcccaccgcgctccgtctgccgcccctctcctgagaaatgtctgagcatctctttgaggacaccttcgtcgtcactagactcgaccctgatggcaaaaagtttgatagagtttctcgtgttgaagctcgcagtgagcatttagatatgtatatgcagctagatgttgccacagatgtttatcctatgcatgcttgtgagatattaacatggttatagcgcctactctgaatttggat

SEQ ID NO: 67127 - DNA, 335 bp, Zea mays
  Clone ID: LIB3076-044-Q1-K1-H12
cttgcagctttcctatctgccagtccttttcaacagaaagacattgtggtcacaattccttcagcaggtgacagtgaaggggtcatcaatgcagcagggatgaaaaatgatatatcaactgacagctccaaggattcagctggttccacggatttgatatcaggcagagcaaaggaagatttgcatcgtgggcacagaatagcaacttgtgccagtgctgatataagctcatggagcatgtcaatccctaatgaatgtgaaggaactacagaacagttatctgatggctcagacaaattgcctttgcgtaagatagcgaaaacatgtgctttgac

SEQ ID NO: 67128 - DNA, 319 bp, Zea mays
  Clone ID: LIB3076-044-Q1-K1-H2
acgcccacacttccgcccacgcgtccatccactcacttccaaactacaactaattcaaaacgcggaaccttcatactccaagtactagattaatcaaccaatgtacccaatatttaccctcttctaaagacaccatactatctgcctcttttatcctaagtatattaaggcctcagcactacacattacgaactgccatgcaggaatttttcaacaatttgacttataaatcgtcgtgttcaaaatacacaaatctgtcaataataatacgcattttccactgacgtgtcttacttaattggccaccccatattttctt

SEQ ID NO: 67129 - DNA, 346 bp, Zea mays
  Clone ID: LIB3076-044-Q1-K1-H6
ggacatcatcagtaccacccctggcacccattgagccagccccggcacccattgcagctgcttcgcctttctcaaaatgagatgagatgtagcgctccggccctatgtccgtttccttttttatcttttagctatgtaattttgctaccatgtgtccatctaccatactgatagtacctcttattatggctgctatgcaaggcatatccatggttttgtttgatgaaaaaaaattaaaaacaaatctcaaaactacttcaatcacatcacatacaaatatataacttgaattaaaactataagactcacttcaaatgtataaaaaaaaggggctcccgttttaaag

SEQ ID NO: 67130 - DNA, 417 bp, Zea mays
  Clone ID: LIB3076-044-Q1-K1-H7
cgacccactcatccgctgactcgtcttgtcaatctctttctggacttgtactttctgtgtatcatcacggtgtatgtaacttttcaatcataccctcactaaatctcaactttctccttctgcgatcagttctagcaatccttcatcagtatagttatatctgtcattgcacacattctatacaccacaagttcttttacttcattctttcttgatgtaacattctcattgaaccaaactatatactgctaatcaaagttcatccacatataataattagtttccccaacatgtacatcacttaaatttatctcattaaacctttcacaaaaccaaaccttaaatttctaccttctttttctataacattaattataaattatctatcattctattaaacatatttcattcatttct

SEQ ID NO: 67131 - DNA, 286 bp, Zea mays
  Clone ID: LIB3076-044-Q1-K1-H8
cccacgcgtccgcccacgcgttcgcccacgcgtccgctgacgataaacatggagcggtaagtcgtcaaaaaaaaaaaaaagagaaaaaaaaaaaaaaaaaaaaaaaaaaaaaaaaaaaataaaaataaaaaaaaaaaaaaaaaataaataaaaatagaaaataaactaaacaccataaaaacaaaaaacttaatatgataaacaatggaacattcacattgaaccaaacagagaactgtgaattaaagtgctcgatataaaataattaatttggctaacaggtaca

SEQ ID NO: 67132 - DNA, 461 bp, Zea mays
  unsure at all n locations
  Clone ID: LIB3076-045-Q1-K1-A10
cttggattcggcgaccaccggagcgcggaggaggcacaggcgccgatctaaagacgatgggcgccgcgggctcctcgccgtccttctcctcctcgagtaagcggctggaagggaaggtggccctcgtcactggtggcgccaccggcatcggcgaggccatcgttcgcctcttcatggagcacggcgccaaggtctgcatcgcggacatccaggatgaggccgggcagcagctgcgcgacgccctgtgaggtgacgcgcagggcgccatgttcgtccactgcgacgtgacgtcngaggaggacgtgagccgcgccgtggacgctgcggcggagcggttcggcgcgctggacgtgatggtgaataacgccggcgtgacgggcaccaaggtgacggacatncggaccgtggacttcgcggaagcgcgcagggtgctcgacgtcaacgtgcacggcgtgttcctg

SEQ ID NO: 67133 - DNA, 364 bp, Zea mays
  Clone ID: LIB3076-045-Q1-K1-B7
gttattctgcttgtgttgctatgtcagagtgacaccactgggctaacaaccgagaatagggagctgaagattcgcctgcagaccatggaacaacaagtccacttacaagatgctttgaatgacaccctgaaaacagaggtccagcggctgaaggtggcaacaggacaggtgggcaatggtggtggagggatgatgctgaactttggggccatgccacgcctggtcggaggcaaccagcagatgttccacagcagccaagcgatgcaatccgtgctggcgacgcaccagctgcagcagcttcagcttcactcccagcctcagcagcagcaactgcactcgctgcagcttcaacatgtggcgagag

SEQ ID NO: 67134 - DNA, 300 bp, Zea mays
  Clone ID: LIB3076-045-Q1-K1-C12
ttcgacccactcgtccggcaggacgaggccctgctcgtcgcggtggctccgtctctctcggcgcccgccgacgtcggcgtgcgcgcgctctacagaggcgcgtccggcgacacctgggcctggggcttccgcgccttctaccccgtcgcgcatgtcacgttcgccaaccccggcgtgcatgaggaccccgcgtgcggtccgctgcttgacgccgtcgccatcaaagagctgcccgcgccgtacccgaccaaatacaacctgatcaagaacgactgcttttaaatccgttcccaagtgctc

SEQ ID NO: 67135 - DNA, 483 bp, Zea mays
  Clone ID: LIB3076-045-Q1-K1-C9
cgaaacaatttgtccggagaaattccacaatcaatctgtgaagcaacaagccttatgctccttgatctctccaatagtaatctgcttggctccatcccttcttgtttaatggaggatatgagtaacctcaatgtattaaatttgaaaggaaatcaacttcatggaagattaccaaatagcctaaagcaagattgtgcattcgaggcattagacttcagcgataatcagattgaagggcagttacctagatctctagttgcttgcaaagatttagaggtttttgatatcgggaagaatcttattaatgatgcatttccatgttggatgagtatgcttcctaaacttcaagtccttgttctaaagtccaacatgttcactggggatgtggggccatctatttcagaagatcaaaatagttgtgaacttggaaaacttcgaattatttgattggctttaaacaatttctctggattattgcgaaac

SEQ ID NO: 67136 - DNA, 451 bp, Zea mays
  Clone ID: LIB3076-045-Q1-K1-D2
cccacgcgtccgcccacgcgtccggtgactagcccaccgccaccggcaagtgccctccggcgtccttcagtaccggaagaaggcgaggcgcccaaccgagagcaccaggggaaaggaagtgcgcctaggcatcgacatggaggacttctacgtcacgatcccctacggcctgctgctcgtagccggcggcgtagccggctacatgaagcgcggcagcgccgcgtctctggtcgccgggggcggattcggtgctgcgctccttctcgctggtgcgctcagcgcctgggccttcgcgcacgccggaggtggcgctgccgacatctttgccaccgtccttcagatcgtttgtgctgtgctattgactgttgttatgggaataagatatgtcaaaacacaaaagataatgcctgctggaattgtcgcttctatcagtgcacttcgtactgatatt

SEQ ID NO: 67137 - DNA, 421 bp, Zea mays
  Clone ID: LIB3076-045-Q1-K1-D5
gcagccaaccaggggaggccctccgcggtccgtggctccgtgccatcctctcctgggcagcgagcagtggtggccgcgggttcccccggctcgtcctcccggatccggcgacgaagattaattgaataacttcgataagatgggtcgtggtattagcagtgggggtggtcagagttccttgggctatctctttggcagtgacgaagcttcaaaatcatttgagaagcctgcaccagttcaaaagccaacttctccatcctctgcagagagactaaaagatatcgctgctggtattcaaagtagtaaatcatacaattacaaaagatctgaaggccagaactgtggaaatttccttacggaccgtccgtcgaccaaagtgcaagcaggctcaggggggaactttcactcgggtatcttttta

SEQ ID NO: 67138 - DNA, 293 bp, Zea mays
  Clone ID: LIB3076-045-Q1-K1-E4
ctcctcactctagcctccgcctcttcccctgcgccccgagccaatatgaatggggaatgggtcaagaagatggcaggtgctgtgcgcactgtggggaagggtagcatgcgcatgatgaatatggctgttcacatgactacgaccacagatgattaaaggctttagagcaccctgtattgaatttgagtgatcaccattcctgatattgtagaggtcaacatttttaaggatgattttattattcagtttgtgaatcctaaagtgtccagttttaatttgtgctaatacatgtg

SEQ ID NO: 67139 - DNA, 343 bp, Zea mays
  Clone ID: LIB3076-044-Q1-K1-G5
cccacgcgtccgctcactcgtcctccgcccttctctcgcgcgcgccgaccgtcggcacctgttgccattaagtcgggggaagtcttattcagcgaccagcacccgccaggccatatctctgcaatgggtgactacacaatccagattagcaccaagctcattgaccagcttgctcgtgatgacgagaaggtaaaactgaaagccatgaagcccaagcctaagaagaagcccaccgtccagccacatgaagagcccctggaattcccgagagaaccatagactacaagccttgctactgctcctgggtggcctctgcagtcttcccctatgtttctgccattga

SEQ ID NO: 67140 - DNA, 415 bp, Zea mays
  Clone ID: LIB3076-044-Q1-K1-C9
gcaagatcgaagagaagcgtggtgtgactgttacagataatgggaacacagaggtaaaggcatcaccttcattggcaaacgggatccattctgaacctatgccaggacaaataccagctgcaaagagcagccctgcatgggatgaagactggggtcctactaagaaaaccggtgttccatctctctcagttgattctagtgcacaaacaaagcaaccctcagtacacccttttgacttcagtactcaaacaaagcaatccacaccactcccctttgatttgagcacccaagtaaagcagccatcattagtttctcatgctacagcagctacgatcccacctgcgcaaccacaaccagtacaatctcttgtgcccagttcaggaccttaatcttctggctcatgtgcccctggtga

SEQ ID NO: 67141 - DNA, 120 bp, Zea mays
  Clone ID: LIB3076-044-Q1-K1-D12
ccactcgtacgcacacacttcctcaaattagcatattagatccacaacttcatcatacgtctctttgaaatccaacattaccaatcgtacaattcaaactccaacttactcctatactat

SEQ ID NO: 67142 - DNA, 305 bp, Zea mays
  Clone ID: LIB3076-044-Q1-K1-D2
cccacagcgtccgctaattctagatcgcgagctgccgactctttgaaaaaaaaaaaaaaaggaaaaagaaaaaattaaaaaagaaaaaaaaaaaaaaaaaaaaaaaaaaaaaaaaaaaaaaaaaaaaaaaaaaaaaaaaaaaaaaaaaaaaaaaaaaaaaaaaaaaggcatcctatttaaagaatcaaatttaaattaataattaatacaacataaaatatttataatattgaacccaaatttaaattaattgcccatatattaaaaaataattaactagaaaaaccctgattataccaaattta

SEQ ID NO: 67143 - DNA, 392 bp, Zea mays
  Clone ID: LIB3076-044-Q1-K1-D5
aactatcgtcgtttcactgaggcccaacaggtgttgtaagtcacaaaggttctgcacggtggcgcgggggtcaagtgcctgcccctaaagaatgtactagaaccaggtgacatccgcacgcttgctgaactcgggctaactgaactaccagccatgttacaggactcacatcctgctgttggctctactcttattggtggtgaaacagaacctctttacaggtatgaacaattttgctgcacaattctatatgcacccaaacaaagtatacaaaaacaatacccaacatagcatatatgatgctaattcttcttgcaaaaattgtccatagcttgctacaagacatctatctacacgtgacatgtatgaggagtttaagaagcatgctacta

SEQ ID NO: 67144 - DNA, 361 bp, Zea mays
  Clone ID: LIB3076-044-Q1-K1-D8
actcacgcctactctccatctccatccagccttccaggctcaaaccctacggaagctaccggtgaatcacaccccaagcagggtcctatcgtatcaagaagccgtcgcgggggccggatcgccgcggctcggatagaagcggagcgaaaatcatctgcagaaaggtaaggattcgcaggcgtgatcaggagctgaaagaacctgttcgaggtggcctacactcgtagggatcgcgttgacattgggagaaatcactgaaaggcgtaaaccgagcaatatccaatatgggaagggaagagcaacaatacccgtggcaccaaaaatttgttgcatagatccaagagaagaacaatacatatct

SEQ ID NO: 67145 - DNA, 99 bp, Zea mays
  Clone ID: LIB3076-044-Q1-K1-D9
ccacacctacgctcacacattctccattttttcattctgccccactacacatacaaccgaagattttacatcttagaaggtccatatcgtacaatctat

SEQ ID NO: 67146 - DNA, 340 bp, Zea mays
  Clone ID: LIB3076-044-Q1-K1-E10
cccacgcgtccgcacccaccgtctccgttttcgacaacagcgtagtgtagtgtacttcgggagagggttggggagagtagtagtgatccgcaatgtcgacggaggaggctgttgtggctgaagtcccggtgaccgaggtgccagcggaggtcccggcggaccatgtggccgatgcgcccaaggctaagaacgcgcccaaggagaagaatgcgcctaaggagaagaagctcttcgcggcgaagaagccggcggcgcaccctccctacgctgagatgattgtagaggcgatcgctgcccttaaagagaggaaggggtcgagctcggtggccatcaacaagta

SEQ ID NO: 67147 - DNA, 376 bp, Zea mays
  Clone ID: LIB3076-044-Q1-K1-E11
ccgactcgttttgcaactaaattctgcttttcacagaaacaccaccgcataggggctcgatccttttgtcccgtgaagcattgacgggcctgagcagggctacctttgctgcttccgggcagaaagcatcgatccattactgcaagttctcaataccgaattccgttatgcttaccgaatcgtcttatgaagggctgctcaatcaccgagctcccatgctcattctcgtattactacaatggcaataccatcgagctcttaaatttacatgaacatattcttgctcataacgcaactgatgatgactagcaaacgcagattataccactgaacataaacattgcagtgcccaaattcaaaacaatgactattctaa

SEQ ID NO: 67148 - DNA, 61 bp, Zea mays
  Clone ID: LIB3076-044-Q1-K1-E12
ccaacccgtcggccaacccttccgcggcctcttggcctagtcctagatcgcaagcggcgtt

SEQ ID NO: 67149 - DNA, 457 bp, Zea mays
  unsure at all n locations
  Clone ID: LIB3076-044-Q1-K1-E5
gcgcggacgcgtggggcttcttgttgccaaagaattccctcccctagccgccgccgccgctcggctcccgtagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatnctgatatcccttttggcttcctcattctagtagtttaggatttcttt

SEQ ID NO: 67150 - DNA, 220 bp, Zea mays
  Clone ID: LIB3076-044-Q1-K1-E6
cccactcgtacgctcactctcgatcaaactttctattctaatccataatatctgggaacgactaaactaagacctacctggactataattagcattcaatctataacttataaaataaagacccgtaacctatagacacctcaacatactaacatgtaaaaatgataccataacataacctgatttaaatctataactcctacatactacaatatcacac

SEQ ID NO: 67151 - DNA, 341 bp, Zea mays
  Clone ID: LIB3076-044-Q1-K1-E8
cccacgcgtccgcccacgcgtccgcggacgcgtgggcggtgcccacccagcgtgcaacctgggcgagaaccgcctgcccctgcgctccttccagctcgctctgtaatctgcatcagcctcgcccgccgccgtcgccgccatggggaggggaaagttcaaggggaagcccacaggccgccgcaacttctccacacccgaggagatcgctgctggtacttcaggtcggccacgcacctttaagaagaaggaggaagaggaagatgaggaagaggtagaaagagaagagtctgaggaagaatctgaagaggattctgatgaatagactaaacataaaagcactg

SEQ ID NO: 67152 - DNA, 382 bp, Zea mays
  Clone ID: LIB3076-044-Q1-K1-E9
cccacgcgtccggtgccttcttgttgtggagcaaggaaatggtgctgagttgagtcttaagcctttcatgccattggcaattcaagtccttgagtgttctttcctttcgggcgtaagggcggggaaaattgatccattactgggagtgctcaaaccgaagtttgttatgcttccagaaggtcttaagtcgcggtgttcaataaagggggtgccatggtcattcttgtattactccaagggcaagaccatcgagctctcaaatttacgtgaagatattgaggtgcatcttgcaactgatgttgccttccgattgcagcctagacaactgaacgaaaccactgcagtggcgagattgagaacaaagctgcttgtaagcaatgga

SEQ ID NO: 67153 - DNA, 402 bp, Zea mays
  Clone ID: LIB3076-044-Q1-K1-F4
ggaagtaatatgctgcatgggggaacacgtttggactgtgagccccagcaacaaagtaaggttcctgccatggatgagcgagctctctctgggctacaagcacgaatggagaggctaaagagcgggtctatggaatcactatagattgataacagtactgagaaataccatccgttgtaattcattgtaaatttgatgcatagtgatgctgcttgtagataggtatttgaatgtcggaagaagtacgtctcacggggcctacatttcgtaacccctgtgccatgtcaatccattcttgctgagcctttgattgcagtttttagacaagagctagccaaatgttttcttgtagctactctttgaagggctaattaaggttgacaaattttgccgtacttgatt

SEQ ID NO: 67154 - DNA, 185 bp, Zea mays
  Clone ID: LIB3076-044-Q1-K1-F5
tctcaactcatattctcaatcgggtttcactattgtactattagccccaacaacaggttaattttcaattcatggaggacctagctctatttatcctacaagcactaattgataagctaaatatcaaatatatctaaatactatatattaataacaatactaatatataccatcctttagatatt

SEQ ID NO: 67155 - DNA, 395 bp, Zea mays
  Clone ID: LIB3076-044-Q1-K1-G10
actaacctactgccctcctttttgatttatccatgcatatcttcataccgctcattgtcaacttatacacaagtaccacctatcttttccctttttttttttctttaattttcttctccccatcctcttctccactctgctctccatttatcatcactctaatttctttctctcattctttgtctaatcaacccctatatcacatatctacttacctaacataccctattacatcccttccttctcatttcatactcctatctctctcttttatatttctttctttcactgcttacttattttttatattactaactcacatttatcttcaatacaccccatatttccctccttatccttctctcattcccatcccacctactttcactttcctt

SEQ ID NO: 67156 - DNA, 401 bp, Zea mays
  Clone ID: LIB3076-044-Q1-K1-G11
gccgctaacagactgccggccgtcaggatctatccatgcatttctgcatgggcctcatggccgagctatgctcaagtgccgcctctggtttccctttttttttttttttaattttcttctccccagccgctgctccactcggccgccagggagcatcacgcttgtttctttctctgattctttgtctgagcagccgctagagcacagagctactggccgaacgtgcccgagtacggccgttcctgcgcgttgcatgctcctatctctctcttttttttttctttctttcactgtttactgattttggagattactaacgcacggttggcttcaatgcaccggagatggccggcctgagccgcctcgcatccccatcccgccgacgtgcgcgtcccttcggg

SEQ ID NO: 67157 - DNA, 447 bp, Zea mays
  Clone ID: LIB3076-044-Q1-K1-C2
ctcacgcgtctgctccttctactccgcctgttccatccactacaaggatcgccatgtccggctcaggggaacaccacttcgaatcgaaggccgacactagggcgtacaaaacctacccgcaacaggctggcaccgttcgtaaaaacagcttcatcgtcatcaagaaccgtccctgcaaggttgtttaggtttctacctccaagactggtaagcatggccacgccaaatgccactttgtcaccatatacatattcaatgggaaaaagcttgaagatattgctccttcatcacacaactgttacttaagttaatatctgtctgttctctggttatctaacttattttgatagttcacttcatatgttactgacaagttcaatattttttatattccaaatgtgaaccgcactgagtatcaacttattgatatatcctaggattgatttg

SEQ ID NO: 67158 - DNA, 422 bp, Zea mays
  Clone ID: LIB3076-044-Q1-K1-G3
gattaagacccgttctagtgctgcagggggatctgttgcaacttaaggggggcaagggtctatgcaagggtggagccaatcgccaccggaaggtgctccgcgacaacatccatggcatcaccaagcctgcgatccttatgctggctctgatgggcggcgtgaagcgcatctcggtgctcatctacgaggagacccgctatgtgctcaagatcttcctcgagaacgtcatactcgacaccttcacctacaccgagcacgctcgccgcaagaccgacaccgccatggatgtcgactacacgctcaagctccagtgccgtaccctctacggcttttgatgctaggcgcctcttcttaactggggaatgcttatggtgatacgtatctgtcgctgtgggtcgtaatgtatcttcattccttgatat

SEQ ID NO: 67159 - DNA, 373 bp, Zea mays
  Clone ID: LIB3076-044-Q1-K1-G4
cggactcatgggctgactcgtggggcccttttttccttcccctccccgatctcccccaagccgaccgtaccagtttagccgggtgtctgcgatctcgctgctacagtcgctcctcatatcggcagatatctctttctaacgcaaggctgcaattgagtacattcattctttatcaagggcacaatctgctcgttctctcaatggtgctcgcctttgtcctgctagtatatcacttagcacccatgccgccactacgtcaagcacaccacaacctatgtcttccttaccctcttcatagaagactcactttgttggcctcaaatactaggatcgcatttttaccaacctctattgtctgcattacccttttctt

SEQ ID NO: 67160 - DNA, 411 bp, Zea mays
  Clone ID: LIB3076-044-Q1-K1-A10
gcgtcgagtaccttcacagccttgcccagtagacctttatccacagagacttgaagccagcaaacatacttcttggtgatgacatgaaggccaaggtggcggactttggattggtccggcttgcaccagctgatgggaagtgtgtctccgtagagacaagacttgctggcacttttgggtaccttgcaccagagtatgcagtcactggacgagtgaccacaaaagctgatgtcttcagctttggtgtcatcttgatggaactgattacaggacgcaaggcacttgatgagactcagcccgaggatagcatgcatttagttacatggttccggaggatgcagctcaacaaggaaacattccgcaaagcaatcgaccctgtcattgacctcgacgaggaaacctacgctagtg

SEQ ID NO: 67161 - DNA, 285 bp, Zea mays
  Clone ID: LIB3076-044-Q1-K1-A11
gacgcacgcgtccgacggcgagtactttcacaagctttccgattagacctttatccacacagactctaagccggcaaacatacaaattggagatgacatgaagcccaaagctacggaatctggattggtccagcatgcaccagcatgatgggaagtgtgtcttcgtatagacaagacatgttggcactattggataccttgaaccatattatacactcactgtaccagttaccacaaaagctgatgtcatcagattatgtgacatcctgattgaactcattacag

SEQ ID NO: 67162 - DNA, 262 bp, Zea mays
  Clone ID: LIB3076-044-Q1-K1-A12
ccgtccagtactaccttaagcccaccgactaaacgttagcggagatacactcgtatccggcaacattgcgcatggtaacgggcaggacgctctatgctatcgacggtgtatggatcaagcctgcactagtagcttgcgctatgtatcctctactagacaagacacgtgatcacgctcgggctccttgaaccagaccatatcataatccgagcagacaccacgaacatgcatgtgatcggatacataatcatcctgatcgaac

SEQ ID NO: 67163 - DNA, 430 bp, Zea mays
  Clone ID: LIB3076-044-Q1-K1-A2
tctcactttactgaagttcatcattaacggatccattgccagactcaatcgctttagttacaaaagcagacctccaacgtaacatatacttcatatattgcttcaattcattatccatcttctttctataattgggatctttgttagatgtcaaccctgagattgctctctgcataggcttacaattcgctggatccaaatggcaatatcactataaaatggtatatcattcaatggactcctgatagatatatcataagtacaattacccacattaacaactgtatctctttcatcttcagcttgatacaccctggtttattctattaaatatcccattttcacctgtacaatataagttaatgtaacatggccaattgctgattttcaaacatacattaccgataacaataacaccatccaaaattta

SEQ ID NO: 67164 - DNA, 286 bp, Zea mays
  Clone ID: LIB3076-044-Q1-K1-A4
tcgacccacgcatacactcacacgtcagccgctctttcactctttttttcatacaatctctcatcccaaaattctacgcacttgacactttaacataagcccattccatccaacaataccaattacaatcaataatctatcaatctctatattaacccatcatcctccttacatccataatacccacaccctttctaatacattgctaatattactaaactgcaactatcactctacaacaaccgatattatcattgtataaaaaaccttttaattctacatataa

SEQ ID NO: 67165 - DNA, 156 bp, Zea mays
  Clone ID: LIB3076-044-Q1-K1-A5
cgtaacatagacttcatatatttctgtgaattcattatccatctcctttctataaatttggatctttagtttgatgtcaaccctgtaattgctctctgcatatgcttacgattcgcttcatccaaattgcactatcactataaaatgcgatatcat

SEQ ID NO: 67166 - DNA, 268 bp, Zea mays
  Clone ID: LIB3076-044-Q1-K1-A6
cccacgcgtccgcccacgcgtccgagaagaagtctcccatccccgagattcctggtatgcgaccgcttcagataagccaaaaagctaaggcttgagctgttggatgctgccctggtgttgttggctggatgagttgtgttgacctaggaagcagcagaatgcccagtgagctgcccaaaccaggtagaacagtgagcacttggaatgcccatgttacactcgttatataatttggtggtcggtgcagtattacttgtcatgtctgcat

SEQ ID NO: 67167 - DNA, 254 bp, Zea mays
  Clone ID: LIB3076-044-Q1-K1-A8
acgcccacgcgtacgcccacacgtacgcccactcttccgaactacacctaaatcacgaactttcaaaaattaaaaaaaagcaaaagccaaaaaaaaaaaacaaaaaaaaacaaaaaacaaaaaaaacaaaaaaaaaaaaaaaaatagaacaacaaacctacaaaacagaacaaacaacatctacacaccaattaaaacaattagcacatacaaaaccaacataacaacatatacataatccaaattaaataaac

SEQ ID NO: 67168 - DNA, 89 bp, Zea mays
  Clone ID: LIB3076-044-Q1-K1-A9
taccgctcctactggaacatgcataccgttttgctctactcaaaatctacacattctcatgcatatttatcattttcgaacgtcctcaa

SEQ ID NO: 67169 - DNA, 400 bp, Zea mays
  Clone ID: LIB3076-044-Q1-K1-B11
gtctatactaaaatatttagttctcctaataaagggcatcccatggaatacctaagagtacccctgccgccgcccctgttcttctcttacaactatgcccgtgagcagggagggtttcacaccttgcgtgcgtttatgcagcttcggatctatccgcgggcaatcattgtacgatcctttcgaaacacgggatctgtgggggaaggttatccggaccaactatcccgaatcggcagggagcagtccacactctaacctgatagcttcaaggagctgaggtgatatgacctccttttcgccctcgtctgtgctactttcccttgagcttttctgggccacttctgcgccccagcctctgtacaagatcactttgttggtttctcgtgacactagcaccgat

SEQ ID NO: 67170 - DNA, 361 bp, Zea mays
  Clone ID: LIB3076-044-Q1-K1-B12
ccctcctccgttacccgcaggccatgggcagcctggttgcggtgttcctgtcctctttggccacattgtgcatcttcaccagcggcacgctctatgctatcggtggtgtctgcatcaagccggtgctcgtgcttgcgctatggatcctctactttctgttccccttgatctcgctcccgctcctccacccgatccagatcataatccgcgcggacgccgtgcgcatgcagctgctcgggttcataatctgcctgttcgtgtccggtgccgggttctacttcaagagccacaggtggagggctgcccacatcatcgtcatcgccctggtccaaagcaccgccaatggcatactgtacgcgtt

SEQ ID NO: 67171 - DNA, 407 bp, Zea mays
  Clone ID: LIB3076-044-Q1-K1-B4
cggacgcgtgggcgtcctcgggccagtgaccctctcctgcctgaacgaggggaagaggtgcctgaggcatcatagatggatataccaggtcggcctgaaaggcgagtcgctcggcctacacaccgtgaccggaagctccgccgtggaatgggccggccccggcggcggcacgcagccgctgacttggcacaaggccctgttcaacgcgccggctgggagcgatccggtggccctggacatgggcagcatgggcaagggccaggtgtgggtgaacgggcgccacgcctggcgctactggtcgtacagggctcactcccgcggctgctgtctgtgcatctacgcctggacgtaccgcgaggaccagtgcacgttcaactgcggcgacctctcccagagatggttccacg

SEQ ID NO: 67172 - DNA, 452 bp, Zea mays
  Clone ID: LIB3076-044-Q1-K1-B6
gcggcggcggcggagcggaaggcgaaagagtagcagcagcaggcggcgccgagtagcgggtccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgctttcgccttcacccaatcagggatgaggatgctaaattcaagcttt

SEQ ID NO: 67173 - DNA, 460 bp, Zea mays
  Clone ID: LIB3076-044-Q1-K1-B7
cttctctctctgctcctccgcctccgcctgatccatccaagacagggatcgccatgtcgggctcgggggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacgtaagttaatttctgtctgttctctgtttagctaagttattttgatagttcacttcatatgttactgacaagttcaatattttttagattccgcatgtgaaccgtactgagtatcagctgattgatatttctgaggatggaattgtgagccttcttac

SEQ ID NO: 67174 - DNA, 430 bp, Zea mays
  Clone ID: LIB3076-044-Q1-K1-B8
cccacgcgtccggggagcggcactggcggctccggcgcgggcgcgggcgccgtggctgggtgcactttgtggcggccatgttccggtgcgacggctgcactcgcgtagccggccgctagtccaggaacatggcgacgctggatgacgatggtggggaggagcagcagcagcagcatgcgggcgttgcagcaatgcggaggttcaagtccgggaggagagctgcttcgtggtgagactaggcgctggccgcggcagctgtgggcgatgaggactaggggatggagatgcccgacagccaggacgctgagcagtggttccggcggccggtaatttatgttgtggcgagaaggcgggaaacgactggcgtcgccgggacccgtcgactgtggatgccgataggtgaaaccgactgtcctaggcgtctcgagct

SEQ ID NO: 67175 - DNA, 127 bp, Zea mays
  Clone ID: LIB3076-044-Q1-K1-B9
accatgcctactggaacatgcataccgctttgatcttttgtaaatctacacatgcacatgcatattcatcttcgtcgaacgtcctctatctcccatctctgtaacctcacatagcatatgatgaatg

SEQ ID NO: 67176 - DNA, 356 bp, Zea mays
  Clone ID: LIB3076-044-Q1-K1-C10
acctgacctaagagctttgtgctccgacataaacacacagtgcgaacacagcggtcagagcatcatctagatcggcaaacggcatccatactgcacctatgccacgacaaataccagctgctgagagcatccctgcatggaatgaatactggcgtcctactaatacaaccagtgttccatctctatcagatgattctagtgcacaaactgcgcatcactcaatacaccctttagactgcaagactcatacaaagcaatttacaccacttgactttgatttgagcacccaagtcaagcagacatcatcagtttctcatgctacagcagctacgatgccatctagtcaaccacaacca

SEQ ID NO: 67177 - DNA, 301 bp, Zea mays
  Clone ID: LIB3076-044-Q1-K1-C11
gacccattcgtccaaccggaccaacgcacttagcgctccgacttaaacacataatgcgaacaccactatcaaggcctcatctagatcgccaaacggcaaccataccgcacctataccactacacataccagctacaaagatcacccctgcctcgaacgaatactcgtgtcctactaatacaaccagtgctccatctctataagatcctaccagaccacaaacaacacaccacttaatacaccctctatactgcaatactcatacaaatcactccacaccacttcacttcgatttgaccacc

SEQ ID NO: 67178 - DNA, 374 bp, Zea mays
  Clone ID: LIB3076-044-Q1-K1-C12
aaaaaaaaaaaatctccgcgccgcggggggaggtggtctgttcaccttggggagcagcggcgggccggcggccgagaaatgcccggtggcgccttcctcctcaacggcagcggcggcggcatggcggactacggcggcggcctcaccgtacccgtcgtcgtgacctgcctcatggcggcctccggcggcctcatcttcggctacgacattggcatctcaggaggtgtgtcggagatggaggatttcctgaacaagtttttccccgggttgctcaagaggacggcgcgcgccaacaaggacgtgtactgcatttacaacaaccaggcgctgacggccttcacgtcgtcgctgtacgcgttcggcatggtggggac

SEQ ID NO: 67179 - DNA, 416 bp, Zea mays
  Clone ID: LIB3076-044-Q1-K1-A1
tcaggagtgaacaagcaattcaagatcttacttaactgtagttcaccattaagggatccattgccagactcagtgtgtggatcttcgaaagcggacctcgaacgtaacatagacttcatatattgcgtgaattcattatccatcttctttctataattgggatctttgtttgatgtcaaccctgtgattgctctctgcagaggcttacgattcgctggatccaaatggcaatatcactataaaatgggatatcatgcaatggactcctgatggatatgtcgtaagtagaattgcccactctaacagctgtatctctttcatctccagcttggtaggccctggtttattctattaaatagccccatttgacctgtacaatataagttaatgtaacatggtcaatggctgatttggaa

SEQ ID NO: 67180 - DNA, 262 bp, Zea mays
  Clone ID: LIB3076-043-Q1-K1-E10
tcttactcccactctttctccctaaacccctcgtaactgttctaccacactctcactcatactctcagtgccatttctaaaatctcactttcccaacacttatcactaaacatccaacacctcatctcccaatcttaaactctcctaccaaacgcttaaaccctctttaaacttaatccacacaaacgacaaccatacaatatcaaccaatttatacacttcacctccatcacattcactaattaacactacctacataact

SEQ ID NO: 67181 - DNA, 457 bp, Zea mays
  Clone ID: LIB3076-043-Q1-K1-E11
cccacgcgtccgccctccacccctcgcgagctctccaccccgccgccgcccatggtggccgggccaccaccaccggcgcagtgtgccaagcacttcgctgctgggccgccgccgccgccccaagctggtgctgggcgccgcacgccgaccccgccctcgtctggatccggcgggaacgggtgcgaagaaaataaaaccatttgggtcggtgacctccagtactggatggatgaaaactacctacataactgcttcgggcccagcggcgaggtggttacaataaaagttatccgcaataggcaaacaggacagtcagaggggtatggatttgttgagttcttttctcatgcatcagcagagaaagctcttcagaattttactggtcatgtgatgccaaacactgaccggccatttaaattgaactgggcatcgtatagcatgggtgaaaagcgatctg

SEQ ID NO: 67182 - DNA, 456 bp, Zea mays
  Clone ID: LIB3076-043-Q1-K1-E12
cccaggcgtccgccctccacccctcgcgagctctccaccccgccgacgcccatggtggccagtccacttccaccggcgcagtgtgccaagcacttcgctgctgggccgccgccgccgccccaagctggtgctgggcgccgcacgccgaccccgccctcgtctggatccggcgggaacgggtgcgaagaaaataaaaccatttgggtcggtgacctccagtactggatggatgaaaactacctacataactgcttcgggcccagcggcgaggtggttacaataaaagttatccgcaataggcaaacaggacagtcagaggggtatggatttgttgagttctgttctcatgcatcagcagagaaagctcttcagaattttactggtcatgtgatgccaaacactgaccggccatttaaattgaactgggcatcgtataacatgggtgaaaagcgatct

SEQ ID NO: 67183 - DNA, 177 bp, Zea mays
  Clone ID: LIB3076-043-Q1-K1-E2
cccacgcgtactactgcatctatccctactagcactctagcaacatgctatagcactaatgctgagccaaatctccaagatcacgacaccactacaatgagaccatgcttctcaagattattagacaagcagctacactatcaaccaatgactgattcactactaccttcatgacat

SEQ ID NO: 67184 - DNA, 159 bp, Zea mays
  unsure at all n locations
  Clone ID: LIB3076-043-Q1-K1-E3
ctttcttntaacgccaaaaggaccccaacctacctacccggaacccgccattgccaccggggccagtggacattctcaaacccaaccccgcaacctcccgtgaccaagccaccgccgccgccaaagggaagaaccgccgccggggccaagggcttccgc

SEQ ID NO: 67185 - DNA, 208 bp, Zea mays
  Clone ID: LIB3076-043-Q1-K1-E4
ctctctcgtagcgcagaatgaaacacaccttacacactacaagcctaccttcgctacggggccaagccacttctccaaacccaccacaccagtctcaagtgcccaggaagcaacgcgccccaaaagcagcagccgaccaatgcaccacgcacgtcggcagtactacctgcagcacatccataacctacagatctagatccggcacaag

SEQ ID NO: 67186 - DNA, 354 bp, Zea mays
  Clone ID: LIB3076-043-Q1-K1-E5
ctctctcgttgtttcggatcaaatacactttacacactcctactgtaccttcggtgcggggtcaatccgattgatcacacgaagcacactgggctcaagtgcaccggatgcaatgcgccacagaagcagatggcgaccaatgcagcacgcacgtctggcccgtcatcctgcggcgtgaagaagccttaatgtttacgaccgggcacacgatgcgctccgagagatccgcaagtaccagaagagcacgcagatgctcatgcgtaagctcggcttgaagaagactggccgtgtgatcgcgcatgacttcaagaccgacctcagattccaatcctgatgcgtcatcgatctgcacga

SEQ ID NO: 67187 - DNA, 407 bp, Zea mays
  Clone ID: LIB3076-043-Q1-K1-E6
cgctctcgttgtatcgaatcacatacactttatacactcttactgaacttccagtacgagattaatacgactgatcacacccaacacacttggctcacgtgcaatgcatgtaatgtgactcagaagctgatgatgacaaatgaagcatgcttgtttggcgcgtgatcaaacgctgtgtacattccttaatgtttacgccagcctaacgcatcgttccaatagatccacaagtacccaaagagctcgcagatgatcatgcgtaagatcagctcgaagaaactggtcctaatgatcaggctagactactagacctacctcagatccaatatcctgatgcatcatttatctgctcaaggcctctgttgcctagcttgtagtgatgttggacgactctaacatgtgctaca

SEQ ID NO: 67188 - DNA, 341 bp, Zea mays
  Clone ID: LIB3076-043-Q1-K1-E7
gcgtctccttagcccgccgtcgacgtctctgcctcttccgctctcgacggagatccccagagtactctctttggtgtattcgatggtaacgggggcaaaaatgctgcatagttcgctgcggagaacatgcccaagtttttggccgatgagttcaagaaggtgaacggcggacgagagatcgaaggagctgtcaagaggggttacctcaagactgacgaggagttcctcaagagggacgagagcggcagctcgtgctgcgtaacatccgttctacaaaagggtggtctgatcttctccaacactacagactgccgtgcggttctcagtcgagcagggaaagc

SEQ ID NO: 67189 - DNA, 277 bp, Zea mays
  Clone ID: LIB3076-043-Q1-K1-E8
gcgtctccttagcccgcagccgatatcttttcctcttccgctctctgcgtagggcccgagatgactctctttggtgtattcgatggtaactggggcaaaaatgctgcagagttcgctgctgagaacatgcccaagtttttggccgaggagttcaagaaggtgaacggcggacgagagatcgaaggagctgtcaagaggagttacctcaagacttacgaggagttcctcaagagggacgagagctgcagctcgtgctgcgtaacatccgttctacaaa

SEQ ID NO: 67190 - DNA, 438 bp, Zea mays
  Clone ID: LIB3076-043-Q1-K1-E9
taagggctctttcgcgaagccaacagtagttgtgctttcagattctgactctgactctaaggttcttttataagagctaactgctgttcactcaaagtcaaaccggaaggcttcatctgcgagcctaaaaactggtggaaaggcttcagccctttctaaaggtgaggcaagcaaaggaaaagcatacattactgacaaaggtgcaaagggttcttcatcacatgcagtgcctaccaagtctgatgcagaactaaatctagagcttgatatccctccaaattctagaatgctaatgaattgtgaagcagctgaactattgcaagaaattcacgagcacatggccatactatcagaggaccccaagatcaaaattcctgagtcatttgacaaaacttttcagtattcaaaagatggaaatcatttcaccactgcaagctc

SEQ ID NO: 67191 - DNA, 199 bp, Zea mays
  Clone ID: LIB3076-043-Q1-K1-F2
cccacgcgtccgatggcatttatcgctacttgtagtctttcaacatggccattaaccacatagactgtagcgacttataagatagcactactccgatgggaccaaactttactcgtcatcctcatcgtcgtcatctgcgccgcccgaagagttgacttggttgagcctttcaatgagactggccttactttgctcgtat

SEQ ID NO: 67192 - DNA, 403 bp, Zea mays
  Clone ID: LIB3076-043-Q1-K1-F5
agcggacattgacctgcaactcatccaatttcttccgcatggccaaaagcatatatcgagattaatatcaacaaagcagactgtcaggacctcacaccatagtgatgcaagttactggagtcagaagttaaatctgttttatcaacctgggccgtgaagtgcctttgaacagcatcaactaactgctccctggatggattagggcatgcatcctgttcacaaatgcagtcagtcagaacaatgaaacataattggctacttgcaattgatagtacgaccttgtctagaaatttgagctctacttacgagattgaagtggcgccaatatctcaacagtgcagtcagttctaacttgctcatgtcaactttctgcactgttaccagtcaaaagaatgtaaagata

SEQ ID NO: 67193 - DNA, 255 bp, Zea mays
  Clone ID: LIB3076-043-Q1-K1-F6
acgcacgcaaccgaccgcacaaccaccggcaactcattcaatttcaacaacatgaccaaacccatagaccaagaccaatacaaaaaagcacacgcccaacacctcacaccataacaatacaacctacaagacacaaaatctaaacacatattatcaaccaatacccaaaaccacctaacaacaacatcaacaaacacctccctataaaaatcaaggcacacatccactacacaaatacaaacaaccacaacaaca

SEQ ID NO: 67194 - DNA, 168 bp, Zea mays
  Clone ID: LIB3076-043-Q1-K1-G10
caccaacccaacccaaacaacataccctataccaccatcaaccacccaacatcacctaaacaacccacaacactaccacccctacatctatacacacacatcctcatcacaacccaaccccaacaataccaatatcacaccaccactatcccactcacaccactacta

SEQ ID NO: 67195 - DNA, 452 bp, Zea mays
  unsure at all n locations
  Clone ID: LIB3076-043-Q1-K1-G11
gcggtctggagttggaagaacattcacaaaagaagttgttgaggccatggcttccttgaatgagtggcctatcatcttgtcactggcaaatccaacctctcattctgaatgtactgctgaagaagcatataactggactcagggtcgtgtaatatttgccagtggcagtccatttgaccctgtggagtacgatgggaaggtttttgtacctggacagtcgaacaacgcctacattttccctggatttggcctcggtcttgttatctctggagccatccgtgtccacgaagacatgcttcttgccgnctcggaagcactagctgctcaggccacacaggagaacttcgacaagggatcaatcttcccgcccttcaccaacattagaaagatctctgcgcgcattgccgcagccgtggctgcaaaagcttatgaactcggtttggcgacccgtc

SEQ ID NO: 67196 - DNA, 365 bp, Zea mays
  Clone ID: LIB3076-043-Q1-K1-H10
cccccccccacccaccccccccacccccccacacccaccccctcctccacaccccccccacccaccccacctctcaccacccccccccaccccacacccaccccctcctcccaccccccctccacccccaaacccccccccccccctacccccccaaacccccccccccccaccccccccccccaccccccctccctccctcccccccccccccccccccaccccaccccccccccccccccccaccccccccccacccccccccccccccccccctaccccccatcccccaccacccacaccccccccccccccccccccatccacccccccaccccacctccccccccccacccccacccccc

SEQ ID NO: 67197 - DNA, 375 bp, Zea mays
  Clone ID: LIB3076-043-Q1-K1-H12
aatttaaattggcccttccccaatcattaatagctctcatactactaacatatttcaaggttcgatcatcctatatagcactcatctggcttgtttctcctgcttttgcatatggctttttccaagctactctctcccctcttcgcctacctaaacaccttaacgttctcaccttcgttgtccatttctttgcaccacttctctcttctgctcctttggctattcgcatctcctatgtaatttttccaactatattacctatttacaacaatcctaccctactaccacactctctttaaaatctaatacctcccctttccatttcttttttcatttgttccacctttgtctatctgcttttataccttcatatct

SEQ ID NO: 67198 - DNA, 445 bp, Zea mays
  Clone ID: LIB3076-043-Q1-K1-H9
gcgaaaaaaacagaaaaaaacaaaaattaaaaattaaaaaaaaaaaaaaaaagggcgtggtctcgggatctagaaccgagcctcaagcgggcaggccacccagcactcaggctagatagctcatcacagccacagcagctagaccctagtagctcactcgcgctcgtgccatgatgaatacccgagcctgtggcagcggcagtggcggcaggaacgaccagaccatgatgggcttctccgagcatccgaagccggcggcgtcggggcaggcgcagccgtccccgccgtcgtcgccgagcgagcgtccgccagcaggccgcgggcgccggcgcgcgcaggagcccgggcggttcctcggcgtgcggcgccggccgtggggccggtacgcggcggagatacgcgaccccacgaccaaggagcggcattggctgggcacgttcgacac

SEQ ID NO: 67199 - DNA, 310 bp, Zea mays
  Clone ID: LIB3076-043-Q1-K1-D8
ccctctccttatcccgcaaccattataatttcctcttccacactctgcctatagccctagttgactttaacagatgcctaccatcataaccgtctcaataacgctgcagacttcactacccagaacatgccctagtctatagcctatgagcccaataaagtgtacggccaacgacagatctaccgacctgtcaagaataattacactcatacctacaacaaattcataaacaaccacgagagctgcagcacttactacataacatccattctccaaaaattctatactgatcatatccaacactacaaac

SEQ ID NO: 67200 - DNA, 177 bp, Zea mays
  Clone ID: LIB3076-043-Q1-K1-B2
cccacacgtactcctacatgtacaactattttaccactaccaacataccttatccatgagtatagatttaatcgccaataactacatacctatacatactatcgaaaatcattacattcacaactatctcccatatactatgatccaaagaaaaattcacacttaccatcctgtcac

SEQ ID NO: 67201 - DNA, 197 bp, Zea mays
  Clone ID: LIB3076-043-Q1-K1-B3
gacccacgcgtcctcccacacgtactcttacatgtacaactattttacctcaaccaacataccttatccattagtatatgtttaatctccaataaccacaaacctatacaaactatcaaatttcattacattcacaactctctcccatatactatcatccaaataaacaatctcacttttcatcctgtcactccaaa

SEQ ID NO: 67202 - DNA, 296 bp, Zea mays
  Clone ID: LIB3076-043-Q1-K1-B4
cccacgcgtccgccgactcgtgcgtggatttcaagaccaccaacatccaaaccacctggggagaggtctcttacgcatgactcccaaagtgctgcacacggctgtagctataccgcatgcttcgatcgacacagatacactgcgcagattatagcttacctgataccactgcgccacatctatgcatgcaaggatcccaattccgctcatcgccagcacttctcccatgtggagatcgctgccttctaggccccaggaacaaaacgtactagctcaggacgactacgactactagg

SEQ ID NO: 67203 - DNA, 243 bp, Zea mays
  Clone ID: LIB3076-043-Q1-K1-B5
gaaaacccggctcgacccactcatccgcccactcatccacccacacgtatttcgattacaacaccaccaacatccaaacgagctttgtttaattctaaaactcaccacccccaaactcctacacacaactcaatctatacctcatacctctatccacacacatacactcatcaaaatataccttacctaataccactcctccacatctatacatcctaccatcccaataccactcatcaccaa

SEQ ID NO: 67204 - DNA, 410 bp, Zea mays
  Clone ID: LIB3076-043-Q1-K1-B7
actctctcgaatgcgctcactcatttctcttcacacactctactcttacataaactcctagtacatttctaactctcctcccatacacaacatacaactcttatcacccatatactgcatctttctatcatctcatgaacaatgcaaaccctacttaactaacagcaaccctcttaaagtactatacttaactttcttcccaagaccatcatcatcaacttatacctattagtactatatgaaacacaacaatctcttacccaaactatccttacatcatcaacttctacatatctcactgcatttcatcacttatatccaattccataacaaacacactttcgctctgcacataatccacaaaatctacatctcatattattcatctaacatactatcatcatacacat

SEQ ID NO: 67205 - DNA, 148 bp, Zea mays
  Clone ID: LIB3076-043-Q1-K1-C1
ctaacccgtggactcccaggacccgttcgttgacaactacaaccaggcccaagtctaggagatggagtaaatggccatctatcgcacgatcgttgtaccatgtcggcgatcttgacgactactatgcaggccgatacgtgcttatccg

SEQ ID NO: 67206 - DNA, 324 bp, Zea mays
  Clone ID: LIB3076-043-Q1-K1-C11
acacccacgcatccacccactcgtccgcatctctctaactctctgctcacacgactaccttcatgtacttgtttattctcccactgccctagtgcttacccttacacttccctaacccaatccctctatgatcaaactcacccattcataaacaccctcccatatcacctattcctcttcccatgtatatctctcccaaccaatcttatccatcacatgtactgtgttccccttacctctctctcaaatataatcctcagctcccaagcttatatgtacctacatcacacacgtcatttcccctaccctcatcatctgccaacc

SEQ ID NO: 67207 - DNA, 454 bp, Zea mays
  Clone ID: LIB3076-043-Q1-K1-C12
tgaataccaatatgttgctgcacctacactacgtacgttgtttccaatggccagggatgatgctatggatcttcgggcaaaagtgcttacctatgatccaaaagcaagaatcagtgctcagcaggctctagaacacaggtacttttcatcgttacctgcaccaacaagaccatcgcagcttccaaggccacgtcggaaaggagatcaagggaataacaagattcctgatctcaacctgcaggatggccctatggtgctctacccggcaagaaagttacgtagggtgacagcgcatgaagggatggaaggtatgcacaggacagataaagtggacgaacatccttctgggatgaggcacactgatgacatgcccaatcagagttctagaattccaatgtcaattgatgttggggctgtgtttggcacacgacctgcacctaggccaacattgaac

SEQ ID NO: 67208 - DNA, 361 bp, Zea mays
  Clone ID: LIB3076-043-Q1-K1-C2
gccacgcgtccgcccacacgtccgaatgcctgttgagaagctaagcaaggaaaatattgagaaaggatttgaagcattaactgagatacagaatttattgaatgacaccgctgatcaagcactggctgttagagaaagcttaattgctgctgcgagcaatcgcttttttactgttatcccttctattgatcctcatattatacgggatgaggatgattcgatgctcaaagcgaaaatgcttggagctgttgacgatattggaactgctttaaagatagttggcttcgatagcgacagtgatgaatctcttgatgactaatgtatgaaacttcactgtgacatcaccccgctggctcacgat

SEQ ID NO: 67209 - DNA, 301 bp, Zea mays
  Clone ID: LIB3076-043-Q1-K1-C3
cccacgcgtccgcggacgcgtgcgtggagatcaggaccaccaagatccaaaccgcctggggagagatctcgtacgcatggcccacaatgtggtgcacacggctgcagctatagcgcatggctcgatcgacacagatgtgctgagcagattatagcttacctgatgccactgtgccatatccatgcatgctaggatcccaattccgctcctcgacagcaggtctcccatgtggtggttgctgcctacgatgggcgaggtagaagacgtactagctgaggacgactacgactacgacgaggac

SEQ ID NO: 67210 - DNA, 301 bp, Zea mays
  Clone ID: LIB3076-043-Q1-K1-C4
cccacgcgtcctcccactcgtccgactacttcaagtctagcaacatccacaccctctggtgatagggctcgtacccataactgacatactgctgctcacggctgacactattgatcatgcactgactgacacagataggctaatcatatcatagagcacctgctgccactctgccatatctatgcttgctactattataattccgctccaggataacacgactctcatatcgaaattgctgactactatgcacgatattgaaaccgtactagatctggtcgactacgactacaacgaggaa

SEQ ID NO: 67211 - DNA, 232 bp, Zea mays
  Clone ID: LIB3076-043-Q1-K1-C5
cccacgcgtccgccgacacgtctgtcgagtaacagactagcaacatccaatcggtctggggagagatctcatacgcataactaacacactggtgctcactgctgactctataccgcatggttcgacccacacagatgtactcagcatattatagcttacctactaccagtgtgccatatctatgcttagccactatcataattccgctcatcgataacctgtatctcttgtt

SEQ ID NO: 67212 - DNA, 414 bp, Zea mays
  Clone ID: LIB3076-043-Q1-K1-C6
cccactcgtatgcgctcacttaagtgtgatcattgacgacctgcttaaagaaactcttgggatcgatcgacttccctcacatggacaagatacaatctgattgcccttatactgcatgtttcttattgtgcacatgaacgatgcgcaccctactaaacgaacagcaagtgtgttaaaatactttacgtaacttccttcccatgacgatgatggtcaacatctccctattagtgctctctgtaacacatcattgtctcacccaaatgatccttacttcatcaacttgcgcatattagaatgcatggcatctcttatatggaatggctagcaaaacactcgttctcttgcacatgatcagaatatacacatgccatatcatgcagctcacataattggatcatacacaatgacata

SEQ ID NO: 67213 - DNA, 87 bp, Zea mays
  Clone ID: LIB3076-043-Q1-K1-C7
cccactcgtccgcccacacgtcatcgtcttcatagaccacctctaacaccacgagctggggatatatcaatgatccatcacttacat

SEQ ID NO: 67214 - DNA, 129 bp, Zea mays
  Clone ID: LIB3076-043-Q1-K1-C8
atcgtccgcccactcgtccacccacacctcatacacatcatacaccacctccaaacacacaggccgagtttaattcaaaaaaccataacatcaatactactcaccatagcactacatataacgcaaccc

SEQ ID NO: 67215 - DNA, 383 bp, Zea mays
  Clone ID: LIB3076-043-Q1-K1-D10
tagacacatatttcatttattcatagattttctccaatcttacagcactcaacaatctagctgtatgaacaaatatctggcgaaaaagaacaaccatacaatgctgtcaaagcaaagcttatattaagcacctcacaattgccactatcaccattaacaccatacatcccaaatataccataaaaaatattcaaccctacatgaccagtacacaccattgataacagcacacacacacatcacatcaatactctaaacattacaaccaaacacaccgtacaagtccacagactctccagcaccatcatcatctgtcagttgacttataactgtgatagtacagagctgtcaatggatcaccaacacctgcaacagttaaacta

SEQ ID NO: 67216 - DNA, 424 bp, Zea mays
  Clone ID: LIB3076-043-Q1-K1-D12
cataaacacatatttcatttattcatagagggtcgccaagcttacagcactcaacaatctggctgtaaaaacagggatctggcaaaaaaaaacaaccatacaaggctgtcaaggcaaggcttctagtaagcgcctcgcaatggccacgatcaccatgaacaccaggcatcccaaagagaccgtaaaaaagatgcaaccctacatgaccagtacacaccatggagaacagcacacacacacaacacatcaagactctaaacatgacaaccaaacacaccgcacaagtccacagacgctccagcaccagcagcatctggcagttgagttagaactgtgatagtccagagctgtcaatggatcaccaacgcctgcaacagtaaaacgaaagaggacctggacactatggcaacctaaaaagaactta

SEQ ID NO: 67217 - DNA, 409 bp, Zea mays
  Clone ID: LIB3076-043-Q1-K1-D2
gcgaggcgtcctcccgcagctatccctactatccgtcgagcagcgtgcgcaggtccttgggctggaccaggccggtagcggcaagggactactacgatgtgctcaggctcagcaagagcgccagccaggcagagatcaaaaaggcctattattggctcgcaaagaagctccatccagacacaaatctgggtgatgcgtatgcacaacgcacgtttcaagaggttcaacgagcttatgagactctcacggatgaacaaacgtgatcattatatgatcaggttggccctgatcagtatgagaaaactgctactggcggaggctgaactggctcatagggtagttatggaaattcattttaggataattttggtggcagcatttgctggagccgtattggaatgaatgattc

SEQ ID NO: 67218 - DNA, 149 bp, Zea mays
  Clone ID: LIB3076-043-Q1-K1-D3
atcagtcatcgttcggcatgtctccttcctatcgcactagcagcatgcgatggcgatggggctgatccacatctacaaatgcacaacactactatgacgtgcttaggcatcaaagcagtccaatacacgcagagatcttttcagcctat

SEQ ID NO: 67219 - DNA, 100 bp, Zea mays
  Clone ID: LIB3076-043-Q1-K1-D4
atcagtcgtagttcggcatgtctcactccttacgcactagcaccatccgttcgctacggggccgattcacatctccaaacccacgacactgctatcaagt

SEQ ID NO: 67220 - DNA, 127 bp, Zea mays
  Clone ID: LIB3076-043-Q1-K1-D5
ctcactcgttgtcccgcatgtaatacactttacacactaggagcatacgttcgggacggggtcaattcaattgtccacacccaccacactgctctcaagtgctgaggatgtaacgcttcccaagacc

SEQ ID NO: 67221 - DNA, 127 bp, Zea mays
  Clone ID: LIB3076-043-Q1-K1-D6
ctcactcatccacccacatcaattacactttacacactaccaccatacaatcggtactagtccaattcaaatctccacacccaccacaccactctcaattgcactcgacataactcaacccaatacc

SEQ ID NO: 67222 - DNA, 440 bp, Zea mays
  Clone ID: LIB3076-043-Q1-K1-B11
cccacgcgtccgcacaatcacaaacgcatgctcagggatgcgagtgcgggcatggccagagtgggagcggcggcgaagggcgagctgtaggccgaggaggaaaccctcgcgcgcgcaagcggatgtcgacggcgacggcgacgcggtacaccgcggcgcctaaggcgggcgccctccgccaaagggacacacaactgccaccggcagcggcgggtttttctgctgctacctgctccggtccctctgcccgcgcagcaagagccgcacctacatcggcttcacggtgaacccgcgccgccgtatccggcaacacaacggcgagatcgtcagcagcgcgtggcggacccggcgcggccggccctgggagatggtgctctgcatctacggcttccccttcaacgtcgtcggccttcagttcgagtgggcgtggcagcacccga

SEQ ID NO: 67223 - DNA, 298 bp, Zea mays
  Clone ID: LIB3076-043-Q1-K1-D7
ccctctcgttgtcccgcatctcatacattttcttctctctgtctatacgtatatgccgaagttaatctaattgatcacaccgatcacacctgactcaatagcgctgcatgttactctactcagaacatgcactagttttatgaaccatgcgtcgtatactgcgtatggtcaacgtcagcatactcctacttatatgaatcagttacctccatactgtccacaaatccattaagactcaacaatgacacatctcttgctacttaacatttattctacaaaacttgtctataaatctcat

SEQ ID NO: 67224 - DNA, 459 bp, Zea mays
  Clone ID: LIB3076-042-Q1-K1-G1
cggacgcgtgggcttcgacactccgctctaccgcttcaacgtcccggatctccgcgtcggcgccctcgactcgcttctcgccctcagcgacgacctcgtcaagtccaatgttttcgtggagggcgtgtcacacaagatccggaggcagatcgaggacctcgagcgcgccggaggggtcgagagtgggaccctcaccgtcgatggcgttcctgtcgacacctacctcaccaggtttgtgtgggatgagggcaaataccccacaatgtctccgctcaaggagattgttggcagcatccagtcacaggttgccaagattgaggatgatatgaaggtgcgagcagcggaatataataatgtaaggagccagcttagtgcaatcaacagaaagcaaagtgggagcttagcggttcgtgatctttccaatctggtaaaaccggaggatatgatcacctcggaaca

SEQ ID NO: 67225 - DNA, 376 bp, Zea mays
  Clone ID: LIB3076-042-Q1-K1-G4
cggacgcgtgggcgcacacacacacaaccagatctcccccaaatccacccgtcggcacctcggcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactataaccctcgaggtggagtcctctgacaccattgacaacgtc

SEQ ID NO: 67226 - DNA, 358 bp, Zea mays
  Clone ID: LIB3076-042-Q1-K1-G5
atgaaaaggtggccttggctgaggtgagacagaacatagattctgttcaaagcaaagcgaatgttctaaatcttcgagctgataggtgctggagggaagaaggtgctgaagttatgctagaactatcagataccaataagtggtgtatagttgtgaagatacaaggtattactaggtattcacttaaaccttcagatgttaggtcatatgtcattaatcgtcattctcaagcctacatgtgggcagttgatgatgcatggaaacttgagttcactgataagtgggactggctggtattcaaagagctgcaatgtgtgggccgtgagcgtaattccaagggaagacaatcccaattcct

SEQ ID NO: 67227 - DNA, 402 bp, Zea mays
  Clone ID: LIB3076-042-Q1-K1-G9
cggacgcgtgggcggacgcgtggggcgccaagctcgtgcttctcccagagatatggaatgggccgtggtcaaatgacagcttcccagagtacgcggaggacattgaagctggcggagatgcggccccttcattttcaatgatgtcggaggttgctcgcagcttacaagtcactcttgttggtgggtccatagctgaacgttcgggaaacaacttatacaatacatgctgcatctttggttcagatggcaaacttaagggtaaacatataaagatccatctttttgacattgacattccaggaaagatcactttcaaggaatcgaagactcttactgctgggcattatcctactgttgtagacacagatgttgggcgaattggtattgggatatgttatgaca

SEQ ID NO: 67228 - DNA, 347 bp, Zea mays
  Clone ID: LIB3076-042-Q1-K1-H11
gcgaacgcattcctgccatctcccaagacctcctcagactttagaatcgcatctgcgtccatgggcgccgggggcactggaactggagggaaggcgaataagggagcggccggtcgcaaggcctgcgggccgatgaagaagtcggtgacgaggtccgtgaaggccgggctccagttccccgtcggccgcatcgggcgctacctcaagaagggccgctacgcgcagcgctttcttcagcggtgcccctcgctacctcgcggcctgcctggagtacctcgccactgatgtcctggagctcgccggcaacgctgccaaggacaacaagaagacgcgcatcgtcccgcgcc

SEQ ID NO: 67229 - DNA, 174 bp, Zea mays
  Clone ID: LIB3076-042-Q1-K1-H7
caaaaagaaaaaaaaaaaaaagaataaaaaattttaaaaaaaaaaatttaaaaaaaaaaaaaaaagaaattttttaaaaaaaaaattaaaaattaaaaaaaccaaaaaaaaagaaatgaaaaataaaaaaaataaataaaaaaataaaaaaaaaaaaaaaaaggcgcccccctt

SEQ ID NO: 67230 - DNA, 292 bp, Zea mays
  Clone ID: LIB3076-042-Q1-K1-H8
gtcctattgttatgcctccaaaatcattattgatcagaccttttgtggacagaagattctgtatcacatctggttcttttgagatttcaaatcaaagtcaattcaattgctattgtctgtatgaggtcgatggacagaggcccagagcacacaataaatagaggtttttatgtagctgaaggtgcaaaaatgtgtagtgtggagcaggtcaaggttgcacaagctctttatgtatctggtagcctgttcaatcactcatgtcagcccaatgtgcacgcatattttctttcac

SEQ ID NO: 67231 - DNA, 388 bp, Zea mays
  Clone ID: LIB3076-042-Q1-K1-H9
ggtcgaccacgcgtgcggtacaagttgatgctgctccattcaagcagtggtaccttactcactatggagtggacatgggtagggggaagaaggtgcctgttgctaagaaggatgcgactgagggacaagagggtgaggctatagctgaggaaacaaagaagagtaaccatgtgcagaggaagattgagaagcgccagcaggaccgtgcactcgacactcatattgaagagcaatttggcagtgggagattgatggcctgcatttctgcccgtcctgagcagtgtggccgagctggtgggtaaggactactggaccatttcacctagcttcagtagcttacagtttccacctgaaatttcctagcatttgctgggcattattttttatt

SEQ ID NO: 67232 - DNA, 402 bp, Zea mays
  Clone ID: LIB3076-043-Q1-K1-A1
cccacgcgtccgcctaaataagccatcgattcaggctcttatccatgggctgaacagacgctactactcgattgcaatcaattaccgaaaaaatgaacttgaggagaaaatgttgctgaacttgcacaaaaagaaatggacagatgggctaattttgaagaggtttgacactcattcaaaaaccaacgagcagactgtccaggaaatgctaaacctagccatcaagtacaacaaggcggtgcaggaggaggacgaactgccacctgagaaacttgcgatagcaaatgtaggtcggcaagatgcaaaaaagcatttggaagagcatgtgtccaatttgatgtcatcaaacatagttcagaccctaggaaccatgctcgacacggttgtattttaagctctact

SEQ ID NO: 67233 - DNA, 296 bp, Zea mays
  Clone ID: LIB3076-043-Q1-K1-A10
cccactcatacactcactcttcccattcttattcatatccattttataattttcataaccatactcataccatggaacctttcaatactttaaagggcattcaaaattaacacacccaatatcctacataaaaccttcactactatcatactcactaaacctacataacttcatacaaatatttaaacaactaccttctcaataacattcctcccctcaactccaataagccatcaaatccatacaacataaatcattaaattaattacgacttacacttacaaaatcttacaact

SEQ ID NO: 67234 - DNA, 451 bp, Zea mays
  Clone ID: LIB3076-043-Q1-K1-A11
aatacccgggtcggccgactcatacgctccctctccccttccctccctacctctattttcgggccgccagaggcaatttcaccctcggttctttctccaattcgggcgggcgctaccaaaattccctccgccaagctcggatctgaacgctgcgctccgtgtcgtcgctcgaatccgccatgaacggggccaaatccaagggcgccgacaaggccgatgccaagctggcggtgaagagcaagggggcggagaagcccgccaagggcaggaaggggaaggccggcaaggaccccaacaagcctaagacggctcccagcgctttcttcgtgttcatggaggaatctcgcaaggagttcaaggagaagaaccctaataacaagtctgtccctgcggtgggaaaagcttctggctacaggtggaaatccctgagcgagtcctacaaagctcccta

SEQ ID NO: 67235 - DNA, 238 bp, Zea mays
  Clone ID: LIB3076-043-Q1-K1-A2
cccacacgtcctcctacatgtgccattattttaggtttagcaacatacgctgaacatagagaactaggcgattgcaatcaactacagaccgaatcaacctgtcgagaatctgtcgctgtacttgtacatccaatataggacaatcgcgctaaatatgaagagatttcacactgacacatctacgaatgatcacactgtactgcaaatgcttaagctcaccatgatgtacatcaaagct

SEQ ID NO: 67236 - DNA, 242 bp, Zea mays
  Clone ID: LIB3076-043-Q1-K1-A3
caatacgacccactcatccgcccacacgtccacctacaccacccaccattttaacaccaccaacacacacacaacactcgcataaatctaaaacccatcaacccccaaccacaacaaactaatgaaactcaatcacttcactataacaacacatatacaacaaacagactaaatattaacacataccacactcacacatccaccaattatcacactatactacaaatcctaaaccacaccaa

SEQ ID NO: 67237 - DNA, 416 bp, Zea mays
  Clone ID: LIB3076-043-Q1-K1-A4
aatacacttaattcgactgcaagtagctgtacacatgaatcattgtcattgtgcaccagggctatctgcatttatggtttgtttggtttctagagactaatttttaatacttctattttattccattataacgcttaaattactaaatactgaatctaaatatacttttagtctacatatataccagcttaggtactaatatcgattataatggatagacttaaaattagtccctagataccaaacacccccttactcagacacctgttatctcatggacagatagcatacctgctcgactacactacatagacaggagccgctccttggctcatggatgctgccatccaaggcgcctattatgcagacaagcctgtctgttgcttgaatattgcatatgaagctgtttaatggac

SEQ ID NO: 67238 - DNA, 360 bp, Zea mays
  Clone ID: LIB3076-043-Q1-K1-A6
cccacgcgtccgccgactcgtccgcggagttcaagaccagcaacatccaaacgctctggggagagatctcgtacgcatggcccacacagtgctacacacggctgacgctatagcgcatgggtcgaccgacacagatgtactcagcagatgatagctcacctgataccactgcgccacatctatacgtgccacgatcccaattccgctcatcgacaacacgtctctcatgtggaggtagacgcctacgaagggcgacgtacaagacgtactagctgaggacgactacgactacaaggaggactaggatccggaagaaggatgagctgagctggagctggatcgaacagcccagggaagagg

SEQ ID NO: 67239 - DNA, 218 bp, Zea mays
  Clone ID: LIB3076-043-Q1-K1-A7
acacttcctcccactccttttagcattacaccactaccaacatccataagctcttatgaaaaatccattactcattacccccacatctatacacacaactcaactataccacattattccatccacacacataaactcatcaaattataaatcaccttataccactactccacatctatacttactaccatactaataccaatcatcatcaacacact

SEQ ID NO: 67240 - DNA, 455 bp, Zea mays
  Clone ID: LIB3076-043-Q1-K1-A9
ctccgtttccccttccctccctccctctccccgcgggccgccagaggcaatttcgccctcgggtcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagag

SEQ ID NO: 67241 - DNA, 288 bp, Zea mays
  Clone ID: LIB3076-043-Q1-K1-B1
cccaggcgtactcgtacatgtacaagtactttagcactaccaacataccttgggcattgtgatagagctgatcgccaatacctacagaccgatgcgaactatcgaatatcattacatttacaagtctgatccgatatactatgatccaaagaaagtttcagaccgtgcatcctgtcatcatccaagatcgctgacctgtatattcagaagaagatgaacaccaagctgaactcgaagctgatgagcactgttatcgaaatgaatacaataatagtgcaatgcgtcatt

SEQ ID NO: 67242 - DNA, 363 bp, Zea mays
  Clone ID: LIB3076-042-Q1-K1-F9
cgggccgaccgacgcgtccgcacacgccgacgcgaactaaccaaccagcttgtaatatgtatcacgcgctgactatgatggctcggggcgcccttgtcttcggcgcggtgctcctcgcggcctccgccgccgcggtctacgggttccacctgggaggggacgagagcggtctcgtgaggggtgtgctcgccgcgctccgcgagcgagccgaggccgaggacgccgctcgcttcgccgtctcccactacagcaagaaccatggctccgctttggagtttactagggtgctcaaatccaagcggcaggtggtgaccgggaccctgcatgacctgatactggaggcagctgatgctggaaaaaaga

SEQ ID NO: 67243 - DNA, 296 bp, Zea mays
  unsure at all n locations
  Clone ID: LIB3076-042-Q1-K1-C6
caggatgactccgtccgccgccgccgcaacaagccgagcgccaagttcctcaagctgctccggaagcggtcccgcgactacaactccgacgacgaggatgaagctggtgacgaccggcagcaggagcacctgccgaatcctcaacgccgcgttgacgaggacgacgacgaggccctctctcactccgagccggaggagggcgaggacgaggacgaagaggagggggcctccagctcggccgtcacgaggttcgagcaaggctgcanggcgttccgcgtcgcctttctcaagatcat

SEQ ID NO: 67244 - DNA, 281 bp, Zea mays
  unsure at all n locations
  Clone ID: LIB3076-042-Q1-K1-C8
cgttttcggcagcttctgccgtcaggcgcgcacctncgtcgccatcaccttcggcaccgtcggctgtttcatcctggctgtccctcatctcctcgtaccgccttttcagcgcctacgaggcgcccccgtcgtcggcgctcggcagcaagggcgtcgagatcgccgcctacccgcgctgaagccgctggagggaggcctcgttgcaaatctctgttatgcgtagtcgatcatgtaataatggcttatcgcatatatacttcgttgatagtttgctgtcacat

SEQ ID NO: 67245 - DNA, 407 bp, Zea mays
  Clone ID: LIB3076-042-Q1-K1-D2
cttccttccgcggactagttttttctgaagattcggcgatggcggcgacgatccaatccgggaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaatatgagtggggatggtgcaagcaaaaacttggtgctaatgcaattctggctgtgtcattagct

SEQ ID NO: 67246 - DNA, 472 bp, Zea mays
  Clone ID: LIB3076-042-Q1-K1-D3
ccggggagaggcagtggcttggcaccttctacaccgctggtgcggcctccgcggcctaccggtccgcctcccggagcttcgccgacgagaaacgccgccgccgcgggctgcccgtggccgcgtccacaccagacactccggcaagcggcagcaccccgacggcttcctcctcgtcgtccgcctcgaccgctccattcgcgcacccgtcgccgtcgtccgtgcttgaaccgagcaaggaagcgcggaacacgcagtccccggagctgacgccggcaccgccgtcgaccgaatcagcgcagctgccggaggacccagaggtctaccaggaccttctgcgcgggctgcagctgcccgacatcgacccgctggacttccgcgccgggctggacgccctggatctctccgatgcggacttcggcctggacgacgaacatgatcttctgctccgggacttcggggacgaagagatgga

SEQ ID NO: 67247 - DNA, 239 bp, Zea mays
  unsure at all n locations
  Clone ID: LIB3076-042-Q1-K1-D4
ggccatcggacgcacaaggacagcagagtgcaggaccggagcggagcgaccgagagtgtgtgggagagagatggcgtncagcgcctcgtctcccctgccgttgccaacgctctcgctcgccgtgatcctgctcgcgctgtgcgcccgcggcggcgaggccaggccgccaccgccgttccacggcgtgcgcccgttcgccttcgacaaggggtccacccagatcttcggcagcgccaacc

SEQ ID NO: 67248 - DNA, 422 bp, Zea mays
  Clone ID: LIB3076-042-Q1-K1-D6
aaggacatatttcttgtcatatttcttgtagaaacgtacacacttcttgtcatatttctcagacatgttctcttggggtagggatactaacaaatgggttctaaaattgagttgataaggaaacatttgaaacaggaggaggaggatgatgatgagttattttttgtgttagttccagctatatatgcttccctttattctgaaaagaggccagtacacacttcttgtcgtagtggtgcacaaaaaattagagaaatgctcgatggtcatgagagctggtgcaaatctgagtttcgaatggagccagagatctttagagctgtagcaagctattttagaagagaaggactggtgcaagacacttcaaatatgagcattgatgaacatcttgggatattcatgtacatgaaatcttaaaatgc

SEQ ID NO: 67249 - DNA, 217 bp, Zea mays
  Clone ID: LIB3076-042-Q1-K1-E10
gcgtccactcgtccgaccacgcgtccgggagaatccgctgtagtagctaatacaatgttccggggaacgggcatgaccttcaagatgcatatctttgagaagacgctgacagggaagaccatctccctctaggtcgagagcatcgacaccatcgacaatgtcaaggccaagatccaggacaaggaaaggatcccgccggaccatcagcggctgatct

SEQ ID NO: 67250 - DNA, 329 bp, Zea mays
  Clone ID: LIB3076-042-Q1-K1-E2
ctttagttcttattctaatgaactgctggtttgtgatgaagttttgtttagggtttatgggggggcattgtgtatgggggttgtgtttaattgctcaccccttattttgttcaccttcactggatgatatacaatagtatgtgctttcccaagaccctttagttaagaaacatgaaatgctcctgaatcttcttatccaagacatcttttggtaactaacataatgcaggttggtggagcatttgcttattttggacaaaagactcaagtttaccataaatgtatatcaccgattattactcaataactactggcttgctttttaagca

SEQ ID NO: 67251 - DNA, 378 bp, Zea mays
  Clone ID: LIB3076-042-Q1-K1-E3
cgatcccgtgcttccttctcgcacctgcggatctactctccgcacctgcggatctaccccggggcgaaacaagcgccccgacgcctcagggaatgcggagcgatgaggcggcgctcaggcactgacgtcgccggtcagcgcgagctgcgcggcgaccgaacctgccatcgcaagcacgtcgaggacgggtagactcgtccatccttccttcctcctgttagtcgtcgtagggtagtttgcactttgcagatagctagctagtagttaggggatcaggcatgggtgagggcgaagctgaggtgaagggcggtgtgctgcatgggccgttacaagctcggcccgcgtgctgggtcacgggaactttcggcgcgttcacgc

SEQ ID NO: 67252 - DNA, 437 bp, Zea mays
  unsure at all n locations
  Clone ID: LIB3076-042-Q1-K1-E4
ggtcgatcacgcgtccgaggcggacctgccaccccgccgcggcaccgggaagaccgtggcggaagatcaccgggagttcaccgggcgtgcccatcggcaggtgtgccaggtgatcggcgccgtcgttgacgtgcgcttnatgagggcctccgccatcctacggcgctcgaggtgctcgacaacaacatccgcctcgtgctcgaggtggcgcagcaccttggcgagaacatggtgcgcaccatcgctatggacggcacggaggggctcgtccgcggtcagcgcgtnctcaacactggcttccccatcaccgtgcctgttggcagggcttacccttggacgcatcataaatgttattggtgaaccgattgatgagaagggtgacataaagacaaaccactttcttcctattcatcgtgaagcccctggctttgttgagc

SEQ ID NO: 67253 - DNA, 328 bp, Zea mays
  Clone ID: LIB3076-042-Q1-K1-E5
actcgggtctcgacgtctcgtctcgtctcgtctcgcctgcccgcagccccttggcttcgttgcatccggcttctcggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacaaagaatgcataatttgtgcacgttcttttactggattccggtggcgtcctgggcgagatgcaaggtacaagaagactgagatctggcagacatgttgcaagctaaag

SEQ ID NO: 67254 - DNA, 363 bp, Zea mays
  Clone ID: LIB3076-042-Q1-K1-E9
ataccaactatctacatgttacgcgcaatgttgcactaacaatggccgccaagagattcgggcttcttatgcttcttgatatgtgtgtacacgctgactcggtgaccatagtacagaagtgctcacaagctactataccttacatagtatcggcgtacctcttagcagcttacgcttaatggatgtgaaaacccaatgattcatacctacaagatccttcgtgcgatctcagatcataggttaactctataaatcgtgcacgtgcgacaatcattatccctgaatcatgagttaccgtcagtgcatcaatcggcacagatcattacggcgcaacaacgacaacgactcgggctagcaaacctt

SEQ ID NO: 67255 - DNA, 474 bp, Zea mays
  Clone ID: LIB3076-042-Q1-K1-F1
gggaaaagctgctggcgacaggtggaaatccctgagcgagtcggacaaggctccctatgtggccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgacgagtgatggagagctcgctcgagacaatggacggtgcttcatccaacaatggagcggctacacaaggccccgtggcgatcaaaaaaaaggagcctatatccatgtactagaattattcagtttcactccacatcgtgatgttttaattttacttttgtcgtgctataacggatagcgctcctcgttggcgccactggcgggtggttctgcctctggtctgg

SEQ ID NO: 67256 - DNA, 339 bp, Zea mays
  Clone ID: LIB3076-042-Q1-K1-F10
ctcatgtgcctactcatgccagcaagtggtacgcacatttacatagatgtgcttttcgtggccaacgagcaccatctgttccatctcaatcctcatccccaccatctgtcctgatgtttcaacgatgtgatccaaagatgtccccatttgaattagggcatttccacgtgaataagaaagaggatagacgcgcaatgtttgtccatgctggatgcatcgtatgaactgaacaaactacgatgctccatgctcatcatgtttctggaggaacggtaaacagatatatgacctgtgataaatctcatcccgctgttgccgctgctttagacaacagggaag

SEQ ID NO: 67257 - DNA, 291 bp, Zea mays
  unsure at all n locations
  Clone ID: LIB3076-042-Q1-K1-F5
cggacgcgtgggtgaggctgccgccagccactggccagcgtcgttcgctttgtagcagtccagctctgcgcccggcgccgcaggcccgcatcgcgcacaggcacaacttctacggtcctgccgctgatcgccgcacgtggccgcgccgccgcctccctcacccgagctcgaccgcgcttctccagctcgccgcctcgacggtcgctgcctcgacacctcccccgcgtgggcatcagccgggagcagagagccctggtccctggaggcgcgtcgcgttacggcggnggcgcg

SEQ ID NO: 67258 - DNA, 450 bp, Zea mays
  Clone ID: LIB3076-042-Q1-K1-F6
cccaggcgtccggctgggagaggctttacccttgaggagctgaaggctgctggcatcccagggaagcttgctccaaccattggtatttctgttgatcaccgccgcaagaacaaatcccttgagggactgcaggccaatgtccagaggcttaagacatacaaggccaagctggttatcttcccaaggcgtgcgcgcaaggtgaaggctggtgactctactccagaggagcttgccaccgctacccaggtccagggtgactacatgccatttactcgtggtgagaaacgttcagttgaggttgtgaaggtcacagatgagatgaagtcatttgctgcctatggcaagctccgccttgagcggatgaacaagaaacatcttggtgcccgccagaagaaggcagctgaggcagagaaggaagataagaagtgaagctgttgaagatagtaccct

SEQ ID NO: 67259 - DNA, 437 bp, Zea mays
  Clone ID: LIB3076-042-Q1-K1-F8
cggacgcgtgggcggacgcgtgggcggactcgtgggattacatgagcttgatccggtgttgaaaaagttttctttctcagagagtgttgcaagcttgttctcttctttaggctacaagaggcctgcagtcattcaatctatgtacatatttaagcaaccaggtattggtggtgaggtcgtgccgcaccaggataatacattcctttacacggaacctcgtacatgcacagggctgtggcttgcacttgaagatgcaacaatcaacaatggttgcctgtgggcaattccaggatcacataaaaagggtttggtgagacgtatggtcagagatgaaaatggtacacattttgatcggtccttcccagtctatgatcagaaagaatttgtaccgctggaagtaaaaatctgtgctttggtggttatacatggagatctta

SEQ ID NO: 67260 - DNA, 302 bp, Zea mays
  Clone ID: LIB3076-042-Q1-K1-C2
cccacgcgtccgcggacgcgtgggcgggcggccggagaccagcgacggtgacggtggtgctggacgggaaggagggcgtcgcggtcaggatgagcgtgcacagtgacgtgctcgcccagagcagcgccttcttcgcgcggcgcctcgccgccgccgccgccgacggccagccctgcgtggagatccacgactgcgaggacgcggagatctacgtggagacggtcggcctcatgtactgcgacgacggggccaacaagcaccggctgctcaagcagagcgttccgcgcgtgcttcgcgtcatg

SEQ ID NO: 67261 - DNA, 419 bp, Zea mays
  Clone ID: LIB3076-041-Q1-K1-H10
cggacgcgtgggttcaggagcactcttgaactagaaatcggaattgatgaggtttcccagtcgacgaattatacacccacgaccatgaataacaaccaacaacctgctgccgacccaaatatcaagcctgcacctgcaccttacaccagcgatgaacttgtgaaagtaactgaagaacaaattgctgcatcagctgctgcagcttggaacccgcaacaacctgcatcgtcgcaacagcaagaagtgtacactactccgagtgaggacgctcctacatcaggaggaagcgatggtcctgctgctccagctcttgctgcgagtgactcggatccaaagcaagtgaatctggacaaggcggaaacacagagatgactccgcttaacagcttgacactggatgggatgagcacactgaacacg

SEQ ID NO: 67262 - DNA, 417 bp, Zea mays
  Clone ID: LIB3076-041-Q1-K1-H11
gagaaacattaccgttatgtcaggagccatgacgtcgcttattggtcaaagagcttcatcatatactgggaaagggtttgtaaggatcacttcaagaggacttgttggggcatagggttgggttttggtttcagggtggtggccttggaccctcatttcacaaagcttaacatggattcaatcattaatgcttatgagctttcaaagagcagggctatattgctcgattatgatggaactctggttccccaaacttacctcaacacggaacctagtccacaggttttgagcatcatcaataccctttgctcagatagtagaaacatcgtttttcttgtcagtggtcgagacaaagataccttgggaaagtggttctcctcatgttcaagattggggattgcagctgaacatgggtac

SEQ ID NO: 67263 - DNA, 219 bp, Zea mays
  Clone ID: LIB3076-041-Q1-K1-H2
tttacatccaacatgctgtttcggtctagtgcacctttctaaacggtggtgcaccatacaatgtccggtgatgcaccagacagtgttcggtggaccatgctgcctcgtccgaacaatccgctctcgataattcgtctacgacttactgttaaaattcaccggactgtcctgtgtgcaccgtactgtcctttgagccaactgtccatctggccaacattt

SEQ ID NO: 67264 - DNA, 397 bp, Zea mays
  unsure at all n locations
  Clone ID: LIB3076-041-Q1-K1-H4
cttccgaccccgagcggtcggtacctcgcaagcaaaactacaagctcgcttttaaattgtgttgctgcaattctctcctctgtttcccactcgtagatcccgccgcctcccgcgtctagccgccgacgagcaccgcagcctgacactgccgcgggcgaaccatcgcgtgcggcctcgcccgggatggcgaccatggagagcctgatcgggctggtgaaccgtatccagcgcgcgtgcaccgtcctcggcgaccacggcggcggcggcggcggcgagggctccctctgggaggcactcccctccgtcgctgtcgttggcgggcagagttccgggaagtcgtcggtgctcgagagcataatggggagggacttncttgcccgtggatctggcattgtca

SEQ ID NO: 67265 - DNA, 117 bp, Zea mays
  Clone ID: LIB3076-041-Q1-K1-H5
aacatgaataataataagataataaatttttctgtttacagccaacaggctttttctggctatggcacaaaactgggcggtgttgcacctgacattgtccagtggttcaccttacat

SEQ ID NO: 67266 - DNA, 448 bp, Zea mays
  unsure at all n locations
  Clone ID: LIB3076-041-Q1-K1-H6
cccacgcgtccgattggacaccgaatgagcagcgagcaccagtttaggcaagggagcaggtcgccagttgtcggtcgcggcctcctgcgctcagcgcttcgctcgcggtgccggtgcgtgaggtgaggttgatgggcgcggagggatgagcgagagcgccttgaccataaggcggctgagcgggccgtcgaacggcggcggcggcaatgcgggagctagctcttgcgcggtcggcacctgnggaggaggaggcggcggcggcggcggcaatgcggcgagcatccggggcgtcaacgtggggctcatggacgagaaggtgctgcagctcgtgttcctggcgctcaactgggacccacagtcgctgtgcgcggtggcgcgtgtgagccggcgcctgcgcgccgtggcggatcgggtgctgtggcggaagctctgcgtctcgcgggcgccg

SEQ ID NO: 67267 - DNA, 445 bp, Zea mays
  Clone ID: LIB3076-041-Q1-K1-H7
caaaccctaagcagggagttgatttatccgctgcagccatgagtaagttgcagtctgaggctgtcagggatgccatctcccagattgttggggatgccaaggagaagaataggaagttcactgagactgtggaacttcagattggtctgaagaattatgatccacagaaggacaagcgtttcagtggctctggtaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccct

SEQ ID NO: 67268 - DNA, 104 bp, Zea mays
  Clone ID: LIB3076-041-Q1-K1-H8
gttgtcgccggtcgtcggcgcggacaggatgcggttcacgtcgttgaagtcgcggccgtaccgcgcggcgacaccgtcgccgatgcccgtgatttcgccgatat

SEQ ID NO: 67269 - DNA, 221 bp, Zea mays
  Clone ID: LIB3076-042-Q1-K1-A11
gacccacgcgtccgcccgcgcgtccgcccacgcgttttgccagttagcagcaacccatcattggaggtgccatcgtgtatattacatatgatatgtactctacaatggtgccctcataccgacatgtgtttcctagaaataatcaatatattgattgagatttatctcgatatatttctgaactatgttcatcatataaataattgaaaacatcaaatcaa

SEQ ID NO: 67270 - DNA, 198 bp, Zea mays
  Clone ID: LIB3076-042-Q1-K1-A12
agtcacgcgtccgcggacgcgtggggttggcttctactttagctatggttcggggtcaggtgcgtgagggtcttctttgttcggtttcgtgggtgatcggatcgagatggcgtcgtctgatagtgagtaccgctgctttttcggcggcctcgactgtgccacggacgaccactccctccacaacgccttcagcaccta

SEQ ID NO: 67271 - DNA, 340 bp, Zea mays
  Clone ID: LIB3076-042-Q1-K1-A2
acgcgatccaccgcccggagccgcacatcatgctgttccgccgcccgagcaactaccagcagcagcaggaggcggctgccgcgcagatgctggccaagtgagcccctggtggccagggcggcgaccaggaacgtttaaaaccctaaccccctttccatctctaaaaggggcgtcgctgttctgttgatcaattcctctatgctgttagttggaaacttcgggtgtagttggtggatttgctggtgtgtgccttgtgttcgtggaaattcctgtgaaggaactgccatgtgttaggctgttaccatgcccattttcttaatactatgtgttgactgtgatc

SEQ ID NO: 67272 - DNA, 252 bp, Zea mays
  Clone ID: LIB3076-042-Q1-K1-A3
cgtcgacggcattcgtccgccaccaggtaaaaatatgtcctcgatccgattcgacgagtgcacaccggcttttttcactgcgatcgaatcgatggccgccgagggcgagaagaagatgataaccctcaaaagctccgatggcgaggagttcgatgtggaagatgtggtggcgatggagtcgcagaccatccgtcacatgatctaggatgactgcgccgacaacgtgataccttttcctaacgttaactccaa

SEQ ID NO: 67273 - DNA, 227 bp, Zea mays
  Clone ID: LIB3076-042-Q1-K1-A6
tcgacttcacgcgtacgccgacgcgtgagctcctcccgctccagttctttttcgggttcgtattgttctccgtcgttacgctttctttccaaaggcggatctagacggctacctcgcacagactagtaccgctacctcgtcatccacctcgcctggaccacgtacgaccactccctaacaactcctacatcacctacggcgagtgcctctactccaagatcattcca

SEQ ID NO: 67274 - DNA, 396 bp, Zea mays
  Clone ID: LIB3076-042-Q1-K1-B1
aaaaaaaaaaaatataataataatataaaaaatataaatataaaaatataaaaaataatataaaatataaatataaaaatatataaaaaaaaaataaaaaaaaaataataataaaaatataatatataataataataaaaaaataaaaatataaataaaaaataaattaaaataataaaaaaaaaaaaaaaaaaataaaataaaataaaaaaatataaaaaaaaaaaaaaaaaaataaaaaaataaaaaaaaaaataaaaaaaaaaaataaaaaaaaataaaaaaaaaaaataataaaaaaaaaaaaaaaaatataaaatataaataaaaaaaaaaaaaaaataaaattaaaaaattaaaataaaaataatataaataattaattaataataatat

SEQ ID NO: 67275 - DNA, 383 bp, Zea mays
  Clone ID: LIB3076-042-Q1-K1-B11
aattgacatgaagaatctgattggcgaagcatcttgtagaatctgtcaggaaaacttaagcacaactattaatgcactcactgagcctattgatatatatagtgaatggattgatgagcgtgaacgtgttaacactgacgaaggcgactatgattcgttagcttgccccatgcacgatgaaactgttacctacaatcgtaatgtaatgtgctggtatactcgaatgccatagcccatagtcagccatggcttggaataacgtagtggctgactgatatgccagtaggcaccttatctagtacttacagaactacaaaaagtttgtactatacatgtatagacaaccttataagtggctatgtgatgacctatcctaacgctca

SEQ ID NO: 67276 - DNA, 446 bp, Zea mays
  Clone ID: LIB3076-042-Q1-K1-B6
gaagtatgccaagaagacccgttgtcccgcagtgcaggcagtgccatcagggacaaattctggcggttcggcggggcaaaggacccatcatccctgctgaaggattttgcaggtgatgccgtcattagaaactccgggagtggaataatcccgaacgctagttccttgtgcaaagaaattggattgtgaaatagcactgtgggggcggaggctggcatctttctgcttgagcttggctgaagggccaagaactaaacctcgagggcttgaggtagtttgagggagattggagatgatttaatccctctctattcaattcacctttaaccggacaaggtcgaacaagtcatgaaggggcagagtcgcttgaggtcccgggcttgacctctcggcatacattaatggtgtggtgctagcgggagatggttcctctagacatactttct

SEQ ID NO: 67277 - DNA, 363 bp, Zea mays
  unsure at all n locations
  Clone ID: LIB3076-042-Q1-K1-C11
ggatcctccccgcgcccgacacccggaaacgcgcgcgcgcgctagggagagacagagtggggaaacgagggaaggagacgacgcgctcgcctattggccgccggctccgctcctttgcgcccagtgcgacggccacggcctgagcggcgctgccagcaaggcggctagtatgagcagcatggagtcgcggccgggccgaacgaacctggtggagcccatagggcacggcgccgcgctgccgtgcggcggccaggcagtgcagccgttgtggacgagctccggggctgtgctcggtgcagtctcgccagccgtcgtggcggtggcgcccgggagcgggacggngattagcctgtcgagcagtcc

SEQ ID NO: 67278 - DNA, 421 bp, Zea mays
  Clone ID: LIB3076-041-Q1-K1-H1
acggttccttgtcggtccattcctcgatggattttcgaccaaccaaaatgtctttgctttcgactacacaactcacgttctggtattcatcatgctgtcgtgcctgatttcagtctcggcgaacttcaacacttttctcgtgatcgggaagacgtctcctgtaacctaccaagtccttggccatctgaaaacatgcttggtcctgacctttggctatgtcctgcttcacgacccgtttagctggagaaacatacttgggatcctaatcgcgagaatcgggatggttctgtactcgtacttgtgcactagatagactcagcgaaaaccagcataagcctccccgcaagccgttcaggcaaaggagggtgaatcgaacccgctgatctcggactcactgagcgctgtcgaaaatggaggcagt

SEQ ID NO: 67279 - DNA, 232 bp, Zea mays
  Clone ID: LIB3076-042-Q1-K1-C12
acggccggacggacccacgcgaccgcactctccttcgaagccatcgttcccgttttaagctatccagaatctagatgcggaagcgggagcttaattatggtgaatgggcgcacggagcatcgcgtgaggctctacgtacagttcaccgtgcttggatacaagcggtccaagtcgaaccagtacgagactacgtcgctggtgcatatcgagggggtgaacaccaatgaggacg

SEQ ID NO: 67280 - DNA, 458 bp, Zea mays
  Clone ID: LIB3076-041-Q1-K1-F1
ctcaatcagaggaacacgtgactctggactcatttctcctatcgaagatcccatggcaagtatgcaaaaaggctactgtggtactattatgcttgctgttcttacgtttggggcgtctactcgttggcttctgtacacggaacaagcaccttctgcatggctgaattttgcattgtgtggcttggtggggatcgtcacagcatatgcttttgtttggatttcgaagtattacacggattataaacgagccagtccggcttttagctctttcgagttccacaggacatggaactaatattattgctggagtaagcttgggaatggaatcaacagcactaccagttctagtgataagtgttgccattatatcagcatattggctggggcagacctctggcttggtggacgagtctggcaacccaactggtggtctttttgggacagctgtagcaacaatg

SEQ ID NO: 67281 - DNA, 430 bp, Zea mays
  Clone ID: LIB3076-041-Q1-K1-F12
tctggacgcactcgttctcgggctcgtggtcggacgcttgggctccatttacatcatcatctataggagatgcttcggtccgtctacttgctcgtttgaaaagcaaggggtccagaaaaatcatttctagtgctgcctctgccaatggaacacttttggcctattcagatggtgtgagaccctgcctctttgcgctaaggcataagggtggaaagaagtatacccttgacaaattagagctaccaaaaggattgccctgttctcagagtatggcgtttacggttgattcgtccaatttgatacttgcgggacgtaatggaaaaatatacatcattgacattgcaacaagagaaatttcaaatgtatttcaccctacaagaaatgcagatggatcataaatttcaagagaatcacctttaacgaaaatgtt

SEQ ID NO: 67282 - DNA, 329 bp, Zea mays
  Clone ID: LIB3076-041-Q1-K1-F2
cggacgcgtgggtcatcctgttccatggcctcccccaaagccctatcacgctgggacgggtgccatactagcgccccaaacccacacaacatgtacctcgtgtctcactctctttctcgcacgactttatcacaccaacccttacacctgtccgcgtctcgtgaatacctaccgctcaattcaagctgatcccctccgacgatacgtcttccacccttactctcttcacggctactccaatttaccgcctgtcagtatctactgaatatgaacttgcactttgaccctagtcccaaaaagcaatgactgcaccagcaccgatctgctct

SEQ ID NO: 67283 - DNA, 460 bp, Zea mays
  Clone ID: LIB3076-041-Q1-K1-F3
aaaccgggatcgggcggcatcctccgtctcgtaccgacccccgcaccgccaagccctaggccggcgaggcgaccttgcgacctccgttcctctgcgctccggctgagtttctgatttgggataatcctgttctctctgagtgaatcaacatgtctgggaatgatgataagccacatgctgctgcagacagaataaaggcagccacgttatcagtggctaagggattgagcagggctcaagctgaacgcgctgcgactgctgctgcccgcaatgtgaatgcctatgggcagaatgaagagggaccaagccgctggcaggagaggaaggaagccacgagacagatgtatctgatgagtacagagaaggctgcgaagctgggcactgtgaagccaaaagcttcagaaacttcttctgttggcgcatatacccaatgccagaagtgtttccagcatggtcactg

SEQ ID NO: 67284 - DNA, 451 bp, Zea mays
  Clone ID: LIB3076-041-Q1-K1-F5
cgccgcgaagccgtcgccttgcccttcacgaagcttggcctcctccttgtatctgcactcgccttacagatccgtcctccagctagggtagcgttcctctgcagcgaggcgatcaagcggaccaaggcggaaagaagatcgcgtacgacaagaagctggcagcctgctcgatgagtacaccaaggtgctcatcgccctcgccgacaacgtcggttccaagcagctccaggacatccgccggggcctcaggggcgactcggtggtgctcatggggaagaacacgctcatcaggcgctgcatcaaggtgtacgccgagaagaccggtaaccacacctttgacccgctcatggacctcctggtcggcaacgtaggcctcatcttcaccaagggagacctcaaggaggtgcgcgaggaggtcgccaagtacaaggtgggggctccggctcgtgtt

SEQ ID NO: 67285 - DNA, 396 bp, Zea mays
  Clone ID: LIB3076-041-Q1-K1-F7
gcgcgccgccgcaagccgtccgccttgccctttacgaatgcttggtcctcctccttgtatctggactccgcccttcacagatccgtgcctgcagctatggttagcgttcctctgcagcgatggctatcaaacggaccaaggcggagaagaagatcgcgtacgacaagaatctgtgcaacctgctcgatgagtacaccaaggtgctcatcgccctcgccgacaacgtctgttccaagcagctccagtacatccgaccgtgcctcaagtgctactcggtggtgctcatggggaagaacacgctcatcaggcgctgcatcaaggtgtacgccgagaagaccggtaaccacacctttgacccgctcatggacctactggtctgcaacgtatgcctcatct

SEQ ID NO: 67286 - DNA, 424 bp, Zea mays
  unsure at all n locations
  Clone ID: LIB3076-041-Q1-K1-F9
tccgaacctagtgaagctcttgggctactgctgggaggacagagaacttcgtctcgtggatgaattcatggccaaagggagcttggaaaaccatctattcaggagaggatgcgccccgttgtcttgggaactgaggctgaagatagccatcggcgcagctcgaggactcgcattcttgcatgcatcagaaaagcaagtgatctaccgtgacttcaaggcgtccaacatacttttagatgcgaactataacgctaagctctctgattttggccttgctaaacttgggccgactggtagcaagtcacatatcacaaccagggtgatgggaacgtatggctatgcagctccagagtacgtagcaaccggccatttgtacgtgaagagcgacgtgtacggcttcnngcgtgtgatgctggagatgctg

SEQ ID NO: 67287 - DNA, 451 bp, Zea mays
  Clone ID: LIB3076-041-Q1-K1-G1
cgcagatgcaaatgacaacgtcgtttgttttatttcttgtttggcgtttgagatctgagggcgtgagagctggacacgctgatgcaggtgtatccagcggctcacgagatcgttgacggcatggagcggtgcgcctgccgtttcgcggtgcagtggtcggatggaccgcgcgctgggagcatggaggaggtcggcattgagcgggtttgctgcgtgcagtcctcgccggtgcaagacccagtgcttatggagttcctggacggcgtgaccaagctggccggggatgccaacgtggaaacagtgtctcaggagatccacgtcgcgccggtagtcaaaggcggcgtccctgcaaacgcgtcaccgtgatttcaacggaaaatttggtccagcaagtaggcaagcggtttgatgtgcgtggttctgaggttggctatttggtgcctctgatttt

SEQ ID NO: 67288 - DNA, 414 bp, Zea mays
  Clone ID: LIB3076-041-Q1-K1-G11
ctcctcctctccctcgacgccgccggcaggagggcggaccggcggtccacggccgcggggcccgggctgttgccgcacgagtccggcggcgagtgggagggccgcaagtgcccgccgtcctcgccgtccgtggcgcgcctgccgccgctgccgccgctggcgaggtggaagcaggggcggggctcctcgcgccggccgtcgtcgcgccgcctggccagcagctcgtcgtccgacgacgagtacgacgaggactcgaggaacctcttctcgtcgcggagcttgtcgtccgactcgtccgacttctacagctgcccgcgccggaacgccagcgccagcagggggcgcgcgttcgtctcgggcccgtgccgcgcgctggcgctggcgccggcgccggcgcccccgcgccgcggcgcg

SEQ ID NO: 67289 - DNA, 431 bp, Zea mays
  Clone ID: LIB3076-041-Q1-K1-G12
ctggtcctctccctcgacgccgccggcatgagggcggaccggcggtccacggtcgtgtgtccctttctgttgccgcgcgagtccggcggcgagtgggagggccgcaagtgcccgccgtcctcgccgtccgtggcgcgcctgccgccgctgccgtcgctggcgaggtggaagcaggggcggggctcctcgcgccggccgtcgtcgcgccgcctggccagcagctcgtcgtccgacgacgagtacgacgaggactcgaggaacctcttctcgtcgcggagcttgtcgtccgactcgttcgacttctacagctgcccgcgccggaacgccagcgccagcagggggcgcgcgtccgtctcgggcccgtgccgcgcgctggcgcttgcgcctgcgccggcgcccccgcgccgcggcgcgtctcaaagctgccggta

SEQ ID NO: 67290 - DNA, 463 bp, Zea mays
  Clone ID: LIB3076-041-Q1-K1-G3
acggcgcgtctcgttcgaaaggagacgttgaaagggttctagtaggcctgactaggtcccaggaatcagggcttgccaagccaagaagctcgttgcttaggaaagcagcaaaggttgcatgatttctgggttctgtccaaattaggcctgaatcaaatgggcaatcatcacaatgtctagtctctcgtgtatattgctgttctttctttactttttaaaaaaaaaagaaaacacgcacacacaaataaatcagcaaacatgcacagttctcttcacaccatcagtagagcagtgcgagctcagtagctcgccttggaagacgttcgcgctggctttcctactctgaagaaagcagcggatcttgggctttctcaagccccggagatccagctcgccatcgggttccttcatcctactacaacaaacctgccacattgcataagcctccaattcgatacttact

SEQ ID NO: 67291 - DNA, 388 bp, Zea mays
  unsure at all n locations
  Clone ID: LIB3076-041-Q1-K1-G4
ggcgaatctgtgtgccatccatgccaagcgtgtcacaatcatgcaaaaggacatacaaggggcaaggcgtatcggaggaaggcgttgggcatgatatataatatccattctgattgcatcattcttgtgaatttgtttgtaggagctagacattagtgttgttgaatgctgcatggttcctaatccttttcgcagtctaacatctgtggagttagtatgttacatggcaacagctgaacatctgtggactataactatatggcaacagccgaagattgtgtctgtgggataactggttgttntggttgctcttcagtagtttgtttgcttcagtatggactatggagtaaactgcatgctgaaacccgaaccactgctgaaacggcag

SEQ ID NO: 67292 - DNA, 349 bp, Zea mays
  Clone ID: LIB3076-041-Q1-K1-G6
cgcgacgtcctggacacgcgcgacctcggctacacgtacgacgccgagtcctgcaaggggctgccatggctgcgctgcaagatctcgtcgctggtgccccacggcaaggacagcccgccgaggtcatcgtcggcgaggaaggcggcggcgccggtgttcccgctcgccctgaccaagggccaggtggtggaggtgccggccgtgcctgtgccggccaaggacccggggaaggagcagctgctggtgatcgaaggcatcgagtacgacccccaggcgaacaataagttcgacgtcgccatcaacctgcccgcggacaaagcgttgcaggtaggcccacagtacaaggagt

SEQ ID NO: 67293 - DNA, 419 bp, Zea mays
  Clone ID: LIB3076-041-Q1-K1-G7
gaaacaggaagaagaagaagagaagaaagttggctgtgtacagccaacaggctgtttcgggctggggcaccggactgtccggtggtgcaccggacagtgtccggtggtgcaccggacagtgtccggtggaccaggctgcctcggccgaacaggccgctctcgggaattcgtcgacgacgtacggctaaaattcaccggactgtccggtgtgcaccggactgtccggtgagccaacggtcggtcgggccaacggtcggccgcgtgatcggcgcgcgacacgtggccgagccaacggtccgaaagaggcaccggactgtccggtgtgcaccggactgttcggtgcgccagatctgcaacggtcggcttcggcatttaaggaaaggaatcgggcaccggacactgtccggtgtgcaccggac

SEQ ID NO: 67294 - DNA, 433 bp, Zea mays
  Clone ID: LIB3076-041-Q1-K1-G8
aaaacccggccggacgcactcgaacgcccgagcgtcctcggacgcgttttcagattttgatttccctttgcacaatgggtcaacggtatattctaaagatgggtgggcattgaaaacacctgactcagcggaagctgtaaatggagctaacgatgagattcctccactccctgatgaccagattttccagccagatgaactggaacaactgttgcagtcaatacaagaagattcccatttgggctcaactatcattgaccccatgcattcttctatgacaaattcacttctgcctgaggacgattatttgatgttctatgatgcacccttcgatttcactatttgtgatgatgggtatggacagaatggaaattttggctccatagcagtccatctatctggcattggcatgattgaagattgtatggcatac

SEQ ID NO: 67295 - DNA, 453 bp, Zea mays
  Clone ID: LIB3076-041-Q1-K1-E9
tcgcggactcgtgggcggactcgtgggctgattacaagggctctttgaaggaggatgtattggaacaagtcaacacgaagttaatggatcataagaagcgtagaaccaaggtaacattccgaagggaagtgtaatgcttgctcaaatttgttaactcttttttatgttcttctcatggaactcctcactgacgccggttttatgctagcttgaacactattcctccttagggtttgatgaaacaacattgctgctcaataaagaaaaggagcaaggcaaaacacacacaagggttagtggaaaagcagatggcaataaagcaaagtcagcagaacttgtgagccttggtaatgaaaaagagcaacgaagaaatcacacgaaagttagtggaaaactggataatactgcaaagtccgcgagagtttctgctacctgcgttgcgtacttaatgtc

SEQ ID NO: 67296 - DNA, 282 bp, Zea mays
  unsure at all n locations
  Clone ID: LIB3076-048-Q1-E1-H6
aattaacaacgcatcgtcgtctcccacaacacggtccaactaacctagcgacagcctcggctcgtttgatccccgcggggagctctagttccgccaagcgtgcgtaccggcgtccggattccgggacgaaaatgacngagtccctggtgcggaacaagccggggatggccagcatcaaggagatgccggtggtgcaggacgggccgccgccgggcggtttcgcgcccgtgcgcttcgcccgccggattcccacctcgggggccagcgccaacgccatcttcc

SEQ ID NO: 67297 - DNA, 365 bp, Zea mays
  Clone ID: LIB3076-048-Q1-E1-H8
aatgtctctgagctggagttgctcatgatgcacaacagaacctactgtgccgagatcgcccacaacgtttcaaccaagaagcgcaaggagattgttgaacgtgccgcgcagctcgacattgtggtcaccaacaagctcgccaggctccgcagccaggaggatgagtagtctggtttcttgtcataacggccaactagatcctgccattcccggctgtaggaaactactctgctttgtgccttgttggtacttagaataccagtcattttctacatttttggtaccagtagcgacttctatgtggcatattctactgttatcttgcgtcttaattaactgcaactcaagggttcaatggtggtcct

SEQ ID NO: 67298 - DNA, 447 bp, Zea mays
  Clone ID: LIB3076-048-Q1-E1-H9
cccacgcgtccggcttggtgaaaacgggacagggaaaactaccttcattagaatgctggctgggttgttgaagccagacacagtggaaggaactgatattgaaattcctgaattcaatgtgtcctacaagccccaaaagattagcccgaaattcaagaataccgtgaggcatttgctacaccagaaaattcgggattcctatatgcaccctcagtttgtgtctgatgtaatgaagccactgcaaattgaacaactcatggaccaggaggttgttaatttatctggtggagagctccaaagagttgctatatgcctctgccttggaaagcctgcagatatctatctgattgatgaaccaagtgcttatcttgattcggagcagcgtattgtggcctcaaaggttatcaagagattcattcttcacgcgaagaaaactgcatttattgt

SEQ ID NO: 67299 - DNA, 318 bp, Zea mays
  unsure at all n locations
  Clone ID: LIB3076-049-Q1-K1-A11
actataagcttcaagatcatctttaccaaagtttatatcatctatttntcgggacaactcagaatttttccgacattcgtacacgcatcctttgctgacaactgctgttcttgatgaatatatttctgacgctattcttttctaggagaccctttatcaatcaactacagactgcaagaactttgttgactgcttaaaggatcataatatcattcctggcatcaaggttgacaaggatttgcttccatttcctgaatccaacaatgaatcatgttgccaaggtcttgatagaatgactttaaagtgttctaatttcta

SEQ ID NO: 67300 - DNA, 280 bp, Zea mays
  Clone ID: LIB3076-049-Q1-K1-B12
ttcccggttcgacgtcggatgtgagcgcgcgctcgtagttcgacgtgatccgcttggccatgtcctcggcggagaagccgttgggcgaccagacgatgctgacgaccggaatgtcgatgttcgggaagatgtcggtcggcgtgcgcaagagcgcgagcggtcccgcgatgaagatcagcagcgcgagcacgacgaacgtatagggcctgcgcaacgccagccggacgatccacatgatgttgttcctcgaagcaaggcaagggcgccgcattcgatgcga

SEQ ID NO: 67301 - DNA, 411 bp, Zea mays
  Clone ID: LIB3076-049-Q1-K1-B9
cccacgcgtccggagatgctgaatcgtcaggtcgtgaagtctgattcagcgattatcaagattccagagcgcgactttgagatccctccagaagctcaacgtggaacactttctactgtggaagggattattatgcgagctgtggatgagctgcaggctcttcaagatgaacggaagaaagtggatcctcagaaggccgaagctatcgatcaatttttactgaagttgagatctcttgggtcaggagaggctgcattcacttttattcttgatgatcctgcaggaaacagctttattgagaatccgcatgctccgttattagatcctttactatctgtgagattctacgaaagaactcgtgaacaacaagcagcacttggttttcttgctgaaccaccaaaagaacaacct

SEQ ID NO: 67302 - DNA, 217 bp, Zea mays
  Clone ID: LIB3076-049-Q1-K1-C9
ttccgaagtcataactacggtatcttatcgcgtctattaaattcactgaccatcttatcacaccacagtgactactaaaacactgactatactcaactcaatcgattatcagcacattcctctatatccacctaacatagtagctcctactaacgcaccgatcatcgatccatacatactcaaaacctgaattcattaatttaactcactctgtatt

SEQ ID NO: 67303 - DNA, 417 bp, Zea mays
  Clone ID: LIB3076-049-Q1-K1-D10
tcgcggactcgtgggtgcagactccttcagggagttgggtttctatgacatgggggaagaggttgcctcaaggtggtcagaagaggaggaacgtttgttccagcaagtggtctcgtcaaaccgtgcttctctgcgcaggaacttttgggatgaacttcctcttgccttcccttccaagtccagcaaagagctagtgagctactacttcaatgtcttcatgttgaggaagagggctgagcagaacaggttcgacccagcgaacattgacagtgacgacgattagtggcaagcaggtggtgattttgagtttccaataacaggaagaactgatgaatacatgccaatcgagtcccttactgatcaagatgatgttgcttgcaatccatttttctttggaggggatttatatggagattc

SEQ ID NO: 67304 - DNA, 175 bp, Zea mays
  Clone ID: LIB3076-049-Q1-K1-D11
ttttccatcaagtggtctcatcaaaccgtgcttctctgcacatgaacttttgggatgaacttactcttgcctttccttacaagtccagcaaagagctagtgagctactacttcaatgtcttcatgttgaggaagactgcttagcataacaggttcgacccatctaacattgacag

SEQ ID NO: 67305 - DNA, 336 bp, Zea mays
  unsure at all n locations
  Clone ID: LIB3076-049-Q1-K1-D12
ccgtgctcttggaaagctgangagggaggccgagcgcgccaggagaggccctcagcaaccaggcaccaggtccgtgttgagatcgagtccctctttgacgggaccgatttctcggagccgctgacccgtgccaggtttgaggagctgaacaacgacctcttccgcaagaccatgggccctgtcaagaaggccatggaggatgctggccttgagaagagccagatccacgagatcgtcctggttggtggaagcaccaggattcccaaggtccagcagctcctgcgggactacttcgacggcaaggagcccaacaagggtgtcaaccctgatgaggct

SEQ ID NO: 67306 - DNA, 371 bp, Zea mays
  Clone ID: LIB3076-049-Q1-K1-E11
gcgtaaagaatatgaacgtgttatggctggcattcctccttttatgctagatatgtctcgctggggtttgtaggccacctgaatgaacaagaggaatgatgttggcgcttggaagcaagctctacggaatgctcagagccagttgcagcatcaaattataaggatagagaatctcgagcttatgctgaaatatggcgtacatgtttggaagctccagaacagacaaatggaatcagttctgtctaggatgcaaaagatggctgtagaatacaatgaaaggatagaaaatgtcaatcgagagaggaagttccaccagcaaaatactcgaagacaacttcatgccctgaaaattgaatggccagaactgtgtc

SEQ ID NO: 67307 - DNA, 420 bp, Zea mays
  unsure at all n locations
  Clone ID: LIB3076-049-Q1-K1-E12
gcgcggacgcgtgngacaagttgagctggagggttcaacttcactggtgccggaggagttgccttatcagtgtacatcactgacgagtgcatccatgcctttgctgacgcttctatggccactgcttatgaaaagaaatggccattgtatcttagcaccaaaaacactattttgaagaaatatgatggcaggttcaaggacattttccaggaggtgtatgaagctggttggaaaaccaaatttgaagctgccggcatatggtatgagcaccgccttatcgatgacatggtagcatacgcacttaagagtgaaggagggtatgtctgggcttgcaagaattatgatggagatgtgcacagcgacttcttagctcaaggtttggctcattgggtttgatgacttcggtaactgtgtgccctg

SEQ ID NO: 67308 - DNA, 356 bp, Zea mays
  Clone ID: LIB3076-049-Q1-K1-F10
gctcgcatttcctcccaatccatcccgccttcaaacccgaactccaagtcgccccgcatcgatggcgccgaaggccgagaagaagcccgcggcgaagaagccggcggaggaggagcccgctgccgagaaggcgccggccgggaagaagcccaaggcggagaagcgtgtcccagcaggcaagtccgccggcaaggagggcggcgagggaaagaggggccggaagaagggcaagaagagcgtggagacctacaagatctacatcttcaaggtgctgaagcaggtgcacccggacatcggcatctcctctaaggccatgtccatcatgaactccttcatcaacgacatcttcgagaagc

SEQ ID NO: 67309 - DNA, 250 bp, Zea mays
  unsure at all n locations
  Clone ID: LIB3076-048-Q1-E1-H5
cgcagacgcgagggtcaagattcgtgctcacatcatccgcgacgggctcaaggctgaccccaagaagttacgcangatgaaggagaggcttgtcggcgtctctgangagacaccacgggtgtcaagaggctctaccanatgcangagaccggcgccctcctcttccctgccattaacgtcaacgattccgtcaccaagagcaagtttgacaacctgtatggttgccgccactcgctccctgatggtctga

SEQ ID NO: 67310 - DNA, 351 bp, Zea mays
  unsure at all n locations
  Clone ID: LIB3076-049-Q1-K1-F11
cgccgattccgcccgcacgtccttggtgctaccggaagggcctccgggcctccaggcctgcctcgcggggctaatcctccgcctccccttcgggatccaggaccaggacgcctctccggctcccggcacacgcctactcgctcccttcgcccgccgcattntcctcgccttcaatgctcccgtgcggctcctncccaaacgcaggtgcgcggtctacgggaaccccatccgcatgtccatcctcaagtgcagagcatccaagactgaggccctggcgcgcttcttcccgagagcggngttattgggcgaacacgaggcccaggtcgtgctcgtgcttgggggagccggagg

SEQ ID NO: 67311 - DNA, 133 bp, Zea mays
  Clone ID: LIB3076-049-Q1-K1-F12
tcgtccacgcgttcgccgacccctggggttaacgacaggcaatttaagggatctggtttcattggaacaatgggattccctgaacaagagttacatgtccagcattaaagtggttatccaggttaactaaaag

SEQ ID NO: 67312 - DNA, 422 bp, Zea mays
  unsure at all n locations
  Clone ID: LIB3076-048-Q1-E1-E1
cacgcgtccgcgacctcttacagggcgatatgttccaccagaagtggctgcagtccgtgtacctcttctccacctttcaaacttccaaataaatgattggcctgagctttcggcaaaaagctttgcaatcatggttttgatgcttccatctgatagtgcaagaaaatggcatgtacatgaattggagctggttgaggttgttgctgatcaggtagcacttgcactatctcatgcggctattcttgaagagtccatgcgagcacgtgatttactaatggagcagaatgttgccctggatttatctcgaagagaggctgagatggctatccgtgctcgcaatgattttctagctgttatgaatcacganatgagaacacccatgaatgcaataatagccctttcctccttgcttttggtaactg

SEQ ID NO: 67313 - DNA, 402 bp, Zea mays
  Clone ID: LIB3076-048-Q1-E1-E10
gtcttcagggatcacaaggtccgagcctacttcaacgacaggatcttcttcgagacgatctcgcagtccgcgaatctggaggccatcaagatgaagctgtgggagcagatcagcggcaacatggtgctgggtacatacaaccagatcccagaatggcagctcaggctaggaccaagggaccgaggacccgtccttgtgatcctcgacgatgtttggtctctcccgcagcttgaggagctcatcttcaagttccctgggtgcaagaccctagtcgtatcaaggttcaagttccccacgctggtgaaacagacgtatgagatgcagctgctagacgaggcggcagctctgtccgtcttctgccgcgctgcgttcgaccaggagtgtgttccgcagaccgccgac

SEQ ID NO: 67314 - DNA, 374 bp, Zea mays
  Clone ID: LIB3076-048-Q1-E1-E11
atcttcagggatcacaaggtccgagcctacttcaacgacaggatcttcttcgagacgatctcgcagtccgcgaatctggaggccatcaacatgaatctgtgggagcagatcgggggcaacatggtgctgggtacatacaaccagatcccagaatggcagctcaggctaggaccaagggaccgaggacccgtccttgtgatcctcgacgatgtttggtctctcccgcagcttgaggagctcatcttcaagttccctgggtgcaagaccccagtcctatcaaggttcaagttccccacgccggtgaaacacacgtatgacatgcacctgctagacgagggggcagctctgtccgtcttcagccggcctgcgttcga

SEQ ID NO: 67315 - DNA, 118 bp, Zea mays
  Clone ID: LIB3076-048-Q1-E1-E12
ccactcaggctgccggaggatcgcgggtacagccgtgcaactgggcgtgaggccgcggtcggctgggtttcacgcgccgcggcgcggctaggcttctccgcgctcaccgccgcgctcg

SEQ ID NO: 67316 - DNA, 438 bp, Zea mays
  Clone ID: LIB3076-048-Q1-E1-E5
accaagcgttcggtcccctctcaagggcgccggcgcaactgaagaagcaaccgaagtggagcggctttaccaactccgcgaacgcctctcctccgccaatgacaaatccgaacatgcgggggactaagaagggaatattgcaaccgtgaaaggacaaattccaaagcgaagcagctcgcagcgcagcttatccccaggttcttccggagcttccctgcactcggcacgcgcgccatgtcagccatgttcgatctcgtcgatatggaggagctcgcgatcagaatacaagctattcgtggctttccacttcttggcaaagatactgaatttgtgtcaaaaattgcagatgttttgggtcagctccttacaagcgaagaaaatgttgagcgtgatgctgttcataaagcgctcatgtcccttatacggcaagatgttaaa

SEQ ID NO: 67317 - DNA, 260 bp, Zea mays
  Clone ID: LIB3076-048-Q1-E1-E6
gtccgactggcggaggatggcgggtacggcggcgcaactgggcgtgaggccgcggtcggctgggtttcacgcgccgcggcgcggctaggcttctccgcgctcaccgccgcgctcgccgccgcctacctcgaccgctgcttcctccccgggggcgcgctccggctcggcgaccagccctggatggcgcgcctagccgccgtcacctgcttcgcgctcgccgccaaggtcgaggagacgcgcgtgccgccgctcctcgacct

SEQ ID NO: 67318 - DNA, 217 bp, Zea mays
  unsure at all n locations
  Clone ID: LIB3076-048-Q1-E1-F10
tacccanttctcttcacaggtccacttccttggagttcaactcaagcaatacaatacgtcaaagggcccaaattactcttgacaagacctttactaccacgtcagctgtcagcaggtccaatataaccaacattgacaaagaccctctattcagtacaaacaagcacaacaatacggttgcaattttcagacatcctcactcaccactcaaggatcc

SEQ ID NO: 67319 - DNA, 203 bp, Zea mays
  Clone ID: LIB3076-048-Q1-E1-F11
cttcacaggtccacttccttgcagttgaactcaagcaatataataagtcaacgggccgaaattactcttgagaggaccttcactaccacgtgagcgggcagcaggtcaaatacaatcaatattgacaacgaccctgcaatcactagaaacaagcacaacaatagggttgcaattttcacatatcctcaatcacagcccaacga

SEQ ID NO: 67320 - DNA, 152 bp, Zea mays
  unsure at all n locations
  Clone ID: LIB3076-048-Q1-E1-F2
accgagccttcggccaagcgatcggcaacaacttttaacggcggctccctttccctccggtaatggtcctcctcaacccaatcccccccaagaacngccgccgccgccgccaagtccttacccacaaccgcgagcgggggcggcaacccccg

SEQ ID NO: 67321 - DNA, 238 bp, Zea mays
  unsure at all n locations
  Clone ID: LIB3076-048-Q1-E1-F5
ctaccacttcagctagcagcaggtcaaatanaagcaagattgacaaggagcctgcagtcagtagaaacaagcagaacaatagggttgcaattttcagagatcgtgagtcagagcgcaaggatcctgattatgacagaagctatgacaggtatatgcaaagatttgatcctggatttggatttagtggcggcccatacacaattcaacccctctatacccctgctgttaactacaacac

SEQ ID NO: 67322 - DNA, 383 bp, Zea mays
  unsure at all n locations
  Clone ID: LIB3076-048-Q1-E1-F7
cccacgcgtccgcccacgcgtccgcggacgcgtggggtgggtcaagtccgagtggaagaaggatgagaacatggctggtgaatggaaccacacttcgggaaaatggaatggagatgccgaggacaaaggtattcaaacctccgaggattacaggttctatgccatttcagccgaataccctgagttcagcaacaaggataagaccctggtgctgcagttctctgtgaagcacgagcagaagcttgactgcggtggtggctacgtcaagttgctgggtggtgatgtanaccaaaagaaatttggtggagacacatcttacagcattatgtttggaccagatatctgtgggtacagcaccaagaaggttcacactatccctgaca

SEQ ID NO: 67323 - DNA, 394 bp, Zea mays
  Clone ID: LIB3076-048-Q1-E1-G1
ccacgcgtccgcagacgcgtggggttctagatcgcgagcgggcccctttttttttttttttttccaaaactagctcatattaatataattttgagacagaattcccgtccgaattctatcactgctatcacaattgattccttctctccaaaggggaaaaacggaatatatataaatacatcctttgttctgctgtaatagatactacaagtggagtcatatgcaatacaaatgcacgatttttccatgagcagagtagtacaatcgcatattaccatggcatgccatgatcaatcgtgcatcacaatcaagccatagcataaaaatgtactccgtcccggtttccttcacttgaacatggagatgtcaaacacacgggcggagccatctgatg

SEQ ID NO: 67324 - DNA, 365 bp, Zea mays
  Clone ID: LIB3076-048-Q1-E1-G10
agaaattatcagcaacggattagagagctggaaagtgaattaggcaatgagaaaagggtttctagggattctgctagatcctcaaggccgccacttgttcctacgagacagaagcagcctcacggaaggaacgcgccaccttcaggcccttctagatggaggctcaaagcccccacaatccacaacaaagagaacattcctgtgacgatgagcaaatcaaatcctggggatgacactaataaggctgttggcagagcaaggcgcgtttcacttactccggtgattcgacaaatccccatccagcccaagaggcggtcttcgatagcaatactaccatctgtgagagagcatctttctgtgctaaa

SEQ ID NO: 67325 - DNA, 327 bp, Zea mays
  unsure at all n locations
  Clone ID: LIB3076-048-Q1-E1-G5
atcaaggtcaccaccgtcccacacgcatccgctctccgcttcccgctccgatcgaactgctccctccccaacaccgagcccaatgggggacaactcaacgacaacagattgcccaattcaaagaggccttcagcctcttcgacaaagaacgggatggttgcatcacgaccaangagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaagacaccgactctg

SEQ ID NO: 67326 - DNA, 374 bp, Zea mays
  unsure at all n locations
  Clone ID: LIB3076-048-Q1-E1-G6
ccacccgagcccgtccgcatggctgattgcttttggtttagcctttttctgacanggaactggtctgggtactactcgccaaaggaccatatatcataattggaaatgagcaaggcaagctgtanggaagatcactgcacaattatttttatattatcgttcctataaggttttgagaatctgtggttaagttgtattgtaaagctagttagtagcaaaattgtttataaggctatttgagctcttatatcttcatacacatttaatttttcgcagcttgtgaacattgggaagcccaattaaatatttgaatctgcatagagtattgggaatagtcaatagtggtgaacttttgaatgattcagttttgagac

SEQ ID NO: 67327 - DNA, 275 bp, Zea mays
  unsure at all n locations
  Clone ID: LIB3076-048-Q1-E1-G7
cggacgcgtggggttccagcgaacgcacacagccgccgctgtttcttcatcttcctcgcagcgccggcgctgaggctcgggctctcancgacggcggcancngcancggcttcgcctcccgcctctctccattctcctcgcgccctcgcctccggtcctccgcacaccggtcggttaccctgcgataatggctcatcgtggacatctattatggactgaatggtcaacctcctgctcttatacgccattgggtctttcgctgcaatgagcctctc

SEQ ID NO: 67328 - DNA, 289 bp, Zea mays
  Clone ID: LIB3076-048-Q1-E1-H1
agagcccggcgccggcgacgagcaagagcacgtggctgtcgccagagcgctcgcggcgctgaagccgcgagacggcggcgacggaaaggcggcgccgcctctgcagaagcacagcagcaacgggtcttcttcctccgctcttccgagaccgtcgctgtacagacaccaatggcggcctcggaccagtacccctgcccagcccctgccgccgaggacgggggccctgcccctgcagccgccggccggcccaaggatcctgcccccactgcatctgctacaacagccggcg

SEQ ID NO: 67329 - DNA, 252 bp, Zea mays
  Clone ID: LIB3076-048-Q1-E1-H10
ccacacatccgaacacacgtctggcttggtgaaaacgggacaaggaaaactaccttcattacaatgctggctgggttgttgaagccagacacagtggaatgaactgatattaaaattcgtgaggggaggtgtcctacaaaccccaaaagattagcccgaaattcaacaataccattaggcatttgctacaccacaaaattccggattcctatatgcaccctcagtttgtgtctcatctcatgaagccactgc

SEQ ID NO: 67330 - DNA, 357 bp, Zea mays
  Clone ID: LIB3076-048-Q1-E1-D8
accacgcgtccggccatatgcgcaacggtgggtccctcttggatggccagatctcagcagctgtaccagttgtggacttctctgcccgacatcaacccaacgatcacgcagtggatcaccgggtgtcattcgagttgaccgtccaatatgtcgcgcgctgccttgagaagaacactgcaatctccggggattctggcaaggcatcattccaccttgcaccgaacggcagcggcgaccaccacagagaatccaacgaggcaaaggcagggctctacgtcgacgaatcataccatgacttgcccgagaaagcgacgcggtccctgtccctgcgcctgagcaaagagttcattttcaaca

SEQ ID NO: 67331 - DNA, 97 bp, Zea mays
  Clone ID: LIB3076-048-Q1-E1-H12
atcctcttctcccacatcactgtccactaaccctacccacaacctcggatcgttttatccccccggcgaactctaattcccccaaacactacctacc

SEQ ID NO: 67332 - DNA, 405 bp, Zea mays
  Clone ID: LIB3076-048-Q1-E1-H3
tccgcaacaaagatacattataaaagtgcgaagatatggcaagctgtcatgggcgacctgcttgccaaagggatggacaaagctgaaaatgctccaatttcaagctgttctgctggtggtttaacctccaaactacactgtgacaaatttcatgaccttctgccgccggctgcgaaggttaagtgcctttctgatgctgggttcttcattaatgaaaaaaacgttgcaggagttgggtacattgctgcctttttcaacgacgtcgttacaacacatgtacacatttttacttcacactttgtggtactaataatagatgaatatcatgtggggggtaattgcaacacatccagtacaagacaacgagaggattcctacgcctcagttcagctgattaaatgaaac

SEQ ID NO: 67333 - DNA, 120 bp, Zea mays
  Clone ID: LIB3076-048-Q1-E1-B11
cacccacgagtccgcagacgcgtgggtcgcccacacgtccggttctagatcgcgagcggcctttctttaaaaaaaaaaaagtaacaaaaaacaaaaaaaaacacctaaaaaggcatcacc

SEQ ID NO: 67334 - DNA, 183 bp, Zea mays
  unsure at all n locations
  Clone ID: LIB3076-048-Q1-E1-B5
gtctccagttccccgtcggccgcatcgggcgctacttgaagaanggccgctacgcgcagcgtgtcggcaccggcgcccccgtctacctcgccgctgtcctcgaatacctcgccgctgaggttctggagctcgccggtaatgctgccacggacaacaagaagactcgcattattccgcgccacg

SEQ ID NO: 67335 - DNA, 355 bp, Zea mays
  Clone ID: LIB3076-048-Q1-E1-B9
aggacgcgtgggtggggagcaccggcgacacgacgacggccgaggcggaggcgccggcgccggtgggtgactacgagctgctggagcgcctgggggggcgtcccccgtacacgtccgtgtggcgagcggtctcccggtccaccggcgcgcccgtggctgtgaagcaggtgcggctcaccggcgtccccgcgcgcctccgcgacagcctcgactgcgaggtccgcttcctcgccgccgtcagccaccccaacatcatccgcctcatcgacgtcgtccagacccagagctgcctttacctcgtcctggagctctgcgagggcggggacctggcggccttcatccggcgcaatgggag

SEQ ID NO: 67336 - DNA, 356 bp, Zea mays
  Clone ID: LIB3076-048-Q1-E1-C10
atttcaaggctcacttggccagctgtgcaccgaagaattgagtcatgtgggttacctgcggaatgcaatcctgtggaaactgagtaggtgatgtagtttcctggccataagtatgagccccagttgacattgaatctgtcctctgatgctcctagagctgtacccttgaggggcttgtgcttttgtgagcttgtgttaaacctgctgtacgagtaaactagtatgtccgcaaacgcgtcagagccggatgtctgtgggccagctattgggatactgccggatatcgtcaacaattgttccagattggtgtattggatcaaatgagattgtcagcaattgcttgtttttatggcttc

SEQ ID NO: 67337 - DNA, 197 bp, Zea mays
  Clone ID: LIB3076-048-Q1-E1-C11
ctcacttggccatctgtgcaccgaacaattgagtcatgtgggttacctgcggaatacaatcctgtggaaactgaatacgtgatgtattttcctgcccagggagtaggggcgggagttgacattcaatctttcctctgatgatcctacaactgtaaccttgcagggcttattcttttgttaacctgtgttaaaccctc

SEQ ID NO: 67338 - DNA, 402 bp, Zea mays
  Clone ID: LIB3076-048-Q1-E1-C12
accacgcgtccggcagaacatgacgtccctgctcgtgtccttcgtggtgggcttcatcattgaatggcgggtcgccctcctcatcctcgtcaccttccctctcctcgtgctcgccaactttgcccagcaactgtcgatgaagggcttcgcgggcgacacggccaaggcccacgccaagacgagcatgatcgccggggagggcgtgagcaacatccggacggtggcggcgttcaacgcgcaggacaagatcctgtccctcttctgcagcgagctgcgcgtgccgcagatgcacagcctgcgccgcagccagatctccggcgcgctcttcgggctctcccagctctccctgtacgcgtccgaggcgctcatcctgtggttcggcgcgcacctggtccgcaccca

SEQ ID NO: 67339 - DNA, 400 bp, Zea mays
  Clone ID: LIB3076-048-Q1-E1-C4
gtccgcacacgcgtccgcagctctcggcttctctctctcatcggcacacccgagctcgcgccctccttccacgtcgaggtccgagtcctgctttgatggcgaccgacgtgactgaaactcccgcgccgttggtggatgcggccccaaaggcgcccgccgacgccccggcggcgcctgctgccgacgcgaagccggccaaggccaagaaggccaccgcgccgaagaagcgcgccagcccgacccacccgccgtacgccgagatggtctcggaggcgatcacgtcgctcaaggagaggacggggtccagcagctacgcgattgccaagttcgtggaggacaagcacaaggccaagctcccgcccaacttccgcaagcttctgaacgttcagctcaagaagct

SEQ ID NO: 67340 - DNA, 415 bp, Zea mays
  unsure at all n locations
  Clone ID: LIB3076-048-Q1-E1-C6
cacacgcatccgcccacgcgtccggaggcccangcgcaggccgtggcaaaggctgccagcgtcgccgccctcgagcagttcaagatatccgccgaccggtacatgaaggaaaggagtaccatagctgtgataggcctcagtgtacacacagcaccagtggagatgcgtgaaaaacttgctgttgcagaggaactgtggccccgtgctattcaagaactcactagcctgaaccatattgaagaggctgctgttcttagtacctgtaatagaatggaaatttatgtggtggcgctatcatggaaccgtggtatcagagaagtagtggactggatgtcgaagaaaagtggtattcccgcttccgagcttanggagcacctgttcatcttgcgaagcagtgatgcacacgccatctgtt

SEQ ID NO: 67341 - DNA, 285 bp, Zea mays
  unsure at all n locations
  Clone ID: LIB3076-048-Q1-E1-C8
cctccctcatgtacgancccataatccctacatcgactaacggttataatatctcttgcagattctggtactgaacaacttcacttcatagctctttcagagaggaggggggatcccaattaccaacataacgtctaaaaacatcattaaacagcctcaataaatatatcccagtgatagtttacttcttatttacataaatcctcattcctgggacagcatcatactcatctatcacattttgtgctatgtcacacagcttctaccaaaatttactcaacgtct

SEQ ID NO: 67342 - DNA, 354 bp, Zea mays
  Clone ID: LIB3076-048-Q1-E1-C9
cgcgtgggcatattcactcctctgccctctcagatcccgaactaccaaacccccttctcgccggcggaggaaggcgggggcggagaaaagagatcaccatcgctaatcggtgacggcagcggtcgggatggcggcggcgctaactccgggggtgtcccggaagttgaagaatgtgctggagacgcgtacggataacccggatctgctggcctcgctgggcgcgctctccactttctacgtccagaacaccccgcaggcgcgccgcaatctcaaatcctccattgagcagcgtgcacttgccatcaatcgccacttcttcgaaccctcgctccccgcccacaaagcgctggatcg

SEQ ID NO: 67343 - DNA, 366 bp, Zea mays
  unsure at all n locations
  Clone ID: LIB3076-048-Q1-E1-D1
cacacgcgtccgcacatctcctcgcatttcttcncatccgatccccccttcgcaaccaaaaccccaactcgccccgcatcgatggcgcccaaggccgagaagaaacccgcggcgaanaagccggcggaggaggagcccgcggccgagaaggcgcccgccgggaagaagccgaaggcggagaagcgggtccccgctggcaagtccgctgccaaggaaggcggcganggcaanangggcaanaagaagggcaagaagagcgtggagacctacaagatctacatcttcaaggtgctgaagcangtgcacccggacattggcatctcctccaaggccatgtccatcatgaactccttcattaacgatatc

SEQ ID NO: 67344 - DNA, 407 bp, Zea mays
  unsure at all n locations
  Clone ID: LIB3076-048-Q1-E1-D12
catatttcttcgaagtccactcagtactcacctcaaggaagtgaaagtagtaatctacaagttggtcaaggcaacttgaaacttcaatataatgaagctggaaaattatccctgtactccgatagtaagactatggttcaagcaaactttgagcagaaatacaagtattatattggacaggatggaaatggaagtgatcctcaggcttctggagcatacatattccgccctaatggcacagttccaatcagtactgatgggcaggtttctctcacagttctgcgtgggcccatattggatgaagtgcnacagcagataaattcatggatttatcagattaccagggtttacaaggagaaggactttttggaaactgaatttatagttgggcccaatacagtagatga

SEQ ID NO: 67345 - DNA, 321 bp, Zea mays
  Clone ID: LIB3076-048-Q1-E1-D2
agccctgaacttctgctgaatccggtactgatatgccgcaacgaagcagaaaaatgcttgatagagacttcaatcaactccatacgtataaacatgaaggttaagcaggcagatgaattggagaacattcttgccaagaagttccttaagtttttgtcaatgagggcagaggcattccaagtgttgaggagaaaaccggttcaagtttccaacttaacattgattaccttgagcagtgttttatgtctccaataggtcctagtaaacatgaactacctgtaaggcacagggatacatcgttgtggacaactggatgatgga

SEQ ID NO: 67346 - DNA, 366 bp, Zea mays
  unsure at all n locations
  Clone ID: LIB3076-048-Q1-E1-D4
gagcctgaacccaagtgcagtgcagcagccatgggagcagcagcaggtggccacgcgctgcgcgccgtcggcgacgtcgtctcgttccccgcgaccgtcgccgccttcgtggaggcgctgctccagggctgggccgaggccanggccgggctgctggtgccgctgctccgcgccgcggtgctgctgtgcacggccatgtcgctgatcgtgctggccgagaaggtgttcctgggcgcggtcagctccgtggcgaagctgcggcgccggcggccggggcgggtgtacaggtgcgaccccgacgaagaggcggatgcggcctcctgngcctatcccatggtgctcgtccagatccccatgtacaacgag

SEQ ID NO: 67347 - DNA, 366 bp, Zea mays
  unsure at all n locations
  Clone ID: LIB3076-048-Q1-E1-D6
ggtcgaccacgcgtccgacacgcgtccgcggacgcgtggggcccgccgtagcccagcaacaccacccggcaaacgccgcgcaacgcaccacactgggctcctcgacagtcgaaactcgagagcccaatcgttaccgacccgattcggaaggagggttgttgcctcaccccctctggttccggcgcccatggcggtggcggtacctggccagctcaacctanacgaggccccggcatggggctcccgcagcgtcgactgcttcgagaagctcgagcagatcggcgagggcacttaccggcaagtgtacatggcgaaggagacgggcaccaacgagatcgtctcgctcaagaagatccgcatggacaa

SEQ ID NO: 67348 - DNA, 453 bp, Zea mays
  unsure at all n locations
  Clone ID: LIB3076-048-Q1-E1-B10
cccacgagtccgaggacgcgtgggtggggagcaccggcgacacgacgacggccgaggcggaggcgccggcgccggtgggtgactacgagctgctggagcgcctgggggggcgtcccccgtggacgtgggtgtggcgancggtctcccggtccaccggcgcgcccgtggctgtgaagcaggtgcggctcaccggcgtccccgcgcgcctccgcgacagcctcgactgcgaggtccgcttcctcgccgccgtcagccaccccaacatcatccgcctcatcgacgtcgtccagacccacagctgcctttacctcgtcctggagctctgccagggcggggacctggcggccttcatccggcccaatgggagccttaactagcgcctggccagaaattttatgaaacagatgggagctggcttacaagtgctgcaccggcagcatgtcctccaccggg

SEQ ID NO: 67349 - DNA, 348 bp, Zea mays
  Clone ID: LIB3076-048-Q1-E1-D7
gtgtaagaagccatggccggtgtgcccccggtggttctctcgtcggtcgcggcaatgcatgccgcctagctcgttggcagcagcgccgggcggcccccgggccggcctggtccggggtacaggggcagtaagaaacttttgcagaacaagagagagaccctgatagtttttgctctcgttcagtcgttctctcctcttctctctctcacacacagaaacacacgcagaatggcaggagagagagagagagagagatagaaagggatgtatgaaagatctagcaagaagtattcttcgttacatgtatacaagacatggcaaatgaagcatcggtgatggcaaatcatg

SEQ ID NO: 67350 - DNA, 271 bp, Zea mays
  Clone ID: LIB3076-047-Q1-K1-G10
caaatatcaattcttcacacaatttaaatcacctaataccatcgcgacttttacgaatccctttaacattacaaacgcacctaacaaccaagcagcaacccaaatatccaataacttccacattatctcactttttaacccactgatcaacttacactatccacatataacacactatctaataacaaaaactctacccaacttcactactaatcattctaaacttgttaattacataacatactacatcactatcaactaatacacattc

SEQ ID NO: 67351 - DNA, 368 bp, Zea mays
  Clone ID: LIB3076-047-Q1-K1-G2
gcaagctcgccacaccctggacgcctgcttcttgtctgctcggcgcccctgcgcttgctggcttggatggcccttgccatggccgtacgctgccgagctccaagctccaactcggatctttctccctcgtcttccttcccacgagctcgcaccagcctctgcttcctgctcgccatggcgcttggcatccagctttctgcgcaccggctccttgctccagctcccacgcgcgtccgagctcgccccggctccagcttctcccaaggtcggcgatactccagtcctctgcgcagcgcgcacgcttagcttgcctctcttgcgcgcagtcctttgttcctgcgtgccacaatcctccagcttggttgccg

SEQ ID NO: 67352 - DNA, 429 bp, Zea mays
  Clone ID: LIB3076-047-Q1-K1-G3
gggggaagaacaccaaccaagcaggacttggtttttgggaactccatgggctgtggaattgtccccagggagtcccctctgggtttgacgagattcatacagatacatatatttaattttttcccctttcgtttgctcaaaaaatcaattgtacaggcgaaactgcttgtttgtgctttgtttcttccgtgtttgtttccttgggattttcctctggtccgttcttcttcacctgtggggtgggaggagcagagacaatcatgggaaagcaaggaccctgccgtcattgcggagtcacaagtactccgctgtggcggaatgggccaccagataagccggtgctctgcaatgcgtgtggctcgaggtggagaacgaagggttcaatggcaaactacactccaatgcatcgcaatgacaatattgatgatg

SEQ ID NO: 67353 - DNA, 390 bp, Zea mays
  unsure at all n locations
  Clone ID: LIB3076-047-Q1-K1-G4
acttcaacgaaactgccaattttgattgttcacagctccaactgttggtgcttgacgaggcagatcaaattcttgatcacggattcagaaaccaggttgatgctatcatttctcagattcccaaagttagacaaactttactgttttctgctacacaaacgaagtcagttaaggaccttgcaagggttagcttaagggatcctgaatatataagtgtgcacgaggaggccagaacagccacaccggatacccttgagcagtatgccatgattgtacctcttgagcagaagttaaatatgctctggagcttcattaanaggcatctaaattcaaagacgatagtcttcttatctagtgtcaagcaggtcaaatttgttaatgaaattttaa

SEQ ID NO: 67354 - DNA, 410 bp, Zea mays
  Clone ID: LIB3076-047-Q1-K1-G5
ggactctctcctgatctagcacacttggatgagataaagaacttgcagcgtccaactgatgtaccagatcaaggtctactgtgtgacttgctttggtcagatccaggaaaagatgctcaagggtggggcatgaatgatagaggggtctcatatacctttggtgctgacaaggtttcagaattcttgcaaaagcatgatcttgatcttatctgtcgtgctcaccaggttgtcgaggatgggtatgaattttttgctgacagacagcttgtcaccatattctcggcccccaattattgtggtgaatttgataatgctggtgcaatgatgagtgtccatgaaactttgaagtgctcatcccaaattctgaaacctgctgagagaaaaacaaatttatggggtccaacaaaatg

SEQ ID NO: 67355 - DNA, 356 bp, Zea mays
  Clone ID: LIB3076-047-Q1-K1-G6
aaaccctatacagaactctcacactcgatttagatatatcacttacgggggaaaacttgcgtactttatcacactcaacggtctgactatacattaatgatatccagactcacattcaaagaatgcaataattagaaattgactggtttgttaaaccatttatatccctacactataatgacataacgcaaactataatttagatcatgctggacagatctcactatctagcaatcgacactaatgaacttcttatcatacgacatctggacatacgattacacgatatccttctattaatattcaaatgatgactcatctttcattcaaaatttacattgatactttgaatttac

SEQ ID NO: 67356 - DNA, 273 bp, Zea mays
  Clone ID: LIB3076-047-Q1-K1-G7
aaactctagagagctcgcttacacttgagctggacatatcatttacgagggaatactggggcactttatgaggctcaaccatcataacttcatcaatgaaatccagactcacgattcaaagaatgcaatacgttacaattgcctcgtttcttgaaccattgagctacctacactataatgacataacacatactatagcttagatcatgctggacagtgtcactatctagtaatcgacactaattaacttcatatctgacgacattggtacat

SEQ ID NO: 67357 - DNA, 141 bp, Zea mays
  Clone ID: LIB3076-047-Q1-K1-H11
gggttcctattgcactaaggcatatacagtcaatcatccgtatgtcatacgcacatgcaaggattcatctcatgagctacgtttatcatgaagatgttgacatgtccatccttgtcttgctcgactcttttatttcgactc

SEQ ID NO: 67358 - DNA, 371 bp, Zea mays
  Clone ID: LIB3076-047-Q1-K1-H2
ctcctcaagccatggtattgggcgagggtggcgccacctcgcatgcttgagttcgccgagcgcgccgctagggtgctcgagtgaagaggtgagggcaccgagctcgagctcgccatgaatctccacaacgctgctggcatccactgcggactcagccaccaagccctgacattgtagccagtttcctgcaattagaacgaatgccagttggtaaccatttaacatttcttttgctgtgtcaacttattggagttggagagaggctatcactatactaacctttatatcatcaggattgacataaatgtgatttacacgtagatacaagtttgtggcagagattgctctgacacaccaatcagtcttcgatg

SEQ ID NO: 67359 - DNA, 383 bp, Zea mays
  Clone ID: LIB3076-047-Q1-K1-H3
cggacgcgtgggccgccgtcatgtcgaagcgaggtaggggaggttcggctgggaacaaggtccgcatgtgactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatcccaagggtgagatgaaaggttctgcaatcactggacctatc

SEQ ID NO: 67360 - DNA, 287 bp, Zea mays
  Clone ID: LIB3076-047-Q1-K1-H4
acccacgcgtccgcccacgcgtccggctgcggtgagccactcaacaagtggttgcacaatccttatgttgagcgcatgcattgattgtaggcttgcacagttttgtggaagaatcagcttggaatgaaatataagctgtgcaccatatatagttctagttcgctctgatttagtcaggccaagtgtagtttggtagccggatagtctatgcttggaaactatttattgtgattgtgataacatttagagatggattttttcgtttagcttgagataaattttctctc

SEQ ID NO: 67361 - DNA, 396 bp, Zea mays
  unsure at all n locations
  Clone ID: LIB3076-047-Q1-K1-H5
cccaccgaccaccgggcaccggcctcctttcccgcaggcacgggtgcacggcacgcggtttccactcgcttcgtcccccttcggatcgccctcagagtaacagtctagcagagcaagcatgtcgtcgtcggcggagaacgaccccacggtgacggtgaccgagcgcggaggcaaggacaagcacgaggacggcggcgacaaggagcagggcggcggcggcttcatcgacaaggtgaaggacttcatccacgacatcggcgagaagatcgnagaggtcgtcgggttcggcaagcccacggccgacgtgtgcggcatccacatcccgcacatcagccttcaccgggccgacctcgtcgtggacgtgctcatcaagaacccgaacccggtcccgatccc

SEQ ID NO: 67362 - DNA, 384 bp, Zea mays
  Clone ID: LIB3076-047-Q1-K1-H6
cggacgcgtggggtttccctggtggtgttcccggtaatgttgatatgagtaaaatcctgaatgaccctgacctgatggcagcattcagtgacccagaggtcatggcggctttacaagatgtgatgaacaatcctgccaactttgctaagcaccaagcgaatcctaaggtgggccctatcatcgcaaagatgatggccaagttcaatgggtcccagtgatggttatgtcgcagtcaggttttgtgagcagcaagcaaaggtttgttggacagtgaacaggtgttcttttcgtgcatctggtctgggagtgtgtttagcttgtgatgaagaacatgagtgtgtgtgttggtcgtggtgcatctggaggtgcgatgagcatgtgatg

SEQ ID NO: 67363 - DNA, 417 bp, Zea mays
  Clone ID: LIB3076-047-Q1-K1-H7
cccacgcgtccgcccacgcgtccgcggacgcgtgggcgaaggcgtatgtggattcatgggacgaccggatgcgggagacctgtgcgctgctgaagcaggtgcgggagccgggcgctcggggctcttatctcaaggactcggagaagcaggagatgtaccggctgcacaaggaggaccccgcgacttacaccgtggagcggctcgccaaggacttccgtgtcatgcgacagcgcgtgcacgccatcctctggctcaaggagatggaagaggaagaggagaggaagaggggccagccgctcgacgactccatcgaaatcctgctcgacagctgcccagagttcttcaattctcatgacaggggaatttcatgtagcatctcttccatataaacctgacttcaaagtaatgcctgaggac

SEQ ID NO: 67364 - DNA, 422 bp, Zea mays
  Clone ID: LIB3076-048-Q1-E1-A12
acaaagtacattgctgaagctaggaaagggtctcgttttggacatgacacacttgttgatgccatgcttaaggatggactttgggatgtatacaatgactgtgccatgggaatgtgtgccgaactttgtgctgacaatcatgccctcacaagagaagaccaggatgcttttgctatccaaagcaaccagcgtggaattgctgctcgtgacagtggtgcttttgcatgggagattgttccgattgaagtttctgttgggagaggaaaaccacctgtacttattgagaaagatgaaagcctggataagtttgacccagcaaaactgaagaaacttcgcccaagtttcaaggagaatggtggtaccgttacagctggaaatgcttctagtataagtgatggggcggctgcattatttttggtgag

SEQ ID NO: 67365 - DNA, 345 bp, Zea mays
  unsure at all n locations
  Clone ID: LIB3076-048-Q1-E1-A5
ctcngtggtcttgttcactgtcagtgccatgtctccctgccctgcttgcttgtcatcggcaagtgacactacctagcctatagcaaggctacctttctcaggaggtgctgcagtgcaggttaccacaaaactagtgacgacgcggctagtttctacgttgtatatagttcttgctgcagaccgcgtttgtgtttacgaaagatttcacttttaagttttctgtgttaactataattgtatgatttgcgggctctggccggcccggaatactaaatgggcagtgctattcgggccagcccggcacgatctggcctccaccgtgccgtgctcgggttataatctggg

SEQ ID NO: 67366 - DNA, 394 bp, Zea mays
  Clone ID: LIB3076-048-Q1-E1-A6
catcacatctctgcaaccatgagtggtgttacctgctgcctgcggttcccaggccagctgaactcggacctccggaagcttgcggtcaaactgattcccttcccccgcctccatttcttcatggtcggcttcgcgccgctgacgtcaagggggtcccaacaataacgcgccctgaacgtcccggagctgaaccaacaaatgtgggacgcgaagaacatgatgtgcgccgctgaaccgcggcaacggcgctacctgacggcgtcggccatgttccgcgggaagatgagcaccaaagaggtggacgagcagatgctgaacgtgcagaacaagaactcgtcctacttcgtggagtggattccgaacaacgtgaagtcgagcgtgtgcgacatccccc

SEQ ID NO: 67367 - DNA, 358 bp, Zea mays
  Clone ID: LIB3076-047-Q1-K1-G1
gtcagatcagaccagcaacggatcgacctttgcttccgtgcagatggagcagatgctactgcagcaggtgttggaccaatttgttggacaagagatcgttgactggtgtgggagcgctgcaggagaaaacaaaggggggataatgtgtcatccagatggacccaaccaaagaaatagaatggaataaaattaaaggcgttgaacgagaaaaaaatgcatcaaattattgacatcaaaataaataccggttcgtcatggctgacacaactagtgaggaacctgccacaagtgaacagacaaagattgaagggctgatttttttgaaactagtgtgggtgtggaaaaacgttattatttt

SEQ ID NO: 67368 - DNA, 302 bp, Zea mays
  Clone ID: LIB3076-047-Q1-K1-C9
caactacccccattctcgtaaggttccttccataagctcatgagtctaatttccgtctccttccaattcttgctcgcctcgaatatcacctgagatcacataaacaatgctgaatgctgttactgagcttaatagcagcgatggtgtcaatgccaccatctttttcacccaagatgtacatgcccctaccgctgtcaccgtaagtgtctctgtcctcaagcctgtcctccatggatttcatgtacatgcacttgatgacaccaccaatggatgcatgtcaactggaccacactacaatcctt

SEQ ID NO: 67369 - DNA, 352 bp, Zea mays
  Clone ID: LIB3076-047-Q1-K1-D12
ctcttggaaagctgatgagggaagttctagcgcgcctagagagccctcatcatccggcaccatttcgttgttgagatcgagtcgctcgttgacgggaccgatttctcggagccgctgacccgtgccaggtttgaggagctgaacaacgacctcttccgcaagaccatggtccctgtcaagaaggccatggatgatgctggccttgagaagagccagatccacgagatcgtcctggttggtggaagcaccaggattcccaaggtccatcagctcctgcgggactacttcgacggcaaggagcccaacaagggtgtcaaccctgatgaggcttttgcctttggtgccgctttgc

SEQ ID NO: 67370 - DNA, 367 bp, Zea mays
  Clone ID: LIB3076-047-Q1-K1-D2
cctccacccaatcgaaggacctagcgagcggcagcggcggcggcgatcggagaagatggtgcgcaaggcgaaggttgagttcgacgagcagccgccggataacttcgacccgaagaacccgtatgccgacccggtggcgatgctcgagtaccgggaacacctggtgcgagagaagtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggag

SEQ ID NO: 67371 - DNA, 418 bp, Zea mays
  unsure at all n locations
  Clone ID: LIB3076-047-Q1-K1-D3
cgcacaacggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgcccgccgcaagaccgtcaccgccatggatgtcgtctacgcgctcaagcgccagggccgcacgctctacggcttcggcggctaggccgncttcccttctgatgctttgatgtgacggccgtggtcggttgtgtgtcta

SEQ ID NO: 67372 - DNA, 210 bp, Zea mays
  Clone ID: LIB3076-047-Q1-K1-D5
ccgtcctcttggaaagctcacgatcgatgtctagcgcgccaatagagcggtcatcatcgggcaccttatccgtgtagatatcgattccctatttgactggaccgatttctcgcatcctcttactcgtgccagctttgatgagcctaacaaccacctatttctcaagaccatgtaccctttcaagaaggtcatgaacgatgctgtccttga

SEQ ID NO: 67373 - DNA, 419 bp, Zea mays
  Clone ID: LIB3076-047-Q1-K1-D6
cggacgcgtgggcggacgcgtgggcggacgcgtggggccaatggtactgcagttcttagagtagtgcaggctttgagctctcttgtcaatactcttcaagagagaaaggatccagaacagcctgctgaaaaggaccattcggacgcagtttcccagatttctgaaattaacacagcattggattctctgtggttggagttgagcaactgcataagcaagatagaaagctcttcagagtatgcatcaaatctaagtcctgcttctgcaagtgcagctatgttaacaacaggagtagcacctccattgcctgcaggaactcaaaacttattaccatatatagaatcattttttgtgacatgtgagaagttgcgtcctgggcaacctgatgctgtacaagatgcttcaacttctgatatgga

SEQ ID NO: 67374 - DNA, 352 bp, Zea mays
  Clone ID: LIB3076-047-Q1-K1-D7
cacacggccatctcacagaccgacaacgccctatgcaagcagcaagcgcacacgtaaacgggacacctacctcggcgagcaaaagggaaaacgctgatcggagcagcgaagcccgcagccatgccgacggcgacggccacggccacggcagctcctcgccacgcggcgctcttactgcccctgctgctgctcctgctcggcctccacgccacgtccgccggcgccgcgcgcgcgggcgtcgccgtggacgccgagctcacgttcaccaagccgtacccggtcccgaagaagcccagcgtgaagccgtccgggcacggagccgcgagcccgacctttctggacttcggcatcc

SEQ ID NO: 67375 - DNA, 351 bp, Zea mays
  Clone ID: LIB3076-047-Q1-K1-D8
cacacgcctatcttacatactgacacctctctagccaagcatcatactggcattcttcgagcactttaccctttcagcaagattgtctatcctgatcaagacagcaataacccaaatcatgccgatgacaacgaccattgacacgcaaattcctagattcccgaaactcacactgcctttgattctgttcctgctcagcttacacactacgtacaccttctccaaacgctcttacattatccattacacctaactcatgtttattaaacagcacctttttcaacaacagccttatcacaatccattctatcacgaactcaaaacttattactatatatactattattatcc

SEQ ID NO: 67376 - DNA, 424 bp, Zea mays
  unsure at all n locations
  Clone ID: LIB3076-047-Q1-K1-E1
cccacgcgtccgccgacgcgtggggccaacctggccatggcgacatccccagcgctcctgttcccttctgcctcctcggcatcctctgcgccttcgtcggcgcgggtggaggcagtggtgccgaccagcaaaagcaacggagggagggctaaaacctttcgttttgaagcaagggatgagcgcgaaagccgttgcgcttncgtacacgcgcatactcttgctccgtcgcgcgttaggttaggttagtacttagtacttaacttagtacaataacgcgcagccgttttgggcggacacggttctctaaaggcgaagactctgaagtgggcgaacaactcgcccagcgggcgaacattgccgctccggcttcgcgcacctgctgacacctttcgaagcactttcacgtgtgaaccgaagtcgtctt

SEQ ID NO: 67377 - DNA, 419 bp, Zea mays
  Clone ID: LIB3076-047-Q1-K1-E10
ccgtgctcttggaaagctgaggagggaagtctagcgcgcctttagagccctcagcaaccggcaccatttcggtgttgagatcgagtccgtctttgacgggaccgatttctcggagccgctgacccgtgccaggtttgaggagctgaacaacgacctcttccgcaagaccatgggccctgtcaagaaggccatggaggatgctggccttgagaagagccagatccacgagatcgtcctggttggtggaagcaccaggattcccaaggtccagcagctcctgcgggactacttcgacggcaaggagcccaacaagggtgtcaaccctgatgaggctgttgcctttggtgccgctgtgcatggaagcatcttgagcggcgagggttgtgactagaccaagatatccttcttcttgatgtggc

SEQ ID NO: 67378 - DNA, 269 bp, Zea mays
  Clone ID: LIB3076-047-Q1-K1-E5
caaagactatgaaccagtttgagctggctttcctccacttatgctatagggtgactagctgtggtatttagccacctccagggaacaagaagaatgacgtttgctcttgcaggcatgctctacggaaagctcaaagccagctgcatcatcaaattataaggatagagaatctcgagcttatgctgaaatatgaccaacatgattggaagctccataacagacaaatggaatcaaatctgactatgattcaaaagaaggcttgtataata

SEQ ID NO: 67379 - DNA, 212 bp, Zea mays
  Clone ID: LIB3076-047-Q1-K1-E6
ctaacactatgaacgacttttagctggcttatctccacttatgctataggggtctttctgacttttggagccacctccagggaacaatattattgatgtttgctcttgcatccatgctctacgtaatgctcatatccagttgtatcattatatcatactgatacattatctagagcatattctataatatatcttaaatctttgtaaacttc

SEQ ID NO: 67380 - DNA, 437 bp, Zea mays
  Clone ID: LIB3076-047-Q1-K1-E7
gcctcaccaatctcggcgccagactgggaccgcgaggggactggtggtcgccggttccgcccgctactccggctgctttccctcctctctccgtcgccttccccttacgggctgcccatatttcattcagtgccaacaagtgccaagtgctcgtgtccggatgcgccagcgccgcctggtcaacagatttttgccctgcgctgtcactccaccacgctgcttgtactgaaagctttttcccagaataaaggctggggaggaggaagcggcggcggcggcgctcagaagagagggtgagatgaagactcggagctcagcgagaggggagccgaggcgtctcggaaatgcggctcttctggcgctcatgctctgctccgtcgtcgcgctctccctcatccgggggagattcgccccaattgtcactaccgcaggagatg

SEQ ID NO: 67381 - DNA, 180 bp, Zea mays
  Clone ID: LIB3076-047-Q1-K1-F11
ccccgtagggatccattaccattactcctctcctactccctccacactcctactcactcccttctcccacctcattttcctcaccttcaattctcccattcttctcctccccaaactcatgttctctctctactttaaccccatcctcatgtccatcctcaaattcacatcatccaatac

SEQ ID NO: 67382 - DNA, 271 bp, Zea mays
  Clone ID: LIB3076-047-Q1-K1-F12
tctgtttccattgcatcttttcgattctcttaacaatagggacatctcaatcattaatgtttttatctaattaaactaaattatatttctttatacactttaattcattcttcacaatttatcttctctatctcaatcatgcttttcaagaactataactgcatcaatcaatcacactataactcaatccactttaaattgcatatcttctacattaacaatgtctacatttcactttactttacaatattttctcatttattcactcctt

SEQ ID NO: 67383 - DNA, 304 bp, Zea mays
  Clone ID: LIB3076-047-Q1-K1-F5
cccacacttccgtcgacccttattgttatttccagccaatctaacgcatctgattccatggtagcagcgccaagccctgagcaagacttacatgtcaagcatgaaggcggtgatccaggttaactaaaagacatacttggttacactttccgtcacgttgtacaatttatcatctctcgcgcacgcatgctttgcaagcgcaataactccgacaaccatgcccacgacaacttgatccactgtaagttccatacctacatgattaacgagttctagctcttactcccctgcacaagcatttcgc

SEQ ID NO: 67384 - DNA, 286 bp, Zea mays
  Clone ID: LIB3076-047-Q1-K1-F6
ccggggcttccgctgatttttattgttatttccagccaatttaacgtggggcattccatgatagtatcgcaaagccctgagcaagacttacatgtccagcaccaaggcggctatccaggttaactaaaacactcacttggttacactgcccatcacactgaacaattcatcatctctcatgtacgcatgcttctcaacaacaataactccaacaagcagtcccacgacaacataatctacctgaactaccatatcttcatcattaacgtgttctatcagttactcc

SEQ ID NO: 67385 - DNA, 234 bp, Zea mays
  unsure at all n locations
  Clone ID: LIB3076-047-Q1-K1-F8
gaaaacccggctggacgcactcattcgncggcaccaacctcagatcctcactgcttttttacgcgtacttgcgacggcctatttcggctatttctacacctacgttggcttcactgtccgtcgccttcccattacgggcttcccatatctcattcagtaccaacaagtaccaactgctcgtatacggatgctccagcacctcctggacaacagattattgccctactctttcac

SEQ ID NO: 67386 - DNA, 416 bp, Zea mays
  Clone ID: LIB3076-047-Q1-K1-C8
cagacgcgtgaggtactgcagagccaccttagcagacaagagccagacgagactcagagggcgagcaccgtgacctgtctgattctctctcttccctactagtcttctgcaatcaagccacaacaaatgtgaccgtctctgtttctatcatccccttcatcactctgctggtctccctcattcacctctggtcttaggccatggccttcagcgcctaccggctcatcaagtgcgtcacagagggagacggcgccgtgttaaagacctgcatgctcatctgctacaccagcagcaagatccccactgattacataccaactgtcttccataactctagtgcaaacgtggtactcgacgataccacggtgaatcagggccttcgagatactgcagggcacgaagattacaacagactg

SEQ ID NO: 67387 - DNA, 402 bp, Zea mays
  unsure at all n locations
  Clone ID: LIB3076-047-Q1-K1-A6
cggacgcgtggggtccgcccggcgtaaagaaaaccctccctcaccacagccgccacgccatggccgaggagaccgacaccaggcctgcctccgcgggctcccgaggccgccccgcgcccgaggacgacgacagggaggagggcgagatcaccgacctcgcctgcgctccttccccgcccgccacgcacccgctcgagcactcctggaccttctggttcgacaacccgcagagcaagtccaagcaggccgcctgggggagctccatccgccccatacacaccttctgcaccgtcgaggaattctgggggctttacaataacattaatcaccctagcaaattgatcgtgggagctgatttccattgcttcaagaacangatcgagccanaatgggaagacccta

SEQ ID NO: 67388 - DNA, 368 bp, Zea mays
  Clone ID: LIB3076-047-Q1-K1-B1
gtcggatgtgagcgcgcgctcgtagttcgacgtgatccgtttggccatgtcctcggcggggaagccgagggacgaccagacgatgctgacggccggaatgtcgatgttcgggaagatgtcggtcggcgtgcgcaggagcgcgagcggtcccgcgatgaagatcagcagcgcgagcacgacgaacgtatagggcctgcgcaacgccagccggacgatccacatgatgttgttcctcgaagcagggcaagggcgccgcattcgatgcgacgagcgtgcagtctgacgtcgccgcgtagacccagccctgactggaagattacgaaactgctatctgcgtgccgcagcctcagatttcggaattgtcattc

SEQ ID NO: 67389 - DNA, 302 bp, Zea mays
  Clone ID: LIB3076-047-Q1-K1-B11
gccgccaactacccccattctcggaaggatccttccagaagcacaagaggctaaataccgtcaccttgccattcttcctcgacctcaacgtcgactgatatcacatagacaatggtgaaagctgtcgctctgcttattagcagcaatcgcttcaagatcaccatctttttcacccaacagggagatggccctactctctgtcaccggaaacgtctctggcctaaatcctggcctccataggctccatgtacatgcacttggtgacaccaccaatggaagcatgtcaactggaccacactaca

SEQ ID NO: 67390 - DNA, 245 bp, Zea mays
  Clone ID: LIB3076-047-Q1-K1-B2
ccgacaggacgcacgcatccgattgatgcttaatatgtattataaagtctttcctgttaactgccctgtggggttgtaaggatctcatttagttatggagaaagagaatattacttttacttatgaagttgaatttgtaaacagtgatatcatgttgccatcacggagtgatgcatacctgaagattgatgattctaagattcactgctttttcaatttatgaactctctgatggtaattctatt

SEQ ID NO: 67391 - DNA, 436 bp, Zea mays
  unsure at all n locations
  Clone ID: LIB3076-047-Q1-K1-B4
gaaccatctcatctctgcaaccatgagtggtgttacctgctgcctgcggttcccaggccagctgaactcggacctccggaagcttgcggtcaacctgatccccttcccccgcctccatttcttcatggtcggcttcgcgccgctgacgtcaagggggtcccagcagtaccgcgccctgaccgtcccggagctgacccagcagatgtgggacgcgaagaacatgatgtgcgcggctgacccgcggcacgggcgctacctgacggcgtcggccatgttccgcgggaagatgagcaccaaggaggtggacgagcagatgctgaacgtgcataacangaactcgtcctacttcgtggagtggatcccgaacaacgtgaagtcgagcgtgtgcgacattccccccacgggcctggcgatggcgtncacgttcgtcggcaac

SEQ ID NO: 67392 - DNA, 331 bp, Zea mays
  Clone ID: LIB3076-047-Q1-K1-B5
tagttctagatcgcttatcgaccgccttattttattatatatttatatttttgcaaaggaatttttcactgccaaacagtgcacaatcctaattttacatgccatggtatcctttttcgtacaaatctaaataaattggcaccaaaattatgtacttgcagtgtgtctatttaccattcactcacttactcacgccaataataaggatgcaatttttgagcataactcaactcatcatctacctacctaccttttgcatttcaccgtggctcgtgcgctacaacttgtctcttcatgttcatcttgccgccttatgaccctttcaccacct

SEQ ID NO: 67393 - DNA, 379 bp, Zea mays
  Clone ID: LIB3076-047-Q1-K1-B6
attgaagcttaatatgtatgataaagtcgatcctgtgaactgccctgtggagttggaaaaatctcaattggttagggagaaagagaagattacttttacttatgaggttgaatttgtaaacagtgatatcaggtggccatcacggtgggatgcatacctgaagatggagggttcgaagattcactggttttcaattatgaactctttgatggtaattctatttttggctggcattgtatttgtcatattcttgcgtacagtgaggagggacttgactcggtatgaggagttggataaggaggcccaagctcagatgaatgaggagctctctggttggaagcttggtgttggagatgtcttcagagaaccaaccttaccg

SEQ ID NO: 67394 - DNA, 377 bp, Zea mays
  unsure at all n locations
  Clone ID: LIB3076-047-Q1-K1-B8
gcccccaactacccccagcctcggaaggaaccttccagaagcgcaagactctaaaggccggcgccttcccattcttcctcgccgcgggggtcgcctgagatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagatgatgagaaccgncatgctggtgatcttggaaacgtgacaagctg

SEQ ID NO: 67395 - DNA, 317 bp, Zea mays
  Clone ID: LIB3076-047-Q1-K1-B9
ttaatcgtcatttcgtgaagtttgattcatcgattatcaaggttccttatcgagacttttaaatccctgcacgatctcaacttgtaacactttctactgttgaacggattattatgcgatctgtttatgatctgcattctcttcaacatgaacttaataaagtctatcctcataatgcctaatctatctatcaatttttactgaactttacatctcttggatcaagatattcttcattcacttttattcttgattatccttcatgaaacatctttatctaaaatccgcattctccgcttttatatcctatactatct

SEQ ID NO: 67396 - DNA, 319 bp, Zea mays
  Clone ID: LIB3076-047-Q1-K1-C11
aatacccgtcccgacgcactcattctcacactctttagttactttttaaccaccttatcagacaacatccatacgagactcttagactattaccaatacctgtcaaattctatatcatccctactactcttctacaacaatccacaacaaatctgacctactctgcttctctcatccccttcatcactcttcttatctccctattccatctctattctaggccatgaccatcaactcctaccgactcatcaagttcttcacagttttatacttcaccgtataaaataccatcattctcatattctacaccatcaacaat

SEQ ID NO: 67397 - DNA, 426 bp, Zea mays
  unsure at all n locations
  Clone ID: LIB3076-047-Q1-K1-C2
cgcacccacatctgccagaatcggacaaggaagagctctgccgggtgatggactgccagaagctgtcccgggaggcctgcacacacgcggcgcagaacgagcgcctcccgctccgcgtcatcctgcaggtcctcttcttcgagcagctccagctgcggagctccatcgcggaatgcctcatgatctcagagcccctagacggcggctgcggtggcttctcgcggcagctcggcggcctgcctgtctcgggcgagcaccttcgtggcgctggctggcccctggccgccagggagaaccagacgctgcgggaaggcatggacagcatgaatcagcgcgtgtcggatctggagaaggagtgctttgccatgaangacgacatcgagcggctcgggccgaacatgagcgcgggccagagcaggttcccgt

SEQ ID NO: 67398 - DNA, 428 bp, Zea mays
  Clone ID: LIB3076-047-Q1-K1-C3
cggacgcgtgggggacgggagagcgacctcagcagacaagagccagacgagactcagagagcgagcaccgtgacctctctgtttctctctcttcccttctcgtcttctgcaagaagccacaacaaatgtgaccgtctctgtttctctcatccccttcatcactctgctggtctccctcttccacctctggtcttggccatggcctccagcgcctcccggttcatcaagtgcgtcacagtgggggacggcgccgtgggaaagacctgcatgctcatctgctacaccagcaacaagttccccactgattacatacccactgtcttcgataacttcagtgcaaacgtggtagtcgacggtaccacggtgaatttgggcctttgggatactgcagggcaggaagattacaacagactgaggccactgagcta

SEQ ID NO: 67399 - DNA, 445 bp, Zea mays
  Clone ID: LIB3076-047-Q1-K1-C4
ttccgttcgacccacgcgtgcgcctactctcgtgcatttccccatctcccagatccaattcgcgagttcttcctcctgtgccgcatggggctctctgtggagaagacctggtctggacgggagtacaaggtcaaggatctctcgcaggcggacttcggtcgcctcgagattgagctggccgaggtcgaaatgcccggcctcatggcgtgccgcgccgagttcggcccgtccaagcccttcgccggcgctaggatctcggggtctcttcacatgaccatccagaccgtcgtcctcatcgagaccctcaccgcgctcggcgccgaggtccgatggtgctcctgcaacatcttctccacgcaggaccacgccgtcgtcgtcatcgcgcgcgacttggtcggccggttcgcctggaaggtggagacccttgaggagtactggtggtgca

SEQ ID NO: 67400 - DNA, 354 bp, Zea mays
  unsure at all n locations
  Clone ID: LIB3076-047-Q1-K1-C5
agaagatggccacagtcaggactctgacagcgaagagcagagagcagcatcctacgttgcccgaacaaccataagccctccaagatcacaagaggagggcggcaagctccagcctgcctaccagagcgccgtcgtcgccgcagactcctgcgccaagagctatctgaagggtgccgctagtatcagtagtgcttccaggcgtaccatcaagggggataatggccgaaaggagaagggatctccgaggctgtgaaagaggtggcgcangctcgtgacctgttaggcaaaagaggtagcaacggcgccaatgcgactgcaacgtgagatgtcttagtcatcacgcattcaacaatg

SEQ ID NO: 67401 - DNA, 418 bp, Zea mays
  Clone ID: LIB3076-047-Q1-K1-A5
gggcgtcgttgtcgtcgcgtactacgcactcctctgggccgtcgccgtactcaacctcctgtggtgcttcctgcaggcatggcaatgtatgcctgacagggcattctcttggaatgtactgtcactgtttacaaaatcaggaatgttattcttggaagtaagtctcatagcctttctacttcaaggaaatgatgccagcggttttgaatctttggcacggacctttgttatatctggagctgtagttgctgctgatgtattgctcaagactatatatgtttttggcttcggtgttcctttgttcattgatactgatcaaggaactagtgggaaatggggcctgtggattctccacaaacttgtgcttactggagtctatgggctgattgttttcatgcatcattcaagatggagagac

SEQ ID NO: 67402 - DNA, 319 bp, Zea mays
  Clone ID: LIB3076-047-Q1-K1-C6
cggacgcgtgggtgaccgcagagcaaccttatcagacaagagccagacgagactcatagggcgatctccgtgaccagtctgattctctatcttcccttctagacttctgcaacaagccacaacagatgtgaccgccactgttactctcatccccttcatcactctgctggtctacctcttgcacctctggtcttggccatggcctacagcgcctgccggatcatcaagtgcgtcacagtggcagacagcgccgttcaaaagacctgcatgctcatctgctacaccagcagcaagttaccaactgattacatacgcactg

SEQ ID NO: 67403 - DNA, 359 bp, Zea mays
  unsure at all n locations
  Clone ID: LIB3076-046-Q1-K1-G12
acggcttcctgccactcacctcggtctcagggggcgccttgcggcgggcgctcntcctgctgggttcggtccaattgagaaggggcagagggagtaaagcangttaggtccgtttgcgttttcttttgcgggtttgtaggtcaaaagctccgcgagcactttccgctccacctcctcacgctcggaatcaaatcgatgcccccctgtgatttggttcctggtatcggcgcatgagcttgctccaagagatctcccttttggttcggcgtcaggggttctgtgaggtcacgcggcttcttcctcttggcgctcctcacatgtccgggcgcttcgatctctgcccactgcgcgagtgattc

SEQ ID NO: 67404 - DNA, 320 bp, Zea mays
  unsure at all n locations
  Clone ID: LIB3076-046-Q1-K1-G2
ccggaatnngggacgacccacgcgaacgcccacgcgttcgcccacgcgtgttttgacacttggttgtgtactaacttggcttctaaaaggggctgaaacctcaccggaggcggcagcggcgtctacgctagggtttcggcgtgaggatcgcctatgacgactgctttcagacgtcccttccgaggccgcggcgccatgccctccggcacccgctacctccgccgaggctccgccccaggctccaacgacgtcgtcaagcccctgttcaagaccgtctttaccaccgtcgaccaagatcacccccagacacacagagacac

SEQ ID NO: 67405 - DNA, 186 bp, Zea mays
  unsure at all n locations
  Clone ID: LIB3076-046-Q1-K1-G3
ggacgacccacgccggcgcaaaaacnccagccgctccaccttcttcaatttcttcttcctacaaagaggaancccctntgaacagtggcactttaaaatttggcggggacataacacactcactgggctactgcttcntcancttttttttttttttttttcttcccccacccaaactaccaaccg

SEQ ID NO: 67406 - DNA, 409 bp, Zea mays
  unsure at all n locations
  Clone ID: LIB3076-046-Q1-K1-G5
gagcccaagaagtgctgtatgcaaaacagcactgatgacttgtgctgacatctttaaggtctatggtgacgtactggttgagtctattgatgcactggtgagtatcgctattcatttaaaatttcttgtattagctaaaaggtctttgaaaacatctttctgtcaactgctgcattcacagctagtgcagctgtttctaaaggcttcacaagataagcgttttgtctgtgaagctgctgaggcagctcttacatcgatgacaagttggatctccccattactactgttaccaagaatgcagccctacctcaagaacaggaatccgcgggttcgagcaaaagcatcagtgtgtttgagcaagagtgtaccttgcttagatgtgcanggaatcagagaatatggaatggat

SEQ ID NO: 67407 - DNA, 364 bp, Zea mays
  unsure at all n locations
  Clone ID: LIB3076-046-Q1-K1-G6
tggaaagcctttaattatttcccacaatggtgctagtggggattaccctgngtgcactgagctagcttatcagaaagcagttgatgatggcgcanatgtcattgattgccccgttcaagtgaccaaagacggaataccaatatgcatgagttccattgacctgatgaacgatactactgttgcaagatcacaatttatctctcagactgccacgataaaggatattcagattgcacaaggggtttttacttttaatctcacctgggatgacattgtaaacaacctgcagcccaaaatatccaccccatggtactccttcagattggaccgaaatccgagatataagaatgcaggaaagttcatg

SEQ ID NO: 67408 - DNA, 250 bp, Zea mays
  Clone ID: LIB3076-046-Q1-K1-G8
cccacgcgtgcgcctactcactctcactcctacactcactaccacacccctgaggaccgcgttcccccgctacacacgaggggactatcgacacgactattcacaccctgagtcgctccttgactcgatactggaccataaacagcaccactagctgcttcactgggtccttccggaagccccgccaggactgggtgcccctcaccgtgaccgtcaccggcaccggcacctgcaccggagggaactcacg

SEQ ID NO: 67409 - DNA, 371 bp, Zea mays
  Clone ID: LIB3076-046-Q1-K1-G9
tgttggtttttaaattttttttttttttgactcaaagcagctcgatgtcattatctcagaagacagtagctgtgggaacgcaatgcgaggcgcagggaccggacagacactgctgctacgactacgagtaggaagaaagcgagaagaataaaagcgagcgaggaaagggatggcgggggcaccactgcccggccggcagcgggcagcctttggatcagaactacagtggcaggcgacctcctctctcctctctctttctttctgaaaaaaaaataatgcagatcttccgcaagttcccaagacgactggcgacaatgacccaccatgagcacagcaaagcatttcacccgtttctttctttttgggttcct

SEQ ID NO: 67410 - DNA, 323 bp, Zea mays
  Clone ID: LIB3076-046-Q1-K1-H1
aggaactacaggaggcagaggatgctgaaaattctagacacatggagagattgaaggatgtaaatacacagtaccaggagagactatgaacacttagagctcggcaagcgaactatagagatgagttcctgcgcaaggaatctctagcacgccagcagcaataccagcacgccagcatgagccattatgccagcaattccacggctggggagcagcatggttataacccaacggcagcaggcacgcctcctgttgctgctggaggtgcttatggtgaggctcatcggggttatgcttctggccagtatgaatcatttagcgat

SEQ ID NO: 67411 - DNA, 335 bp, Zea mays
  unsure at all n locations
  Clone ID: LIB3076-046-Q1-K1-H11
accccgcgtccgcccacgcgtgcggcaaccgattgcctatcttcctcttaaccaaagaccgatggcccccagggccgggtggatttccgcggcgaggaagcctntnnaagaagaccccgcggccgagaagacgaccgccgggaagaagcccaaggcggagaagcgggtccccgctggcaagtccgccggcaaggagggcggctagggcaagcgttgcaagaagaagggcaagaagagcgtggagacgtacaagatctacatcttcaaagtgctgaagcaggtgcacccggacatctgcatctcctccaaagccatgttcatcatgaactccttta

SEQ ID NO: 67412 - DNA, 248 bp, Zea mays
  Clone ID: LIB3076-046-Q1-K1-H2
ggtcgaccacgcgtacgagatccggagcagccgcagtcccaccgatcccgccgccggtcgccctccatctcctcggcgctgcctctcgtttctgtggggaatggtcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatg

SEQ ID NO: 67413 - DNA, 245 bp, Zea mays
  unsure at all n locations
  Clone ID: LIB3076-046-Q1-K1-H7
aaaaaaattttttttttacttaaacttttctttttaaatcaaaaaaaacaaaggggntgtttcatttaaaaaggcaacgacaaaaaaacactttttttattactacaatatnaaaaaatctatacaaaataattttcttattattcattcttttttattattatcatcctatacattcattctattatcatatctactatttatatcaacttctctaactattctttttttttaaaaaatataat

SEQ ID NO: 67414 - DNA, 313 bp, Zea mays
  unsure at all n locations
  Clone ID: LIB3076-046-Q1-K1-H9
cggacgcgtgggcggacgcgtgggggaaaccatcaacaaatgcttctccaaaaggacagttgaagaaatcatagatgctcttgaacaanaaatctcaaatgtttcagacaaatgggttgctgcaacaatcaagtccctgaaaaaggcttcccccaccagcctaaaaatttctctgagatcgataagagaagggagaacacaaactcttggggagtgcctgcgtcgggaatatagagtggtttgccatgtcctgcgtggcaccttcagccgagacttgtctgagggatttaaggctgtgctactagaaaaagac

SEQ ID NO: 67415 - DNA, 435 bp, Zea mays
  unsure at all n locations
  Clone ID: LIB3076-047-Q1-K1-A1
cccacgcgtccgaattttcatcgtttcgaattctttagacggttgaggcttcctgaatagttcccatctaaaagtagttaaaggagttgcctggcattacattttccgaggacagattctgatgtgaagagggcgcctggcatgaatcaaggggcatctccacccactctgaaaggctgccatgagggtggaaaatagctcacagtcgcaggaagaggaatagcatcctgccaacatgggtgagctgcgggcgcatcataccaattccgcttctgctatgctccgtccaccaggtcaccagcttgagaccgaggcatcaaaccgccagattttgtgtttctcagagcaagtagaactaaagcacctcanagatgtaaatttatgcactcccaaatttaggattttgagcgcaatcttggcagttttcatacatgc

SEQ ID NO: 67416 - DNA, 256 bp, Zea mays
  Clone ID: LIB3076-047-Q1-K1-A10
cccagactacatgacgcttttctagacattattagccatgtttattcgggactccttcgagaattctctcatggccaacgggctcctattgcagtaaggcatatagagtcaatcatacgtatgtcacacgcacatgcaaggatgcatctgatgagctacatgtctcacgaagatgttgacatgtccatccttgtcttgcttgactcttttatttcgactcataagttccgtgtgcataaagcactttaaaagaatt

SEQ ID NO: 67417 - DNA, 327 bp, Zea mays
  unsure at all n locations
  Clone ID: LIB3076-047-Q1-K1-A11
tattctgtcaattgatgagtcaaatgcaacttgtggaaagtttttatcatctattgnttgggacatcacagaagttatccgccattcgtacaggcagcttttgctgacaactgctggtcttggtgaatatatttctggcgctattcttttcgaggagaccctttatcaatcaactacagacggcaagaagtttgttgactgcttgaaagatcagaatatcatgcctggcatcaaggttgacaagggtttggttccattgcctggatccaacaatgaatcatggtgccaaggtcttgatggtttggctttaaagtgtgcttaatacta

SEQ ID NO: 67418 - DNA, 389 bp, Zea mays
  Clone ID: LIB3076-047-Q1-K1-A2
cgcaattcccgggcggacgcgtgggggaaatttcaatgtgcaaccttacagctggattttcagctgcccattcggttcaagctgacttattctgctgaggatgaagcaaaaattgaaaggcctgtgatgatacacagggcaatcctaggttctgttgaaaggatgtttgccattcttttggagcattacaatggcaaatggcccttatggctaagccctcgccaggccattgtttgttcagtatcttctggttcagtggaatatgcgaaacaggttcttgccatgctacatgaagctgatttccatgttgatattgatgtgagtgacaggacaatacaaaagaaggtacgggaagcccaggtagctcaattcaactacattcttgtcgt

SEQ ID NO: 67419 - DNA, 435 bp, Zea mays
  Clone ID: LIB3076-047-Q1-K1-A3
cggacgcgtggggtccgcccggcgtaaagaaaaccctccctcaccacagccgccacgccggggccgaggagaccgacaccaggcctgcctccgcgggctcccgaggccgccccgcgcccgaggacgacgacagggaggagggcgagatcaccgacctcgcctgcgctccttccccgcccgccacgcacccgctcgagcactcctggaccttctggttcgacaacccgcagagcaagtccaagcaggccgcctgggggagctccatccgccccatacacaccttctccaccgtcgaggaattctgggggctttacaataacattaatcaccctagcaaattgatcgtgggagctgatttccattgcttcaagaacaagatcgagccaaaatgggaagaccctatttgtgcgaatggtggtaaatggaccatcagct

SEQ ID NO: 67420 - DNA, 384 bp, Zea mays
  Clone ID: LIB3076-047-Q1-K1-A4
tctaccactaccacagcaccagcgacggaccgggcaggcagagaaaagcagaccagacgagagacctctcgcgttccgtcctcctccctgcccctgctgccgttccccttcttcctcagttctcccgcccgctgctgccctccgtccgcgtccagatcccgccaccaaccgatccggcgccctccagcatggcgggggcgaaggcggcgggagccctggctcttgcgctcgtgctcgcgctcgcgggggccaactccgagggcgacgcgctctcggcgctgcgccggagcctcagggaccccggcggcgttctgcagagctgggaccccacgctcgtcaacccctgcacctggttccacgtcacctgcgaccgcgacaaccgcg

SEQ ID NO: 67421 - DNA, 334 bp, Zea mays
  unsure at all n locations
  Clone ID: LIB3076-046-Q1-K1-G11
acccagcccgcgagcgtgaggccgttcgctttaatttcgtcggccgtcaacancncntgggtgatggatcctattccggacggggaccgccatcacaaccngcacgcctagcgcgactgcgagatcggccatgtcgtgcgtatcggtgagcggcacgcgaaagccgccggcgccttcgacgacgacgatgtccgcacgcgtcagcgcctcgcgatggcacgcgacgatcgtgtcgatgtcgagcgtcacgccttcctgcgcggcgactatgtgcggcgcggtcggcgctttcagcaagaacggcgtgcgcagttcgggcgggagcacgacgttc

SEQ ID NO: 67422 - DNA, 372 bp, Zea mays
  Clone ID: LIB3076-046-Q1-K1-C10
acgcggacgcgtgggttttttttaaattaatataaaaaatatttataaattcgtacagggaaagtactgggtgttccttgctcatccaatacagagctccctttgggcatccatgcttcttggtgatgaacaaatattatagaacgtcctatatatatgtactagtaaaaaacatctcatatgaatcgaattaagcaaacaaagggggaaaacaattgaaggaaaggaatgaactttggtcagctagatgctatgagccagcagtgacggtcgatagattaggccaccatctgctcctgctccgaccactgcgcaaatatgtcgccggcgtggccgtccttgacaagagagttcacccacgagacgtctggc

SEQ ID NO: 67423 - DNA, 338 bp, Zea mays
  Clone ID: LIB3076-046-Q1-K1-C5
caaaacctgctcctagctgctctcgtgtgttttgttacatccaatattaagcgagagcgggctagctataggtaagaccgtaagaggatgatggtggacaggcagcgcgtgaggcaatgcgacattgaggtcatgaagatggccatgctcaagcacgaagaaaccttcaggcagcaggtccacgagctgcatcgcctgtaccgtatacagagggagctgatgatgacgacgagtgacgacctgaccggagccaagccggtgaccaccccccgccggcgcagcaagcagccgcggcgggcgctgccgctgggcctgcagcttccggccgacgagtacat

SEQ ID NO: 67424 - DNA, 304 bp, Zea mays
  Clone ID: LIB3076-046-Q1-K1-C6
gacccacgcggccgcggacgcctgggcggactcgtgggcgtcgttttgcttgtgtggacgggacggatacatgggggagagcggcgtcgacagggacgagggccccgccttgtgcaaggccgctgcggcggacgggggcggggatgtgggcgccgcctccgcccgccgccgccgccggctcgggcgtgccacggaggggcctgctccgacgaagagaatccggtcggggtcgcagaggtcgccgtacgactcgtctctggagacggcgacggacggctgctgctggccggcgcgcctatcgcat

SEQ ID NO: 67425 - DNA, 392 bp, Zea mays
  unsure at all n locations
  Clone ID: LIB3076-046-Q1-K1-C7
cgccagttcgccacctcctttgctctcgcctcgcgcgctccccccccccccccggggggggggtcgttccgatcggcaccggaccgcnccaatngaggtcgccgccgtgcccagatccgccgcggcctgccgtgcggcgcccctgctcccggccgttcgagccgctgcgtgccacctggccctgccccggcgcgcgttctccgcatccgtcgcggcggcaccggcgccgcgccgcctcgccgctcgtngcgctgcggatggtgacagcgtggagacggcgccggaggcggtccccattgagaaaaggttccctcccttcccgagcgtcatggacatcaaccagatccgcgagatcctcccccacaggttcccattccttttggttgatagag

SEQ ID NO: 67426 - DNA, 357 bp, Zea mays
  Clone ID: LIB3076-046-Q1-K1-C9
cccacgcgtccggtgggttggcttctccttcccctccggttcgggttcgggttggtgagggtctcctgggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgaaggcatgaacggcaaggagctggacggccgcaacatcaccgtcaacgaggcccagtcccg

SEQ ID NO: 67427 - DNA, 434 bp, Zea mays
  unsure at all n locations
  Clone ID: LIB3076-046-Q1-K1-D10
ggcggacgacccgctgctgcgtccctggcagctgccctacccggctgccgccatgcccatgggcgccccgcacatgctccactactgatgattgcctccaccaaccacaccaccatacatctgaggctgtcagctggggctggttggcaacaagacaagaagaattggctgcctctcaacaacattcacatctactacctacctggctgctttgagaattacagggcctctactatctgctgctgtgttaaatctacctcctggtttctccaataattgtcgctgttctgtactcttctcttatgttctgtctgtcagtgtgtatgagatgatgctcatcttatgttatgtaaggcttaatcatgtgtctagntgtactttctgtcttggtatgttatcagntatatgaataataaagggttatgtaagcttcc

SEQ ID NO: 67428 - DNA, 388 bp, Zea mays
  unsure at all n locations
  Clone ID: LIB3076-046-Q1-K1-D8
actagttctagatcgctatctagaactagttcccaccgatccatttcanccgccggcgggcgtagcaagcaagagcagcagggatgccngctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccactgccgcaccggtcgcgtttggaacgtcaccaaacgcgccatctgcgtcgagataaacaagcaggtgaatggtcccatcatcaagaagcgtattcatgttcgcgtggagcatgtgcaaccgttccgcttcac

SEQ ID NO: 67429 - DNA, 347 bp, Zea mays
  unsure at all n locations
  Clone ID: LIB3076-046-Q1-K1-D9
cccacgcgtccttccactcatcctttcactcttccgcggacgcttggacacacgggccgggtgcattttagaggggggccggcaccacacctccaanaatccacctccacgactgagttgaccgctcggcggcgccatggcagttcaccggctccaaccttcccccttcggactacagtgctccaccgaccggacgccagtgctccttcatgagccacagctgaccggtgcacgcaccgatggatggtgcatgcatgataggtggatttggttgacctagattcgatgttctaaaagcgacttggaggtggctgacatcttcaacactgcaaccattcagttacaac

SEQ ID NO: 67430 - DNA, 263 bp, Zea mays
  unsure at all n locations
  Clone ID: LIB3076-046-Q1-K1-E11
ggttataccatgtcatttattactaaagttgatggtgaagcagcccaaggaatagctcattcatctgcggctatggtaatacattctgaaaatgggtatcaattacctgcatctacagcaactcaacaaccagtgccccagagggccactcaacagttccaagcacctcacaatccaaactttatgccaaatcggcatggattctcaccacatttcgggtctctaatgggtgtttcnccccaaaaaatcaaccactttttttt

SEQ ID NO: 67431 - DNA, 396 bp, Zea mays
  Clone ID: LIB3076-046-Q1-K1-E2
acgattagataagtccttgtctaatgggcagacttcaaatcactgtgaaggtgctattggggggactcgatctgacccggaaggagataagtttggatctatggaagcggcatgcgaaaaggggaccagttcagagactatgaaacagcgaatagggaggccaaagaaaatcttgaagcaaacaaatgatagcatttcggatcgtgacaagggttcacatcaggagcacatcgaggccaaagaggaagttgatatctgtggtgggaaagacttgacgcatttgaaaactctggagcgtaccgaggctcagaatagcacaatgataaccaaggaagtaaacaacaacgacacagcagagaaaaacctatccaagatagagggagacaactcggatct

SEQ ID NO: 67432 - DNA, 335 bp, Zea mays
  Clone ID: LIB3076-046-Q1-K1-E9
cccacgcgtccgcccacgcgtccgtccacgcgtccgctcttttcatttcccatctctctcgtcgccgtcccgtgctccctccgctagttctcccatttccttccccacctcggtcgtcgcctcccccagagagcaggagccgcctcgtccctgccggtcccgaccccgacccccatcccgtccgcgtccaacgccatgaatcccgagtacgactacctcttcaagctgctcctcatcggggactccggtgttgggaagtcttgcctgctgctcaggtttgcggatgattcatatctggagagctatatcagtactattggagttgattttaaaat

SEQ ID NO: 67433 - DNA, 272 bp, Zea mays
  Clone ID: LIB3076-046-Q1-K1-F11
acgcccacgcgtccgcccacgcgtccgcccactcgtccggactagttctagatggcaaacgggcaaaatttaaaaaataaagaagaaaaaaaaaaaaaaaaaaaaaaaaaaaaaaaaaaaatgaaagaaaatataaaaaaaaaaaaattaattaaaaaaaaaataaaacgtttatttcttttttaatagtgcaatttatatttactcttttgtcccacattttacatctttttttactgggataaaaattgaaattacctatcttaattttt

SEQ ID NO: 67434 - DNA, 407 bp, Zea mays
  Clone ID: LIB3076-046-Q1-K1-F5
cccacgcgtccgcccactcgtcctttgactcttgggtgggatcgttacacagtgggtggcgtcaactagagtgaatgatcagtatcttacaaatgtcttgttaaagattaacgcaaagttgggtggcttgaattcgttgctccaaattgaaacatccccagcaattcctctcgtatccaaggtcccaactataatcttgggtatggacgtatcacacggatctcctggacattctgatataccgtctgttgctgctgttgttagttctcgtgaatggcctcttatctcgaaatacagagcatctgtccgcacccaatcaccaaaaatggaaatgattgactcgttgtttaagccacgggaaactgatgacgatggttctgttcgggaatgtctgattgacttctaca

SEQ ID NO: 67435 - DNA, 251 bp, Zea mays
  Clone ID: LIB3076-046-Q1-K1-F7
cccatggcagcgaccagtgagttcaaatgtttctgcttctacatctactgaggccagtgggagcgaatactggctggagggaatggtcacagaatatcttgttgagacatttgctgattacttcggtgacgttaaaatgtatattgaagaaagaccatttcgaagatttgtggaggcttgcatagaagaaacaatcgtggtctatgttgatcatctcctttcccagaaaaactacataaaagaggaaacaa

SEQ ID NO: 67436 - DNA, 397 bp, Zea mays
  Clone ID: LIB3076-046-Q1-K1-F8
acgcccacgcgtcctgttctagatcgctagctttcgcccttttttttttttttttttttttttgtttttttttaaatttgggtggtctttttttttttttattttttttttttttttttttttttttttgcaaaaaaaaaaaacacacattaatttcccaattttaaaaaagataaaacttatggttttaattaaattccaggtaaccaaaaaaaaataaaataaattttggtcccaaattatgaattttttttaaatacaaccccacaaaaattaaaaataattttaaaattaaaatttttatctatacaaaaaattctttttttttcaaaaaattaataacttttttttttttttttggaatttaacctcccattttttttttttccctttcttt

SEQ ID NO: 67437 - DNA, 395 bp, Zea mays
  unsure at all n locations
  Clone ID: LIB3076-046-Q1-K1-B9
cgggagaggggnggtgctatcaggcaagagctcgccaagctgaataaggcgtccacggcttaagtcccttttgggccttggcagcatgaccttgaacctgtcaaagtcactgagcgcagccctcctcttctggacaatcagcttcttgccccatgagctgttttcccacttcgtcttcacatcagcttcctccatagccttgatcagggttgacttcttgggaacgcgtttgatgtcaatcttgatgtcagctcaaaataagtttcgattacagttgcctggggaggtcaaacttgcagaggaagcggataaattactggatgggttgggtccaaggttttctggttggtggggatatgatcctgttccggtggatgctgatctgttgccagcta

SEQ ID NO: 67438 - DNA, 432 bp, Zea mays
  Clone ID: LIB3076-045-Q1-K1-E9
acccactcaatcgcggactcgtgggtcttctgatgcgatgggatcttcaccttcttgtgattcacctgacaagttttcatgggatcattagcggtctcctatctctagtccactgagaagtccagttttaaaatcaagaaacccaagtgcacctccatcaccaatgcatccaaagttgttcccggagaaccatgtttctcgccctgatggcaatggaagtgctagttttcacccattaccgctccctcctgcttctgtaagcccaaagcagacaaatgctagccaccagttagttccaaaagctgagatgccttcggtggctggtcaatggcagaaaggaaaactcttgggtagtggcacctttggatgcgtgtattaagccaccaataagcacactggaactccttttgccatgaaagaggtgaatataat

SEQ ID NO: 67439 - DNA, 260 bp, Zea mays
  Clone ID: LIB3076-045-Q1-K1-F7
tcgggcgtacttccgcctcccggctctcctctgcctcgccgtcgtcgccgtcgtcgtcacggcggatgccggcgccttcgtcagagaaggtggcctccttctgccccgtgacgccacgttcccggcggcgcaagcggagcggctcattctcgcgctcaacctcctgcctaaggagaaggaggctgcgccggccgcaggcggctgctacgggcccagcgtggtgcccggggagctcctatagcgtcgcgtccggctgcccg

SEQ ID NO: 67440 - DNA, 200 bp, Zea mays
  Clone ID: LIB3076-045-Q1-K1-F8
gcagcaggggagactgggagatagagagaggagagggagggtttcctcaaagagaacctggacccaggcccaagcatagaacactagcgttctctcaccagggcgggcgttcatcccagcagccatggcgatggcgtacaatatggcgactgttgggatgaacgtgaaggaggagtgccatcgctggttcatggagatga

SEQ ID NO: 67441 - DNA, 391 bp, Zea mays
  Clone ID: LIB3076-045-Q1-K1-G11
caatgtcaacagcttatgacatggaaagaaaatattagaaacggcagcgtcatgatggctgcacgtaaatccctggggcgatgttgaagctgatgaagcacatcaaagaaaagtacgggaatccgcccgtgatcattactgaaaacggcatggatgatgcgaacaaccggttttcgaaattagaggatgatctgcaggatgataaacggatacagtaccacaaggactacatgtctaacctcctagacgcaattaggaatgaaggctgcaacgtccatggctacttcgtctggtcgctgctctacaactgggagtggaactcccggtacacggtgcggtttgggctctactacatcgactacaacaacaatttgacactgttacccaaagc

SEQ ID NO: 67442 - DNA, 259 bp, Zea mays
  Clone ID: LIB3076-045-Q1-K1-G2
cggacgcgtgggcgccggcctacaaccgttttcgtgctcacacacccaaacgttagtcgcgatcatgccccaaggactcgagatgaagtcgagggcacggtccaccgccggcgactccaggctttcggtgaggaagaccaaggctgagaaggacccaaacaagcccaagaggcctccgagcgcgttcttcgttttcatggaggagttctggatggactacatggagaagccccccaatgtgaaccaggtttccttgatt

SEQ ID NO: 67443 - DNA, 361 bp, Zea mays
  Clone ID: LIB3076-045-Q1-K1-G5
caggtggtatagcacctgcacaatccaactgcgccagcatttgtcactacgtgcaatgcgtgctgccgtgatatcgaaactggtcaaagctggcggtgtgagatctgtccagattttgacgtgtgcaacgcttgtttcaaaaaaggagcggttactcatcctcacaagttaacgaaccatccatcagctgctgaccgtgacgctcagaacgcataagctcggcaaatgcgtgttcagcagctaagaaagatgctcgatcttctggtacatgcgtcgatgtgccggttcggcagttgccagtatccccactgcctaaaagtcaaaggactattccgtcacgggatgcaatgcaaaacgcgtg

SEQ ID NO: 67444 - DNA, 191 bp, Zea mays
  Clone ID: LIB3076-045-Q1-K1-H1
acggtaaaaatgcaatctagatattattcgtcaaggagtatagtagaaaggatggaagcttttcgggcaaatcgcacacgcatgctgtagttctgtccagaaaattttgagatgacatgttcattgactgaatatgggctcttggaatgtcttcatgagatgatttttcaagttctgactgtttactgaac

SEQ ID NO: 67445 - DNA, 341 bp, Zea mays
  Clone ID: LIB3076-045-Q1-K1-H11
taaaaacattgccactatttcattatccattacgtattcttattcttcaaataacttcatcatatacgggttatttggaaattttgatcactctaagaacactcattaactcataatattctatttttgattcataattcttacctttcaccctcatttcacaaatcttaacatttattcaatcattaattcttattaactttcaaaaatcaattctatatttctctattattattgaactctttttccccaaactttcctcaacactgaacctatttcacacttttttatcattatcaataccctattctcatataatacaaacatcgttttttcttttc

SEQ ID NO: 67446 - DNA, 289 bp, Zea mays
  Clone ID: LIB3076-045-Q1-K1-H5
cccacgcgtccggggcaaacgcccttggtgccactgtcatcgggactgtttccaatcaagagaaagccgctcaggcagctcaggatggatgccaccatcccataatttacactagcgaggatgtcgtcgcaagagtcaaggatattacatcaggaaaaggtgtcaatgtcgtctatgattctgttggaaaggatacatacaaggcttccctggagtgcttggcgtcccgcggcttcctggtgtcgtttgggcagtcggcaggcaaacctgacccaatcccaacgagcga

SEQ ID NO: 67447 - DNA, 384 bp, Zea mays
  Clone ID: LIB3076-045-Q1-K1-H6
cttacctacgctgtgctgctcatcgtgttgcacaacattatggcttagagactatagtggcagataggttagtagaaggctcagttagcaggatcgttgcaagaaaaacaccagagagcaggtgtcctgcaatttcattagcagaagttcctagcaaacaagcaagaaatgatcatgaggcagcagagaagcttaagtttgtcatttatcaaaggcccaaagcattccaaaatggaagcactgatttgggaaacaagaatggtgcaccaaaaactgttgaagagagaatagaggaatataattaagcacgagcacgcatcttaaatggttctggttctgcagattctgatgcttcaagtgttttggggaactctttgcactggc

SEQ ID NO: 67448 - DNA, 290 bp, Zea mays
  Clone ID: LIB3076-046-Q1-K1-A10
cggacgcgtgggcggacgcgtgggcggactcgtgggcagatagagaatgatggggatgtgctttggtaaccagatgtgagagaaacaaatgaggctgtcgcattgaggggtatgaagtttatggactggttgtggacaagagaagagaaagagatagctattgtcagtcacagtggtttcttgtttcacaccttaagcatgtacagcaaggagtgccatccaaccataagagacgaagttagcaagcactttgcaaactgcgaagctacggtcgatggtgttggttgaca

SEQ ID NO: 67449 - DNA, 327 bp, Zea mays
  Clone ID: LIB3076-046-Q1-K1-A11
cggacgcgtgggaagccggccgtcaagagcatcgagagtccagatggagacatcgtcgagtgcgtgcatatctcccaccagccagcgtttgatcatcctctcctcaagaaccacacaatacagtttaggccggcgtaccaccctgaaggtctatacgatgataccaagagcagcataggctcaaacaatgctggcgagaggccgatgctccagatgtggcatcgaaatggcaggtgccccgagggcacggttccaatcaggagaaccaagaaggacgacctgcttcgagctagctccgtgaggcggtatggcaggaagcggcacact

SEQ ID NO: 67450 - DNA, 369 bp, Zea mays
  unsure at all n locations
  Clone ID: LIB3076-046-Q1-K1-A12
gaatactcgtgtgatgagaaagtcccatgtcaataatgtgacttcttttgttgatgatcgtgctactttttaaaacatgtgcactgttttgcttattatcaaaatcctgctgagaatgctacgtcgaatactgtaggcgctgaaccgcgctggtggcaaggctggaaacaagggtgctgaagctgctcttacttccgtaagttacccttccagtcggaaatcctgatttcaaacaaacatagatgcattagcatgtgagaagcccaagttcccctgcagattgagatggcctctcttgtncngcatcacttangctgacactttgcatatttctggttctatacacgaggcaagacatcatttctttct

SEQ ID NO: 67451 - DNA, 401 bp, Zea mays
  Clone ID: LIB3076-046-Q1-K1-B10
cccacgcgtccgagcaattccccgcgcgcgctctctccgccccggcactgggccggcggcgatcaccactcaccaggtgccaaggtgtcttgtcggccccttcaccaagtgttagtcgggtccttcgccggcgacgggcaccaccagtatggacgaatcacgaaaaagagctgtctctactgcaaatgatgaagactttggaaatgacttcctttcatcttggaagttaccaaaatcaggaaaagacacgattgacttcagtgttgactcagttcccaagagtagcaagaaattcagctttgacaacctagatgattttgggcttaatggagcctttgacaaattaccgtcctttcaaatgggcatgtctgatcttgatttttctagccctgacaagaaaa

SEQ ID NO: 67452 - DNA, 351 bp, Zea mays
  unsure at all n locations
  Clone ID: LIB3076-046-Q1-K1-B12
gccgcggtgaagaactgcgtgacgcaggtggccaagaagtcgctgagcctgaacgcccggggcgggctccacaacgcgcgcttctgcgagaaggacctgcanacggcgatcgaccgcgaggcggtgttcgcgtacgcggacgacccgtgcagccccaactacccgctgatgcagaagctccgcgcggtgctggtcgagcacgcgctggccaacggcgacgccgagcgcgccgcggagacgtccatcttcgccaaggtggccgagttcgagcagcaggtccgcgcggcgctgcccaaaggaggggaggccgcgcgcgcggccgtggagagcggcagccccctggtccccaac

SEQ ID NO: 67453 - DNA, 391 bp, Zea mays
  unsure at all n locations
  Clone ID: LIB3076-046-Q1-K1-B2
ggcgacgagaatccaatcctcgatcggccgcgtgcgcggcatggcgtctccgccgccggagctagtcgatgacgccaccgccgagagtctccttcggctcccaccggatgacccagcgtgcctcgtgcgtgcctcccttgtctgcaaggcttggcgggagctcctctctagccccatcttcctccgccgctaccgcagattccacggcgcgccgcctctgcttggtttcctctacaacatctacgacgaacgcccctgtgctcgattcgtcgtcgccgccgacgccgccaccgncttncccttctctgcaccggcgttcgatcaattcgatttgtggttcatcgagtgccgccacgggcgcgccctgctacaaactttcgagcgacatgcg

SEQ ID NO: 67454 - DNA, 437 bp, Zea mays
  Clone ID: LIB3076-045-Q1-K1-E6
cgagaaaaggagagggctcagctgaaagaacaaaacagaaggctccgcattcagctgcgagacactgccgaagctgttcatgctgctggagaactgctcgtcagattgagagaaaccgaggaagcatctacactagaaaaggagaggactgccgcgttgttgcaagagaacgagaagctgaagaagcagctggagaagctgaggaagaagcacgagatggagctggagacgatgaatgtgcaccttgcggagagccggctgccggagtccgctttgggtgccttctaccaccacgagaacgagaggacgcctgacgacgatctgttctggcgggccgtcttcgcttttgcgtacagtgactgaagttacctgactggggattgcttgggagttgaatctcgtcaactgagacaggttgacaaattgggcatgagcat

SEQ ID NO: 67455 - DNA, 372 bp, Zea mays
  unsure at all n locations
  Clone ID: LIB3076-046-Q1-K1-B3
gaaaacccgggagagggggggtgcgtgtcaggcaagagctcgccaagctgaataaggcgtccacggcttaagtcccttttgggccttggcagcatgaccttgaacctgtcaaagtcactgagcgcagccctcctcttctggacaatcagcttcttgccccatgagctgttttcccacttcgtcttcacatcagcttcctccatagccttgatcagggttgacttcttgggaacgcgtttgatgtcaatcttgatgtcagctcanaataagtttcgattacagttgcctgtggaggtcaaacttgcagaggaagcggataaattactggatgggttgggtccaaggttttctggttggtggggatatgatcct

SEQ ID NO: 67456 - DNA, 225 bp, Zea mays
  unsure at all n locations
  Clone ID: LIB3076-046-Q1-K1-B8
aatcctcatcngtttnnttttgcatggcgnctcccccccgcggctagtttatatttcaaccgcccagagtctccttcaactcccaccnnatgacccaacgtgcctcttgcgtgcctcccttgtctgcaaagcttggcgggagctcctctctatccccatcttcctcccccgctaccgcaaatttcacagcgcgccccctcttctttgttttctctacaacatcta

SEQ ID NO: 67457 - DNA, 282 bp, Zea mays
  Clone ID: LIB3076-053-Q1-E1-F12
gatcccccgagcagcaggttttcggtatgaggttttgtgaagaaagtggcacaaaattcacaattacaattgagaagtaggagataacaatgaaaatttcaacacaaaagtcaatgaaatcaacagggggaactcagaattcaatcgtcatacagaacataggttttttaaatgataattattgagaaattaagtaaacagtcgccatcttgatcaccaccatcaaaatcactgtcttcttcgtttctccattttcatggtcacaaagacagtgcaatatct

SEQ ID NO: 67458 - DNA, 259 bp, Zea mays
  Clone ID: LIB3076-053-Q1-E1-F2
gttggcttctcttccccctccggttcgggttcgggttcgtgacgttctccggggttcggtttcgtgggtgatcggattgagatcgcggcgtcggatctggggtatcgctgcttcgtctgcggtctcgcctggggcacgggctaccactccctccataacgccttcagcacgtactgccacgtcctcgagtccatgatcatcctccgatctggacacgcatacgtcccgccgggttcggcttcgtcaccttctccactgt

SEQ ID NO: 67459 - DNA, 382 bp, Zea mays
  Clone ID: LIB3076-053-Q1-E1-F3
acgattccacttccacctctctctttctttccactactcgccctctctctcttgcgcgcgcgtgacaacatccctccacgggcgcgcggcgcgggagcacccaccgacttatcgccggtggggcggggcgggggcgatctgatgccggcgcggcggtgatggcagcgccgtccggcggtgggggcggcggtgcgggggagggctcctcctcggccgccgcagctatgacgatcggggcccacgggggtggaccaagtcacagaagcgatgtggcagatgaatttaggagatgccatgggactggggccataccaagagcgtgttggtgatccagactgtaactattacatgaggactggcatgtgcaggtttgggatgacct

SEQ ID NO: 67460 - DNA, 320 bp, Zea mays
  Clone ID: LIB3076-053-Q1-E1-F4
gattcaacttccacctctctctttctttccactactcgccctctctctcttgcgcgcgcgtgagaacatccctccacgggcgcgcggcgcgggagcacccacggacttagggccggtggggcggggcgggggcgatctgatgccggcgcggcggtgatggcagcgccgtccgggggtgggggcggcggtgcgggggagggctcctcctccgtgcgcgcagcgatgacgatcggggcccacggggtgggccacgtcacagaaggcatgtggcacattaagttacgggatggcatgggactggggccatcctcagagccgtg

SEQ ID NO: 67461 - DNA, 392 bp, Zea mays
  Clone ID: LIB3076-053-Q1-E1-F7
attccggcgtcgaaacacgcgtacggggaagccaaatcgatggcggcggcggcggccggcggcgagaacagcggcgcgggcgcgggcgcgggcgagggcgagttctacctgcggtactacgtggggcacaagggcaagttcgggcacgagttcctcgagttcgagttccgccccgacggcaagctccgctacgccaacaactccaactacaagaacgacaccatgatccgcaaggaggtcttcgtctccccctccgtcctccgcgaggccaggaggatcatccaggagtcggatatcatgaaggaggacgacagcaactggcccgagcccgaccgcatccgccgacatgagctcgagatcgtcatgggcaacgagcacatttcattcaccac

SEQ ID NO: 67462 - DNA, 397 bp, Zea mays
  Clone ID: LIB3076-053-Q1-E1-F8
cgacacacgcgaccgaagcaatttgatagcttaagtcaagtggctgctattgttcacaatgacttttaccatttgtcccaagaaattctgggccttgcatttcagtaccgtgcagattttcctagtgatctacagaaacaggttgtttttgtggatttagccccaatcttctcccagatggcggatgctatattgagaagacaaatacaactcactgttgatactataagtgaggctatagatggtgctgaaggttttcagaacacacaccaacctcagcattatgaatccgcaaaatttagtattgagcaggtcgtgtttattttggaaaagatacgcatcatgtgggagtcgatactgccaagatcaatttacaggaaaagtatgtgcaatgtcc

SEQ ID NO: 67463 - DNA, 380 bp, Zea mays
  Clone ID: LIB3076-053-Q1-E1-G1
acgagcttgttgataagttgtgtggcagtgatgaatgtattggctctggctctcagggtgcaagtcaggacacttttggaactttgggcgccattgtaaaacggcgaactggcaacaagcagataggtttcctcaccaaccgacatgttgctgttgacttggactacccaaaccagaagatgtatcacccattgccacccaaccttgggcctggtgtttatcttggagctgtcgaaagggcaacatctttcatcacagatgatgtttggtatggaatctatgctggaacaaacccagagacatttgtacgcgccgacggggcattcaacccatttgctcacgacttcgacatctccacaatcacaactacagttaagggt

SEQ ID NO: 67464 - DNA, 186 bp, Zea mays
  Clone ID: LIB3076-053-Q1-E1-G3
cgcgcagagcggtcatcctgaccggctgcaacgctgagtacttcgtccccgagaagaaccagggcagcggcattcggaagcggtgggcgcaataagtgcgtgggcctcttggcgacctgcgcgagcaatcgtctcaccacgaaactgcgcatctaggccaaagtttccatcgcggcttgtggggca

SEQ ID NO: 67465 - DNA, 313 bp, Zea mays
  Clone ID: LIB3076-053-Q1-E1-G6
cccacgcgtccgcacaggggaacttggtacaaccatccatggtatcagaatatgacctgggaggagaaggggacctgttcaaagctccagaagccatcatcgaggaaccgctgctcctgaactgtctgtctgattctgttcatttgttgttgtgtaggctgggcttgtgccaagcttgaatcctcttgtgaaggagtttttcaatgctgctgatgacaagcggaaggaagtcctctctaaaatagaagaggatgttgctaagctcagcggttctgcagccaactaagaagctacaagtgaatgccgaggagag

SEQ ID NO: 67466 - DNA, 285 bp, Zea mays
  Clone ID: LIB3076-053-Q1-E1-G7
gaaacacgcgtacgcccacgcgtccgcacaggggaacttggtacaaccatccatggtatcagaatatgacctgggaggagaaggggacctgttcaaagctccagaagccatcatcgaggaaccgctgctcctgaactgtctgtctgattctgttcatttgttgttgtgtaggctgggcttgtgccaagcttgaatcctcttgtgaaggagtttttcaatgctgctgatgacaagcgggaggaagtcctctctaaaatagaagaggatgttgctaagctcaacggt

SEQ ID NO: 67467 - DNA, 383 bp, Zea mays
  Clone ID: LIB3076-053-Q1-E1-G8
ccgttattgacagtgaccttgttctggtccttagtgatggtaaaatcgcagagttcgacacgccccagaggcttttagaggacaagtcatctatgttcatacagctagtatcggaatactccactcggtcgagctgtatatagagaggctgcttaaaaccccgccccaaacctggcaacagaggctgggaggcaaatagcccgtatctgccagtgtacttgcttgcgccatagaggtccctgcgaacaccggagggcggcgtagaagacgaggtgtacatgagtgggaggaacactgggcgttccctgacctgaataccgtggaatcggcgagggagcgcggttggtattggtaggcaccaagggaggagttggtgacactag

SEQ ID NO: 67468 - DNA, 194 bp, Zea mays
  Clone ID: LIB3076-053-Q1-E1-C8
gaaacacgcgtccgcccacgcgtccgcccagtcttacgcccattcactctgctgtctccttgtgataagttctaaaaattacttgcacttttgtgggtggacgatcaagagggtcaaggattatcatacactatcattcaacctcagagtacttctatactgtcacatattttcatttcactggccattgtttt

SEQ ID NO: 67469 - DNA, 217 bp, Zea mays
  Clone ID: LIB3076-053-Q1-E1-D1
acgcaaacatacacgcctccgtacacgcgtcatcccagccgttcacagctttctggggtctccagttcccgccgccggtccagtcccgtggcgggagaccaagagggagtggatttcgatgcacatcaggcatacccgtatccagttcagaaaggcatgcatgtagactgtcacggcttgaccatggaaatcatgctgactgtgaaatgcccggtga

SEQ ID NO: 67470 - DNA, 384 bp, Zea mays
  Clone ID: LIB3076-053-Q1-E1-D2
acgcccaaacgtccggagcaagccaaggctcaatccgaagctcacaggctgcaagcaatgtggatgtgcacagtttccggaccgattggctcaagaacagcaagattggcagaagcaggagcgtgcattacacatctcctgggaacctggacaacgggatgcttcggttctatctgacaccaatgagaagctccagaactgcgaacagggggaggaggagaagttcgcgcttgtttgcgcgaggacttttcggtttcatataagtggctcaagtagagcgttagcccatgccatgcgtttttttaaagatggcagcagcagaagcaacttttctttgggatctacttggtttctaaggattggcatcctcgtaagttgtccgtc

SEQ ID NO: 67471 - DNA, 376 bp, Zea mays
  Clone ID: LIB3076-053-Q1-E1-D8
cgaaacacgcgaccgcggacgcgtgggcgcgcacgccctgtcccggccgcgcgcgcgccctgtcccggccaccgagctccggccaccgcgcagcgagctcagcgaccgcgcgcgccgttccctgtcgcgctcgccgttccccgccgcgcagaactcagaaggtgttcttccgacttgaccttctccaccgttagctggactcgtacgcgatctcaggatggcacagttccacttgttggaccctcactacgacgagcaccacaggggccgtctcaccgcagagggagaggtgttgcccgttctgcgggtccggacccacgaccggtttctgggggagatgaggtacgatgagaggtagactcctcgtcctacagag

SEQ ID NO: 67472 - DNA, 373 bp, Zea mays
  Clone ID: LIB3076-053-Q1-E1-E1
aggcccacacgtcggcccacgcgtctgcacttcttcagcggcagcgtggcaacgagaggaacgaagtattcagaccgaagacaatggacccggtgcggaacagcgtgtgcgtgaccggtgctggcggcttcgtcgcgtcggatctggtgaagctcctcctctcccggagcgaagacgcggtctgcgggaccgtgcacgagtctggtgctaccacgaatgcccagctcaaggtgctggcaggagctgaggaaacgttgcaacttctcaatgctgatctgatggactacaacagcgattgcatcagcacttgccggctgtcatggtgtcttccatgtagccaatcctgtcgtttctcatcgaccctccaaccctg

SEQ ID NO: 67473 - DNA, 471 bp, Zea mays
  Clone ID: LIB3076-053-Q1-E1-E11
ttcttttttttttttttttttatgttcttttttttttttttttatttttttttttttttttttttttttatttattttttatttttttttttggtgtatgtggttttcttttttctttttaaatttttttttttctttttttttttcttttttcttttttttttttctttttttcttttttctctctttttttttattttctttttttatttttattttctttttttcttttttcttttttctttttttttttttttcttatttttttttttctttttttctttttctttttttcttttttcttttttttttttttttattctctttttctttttttcttttttttttattctattttttttctcttatttttcttatcttttttttctttttttctttttttttactcttttatctttttttttttttttcttttttattcttttattttttttctctttctttttcttt

SEQ ID NO: 67474 - DNA, 308 bp, Zea mays
  Clone ID: LIB3076-053-Q1-E1-E12
gctggcgggactaggaaggagacaagtgaactcagagaagaactaccgcggcgggcgagcattgcaagccgagctgcaggggcccggagcggagaccggacgacggagacgtcgcttgcgatgtcgggggcaggatccgccgccgaaaccgccgtcgtcggcgtcgtcgcaagcgtccctagccagcagcagagcagtcaccgcgccgcggcgccgtccgtcccgtcgtcctaccccgtctgggagaacgagcggtaacgcggctgcagctttacgacgtcatcgtcgtcgctctgccacctgcccta

SEQ ID NO: 67475 - DNA, 170 bp, Zea mays
  Clone ID: LIB3076-053-Q1-E1-E2
ttcagttctgaggcagtggtcccgttgcggttcggcgtgtgcgtggccgttgctggcgggttcgtcgcgtcggctcttttgcggctcctcggcgccccgggcgatgaggcggtctcggggactcgtgcacgactctgatgttgcctcgaagtctcagttcaaggtgttgt

SEQ ID NO: 67476 - DNA, 375 bp, Zea mays
  Clone ID: LIB3076-053-Q1-E1-E3
acgcccaacgctccgtccccgcggcccaccaaccgccgccgccgccgcagccatgcacggccgccggcacctcgcggcgtcccttacccgggccctgatccaggcgccatcccgctccatctcttccaccccgtctctcctccaaaccctcgacccctcagtgccgtcgcctcccgccgcgggagcagggcggctcgcggagctgcggcggcggctgcaggcggacgcgccgtcgctgggtgacttcacgtactcagtggaggtggggacgcggcagccgcccgctgcccaagcccaagtggatgaatgagaccgtgcctggcggcgccaagtacgcggccatcaaggccaagctgcgggagctgaagctgcaca

SEQ ID NO: 67477 - DNA, 172 bp, Zea mays
  Clone ID: LIB3076-053-Q1-E1-E4
gcccaaagctccgtccccgcggcccaccaaccgccgccgccgcctcacccattcattgccgtcggtacctctcgtcgtcccttacctgggctctgatccatccggcatcgggggccatctcttccacaccgtctctcctctatactctccgagcctcagtgctcgtcccctc

SEQ ID NO: 67478 - DNA, 179 bp, Zea mays
  Clone ID: LIB3076-053-Q1-E1-E5
tttcttgctagttggactaggttctgacggttgctgatttatgtgcatgtcgcggggcgcgtaagtattcctatcgtggcacaaaccctcggatcagagtaccggagcgcgtacctcggcccataagtgcaagggagcacaccctgacgaacacccaggagaactaccccactgcgaaa

SEQ ID NO: 67479 - DNA, 362 bp, Zea mays
  Clone ID: LIB3076-053-Q1-E1-E7
atctacctcgaggggttgtttgcatcttattgatcttgctggtagtgagagggtggagaagtctgaagtaactggggatagattaaaagaagctcaatacatcaacaaatcactttctgcgttaggcgatgtgatttttgctctgtcacagaaaagtatccacgtgccttatagaaacagcaagctaacacaagttcttcaaagttctttaggtggacaagcaaaaactctaatgttcgttcaaataaatcctgatgttgagtcatattcagaaactataagcactttaaagtttgctgaaagggtgtctggagtagagttaggtgctgcaagaagcaacaaggaaggaaaagatattaaag

SEQ ID NO: 67480 - DNA, 329 bp, Zea mays
  Clone ID: LIB3076-053-Q1-E1-E8
ggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacg

SEQ ID NO: 67481 - DNA, 376 bp, Zea mays
  Clone ID: LIB3076-053-Q1-E1-C6
cggacgcgtgggtgttgttttagtattttcatgttccttttccttgtgtcatgttctaagaagtatttgcactttgataagtgggcgactaaatcatatgcccatgtcaaacactaaatttgcatctgggatattcaacaaactatgcagatgtttagaacagcaagcactgacaatgaagctgtgatgtcaaaggcgccatcgaggcctgttaacaagccagtcatcaaagatataaggcgagcaggcaattataagtacagaatcgatgaattgaatgacccacctgtacgccatcctgggatacgttctttgctgcccttgccaggtggtgatctattaactggaggaacagatttgaagattcgttactggg

SEQ ID NO: 67482 - DNA, 335 bp, Zea mays
  Clone ID: LIB3076-053-Q1-E1-F1
cgagcccgcgtccggagagagcaagggacggggcgactattagctagtactagtagcgaaaaattaaggggaaacgacaacgacgcacggcggcatggcggccggccaccacgggcagccgccggacggggacgacgggcggccgtcggtcgtcggcggggagcatgaccggctgctgcccatcgccaacgtcggccgcatcatgaagcaaatcctgccgcccaacgccaagatctccaaggacgccaaggagacgatgcacgagtgcgtgtccgagttcatccgcttcgtcaccggcgaggcctccgacaagtgccacaaggagaagcgcaaga

SEQ ID NO: 67483 - DNA, 377 bp, Zea mays
  Clone ID: LIB3076-053-Q1-E1-A5
gctcgttggactaggttctgcccgttgctgctcgatcctggtctgcgtgggctgcgtccggactcgcccctgcttctggggcgaagagattttaagagcgccgagtagtttactgcgtccaaagaagggcctacgactaagagggtttaaggatggaagtgtcccgggacgaagaaccccaagaagagacggccctgtccgattaattacgaacccattcattataaaagtaaaggggattagttctcccatagtacctttactgagaatacttcggtagcggaaaactcggaggaggagctccctaaaacgaacaatacgccttaggctacctagttagagtgcgtgtcgcatacctaggttaatattcgtgcgga

SEQ ID NO: 67484 - DNA, 380 bp, Zea mays
  Clone ID: LIB3076-053-Q1-E1-A6
cggacgcgtgggctcgacgccggctgcggccaccacgctgacgctccacaacctgtgtccgtaccccgtatggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgagacgggaagcgttgcgccggcgacggtggtgcagctggtggtgcacgcggaggggcaagacctggcgtcgtacagcgtgagcctggtggacgggttcaacgtgcccgctgtggtgagcccgcaggcggtgggcggcgggcagtgcc

SEQ ID NO: 67485 - DNA, 307 bp, Zea mays
  Clone ID: LIB3076-053-Q1-E1-A7
cgaaacacgcgaacgcggacgcgtgggctcgacgccggctgcggccaccacgctgacgctccacaacctgtgtccgtaccccgtatggccgctggtgagcccgaacaccgggttccccgcgcatctccgagaacacgggccgcctcgacggcggcgggcgcgggctggtctccttccgcttcccggacagcttctgggcgggccacgtggtggcgcccacgggatgcagctccgggcattcccggtgccaaacgggaagcgttgcgccggcgactgtcgtgcagctggtggtgcacgccgaggggca

SEQ ID NO: 67486 - DNA, 377 bp, Zea mays
  Clone ID: LIB3076-053-Q1-E1-B1
acgcggacacgtgggttcctccctcgccatggccctctttgctgccgcacgccgcgccgcgtcctcctccgtgcccgtcctcctccgtgcctccgcctcctcggggtcccaccgcagcgccgtcctgctccggcccctcgctgccgccgtggcgccgccgaagccccgcgcgatgccgttctcctcggcgcccgcgacgagacccagctccgacgccgagctactcagcgtcatcgactccgagatcaagtacgccgaggactgcgatgaccacgacagggttgaggagattccagaaaatttccctttcaaaatcagcgacgagaaggggacgaatgcagttacccttaaaagaacatatcagggtgagcagattg

SEQ ID NO: 67487 - DNA, 172 bp, Zea mays
  Clone ID: LIB3076-053-Q1-E1-B2
tggttcctccctctccatgggcctctttgctgccgcatgcctcgccgcgtcctcctccgtgcccgtcctcctccgtgcctccgcctcctcgcggttttaggggtgcgtcgtcctgttccggcccctctctgcggctgtggcgccgcctgttgcctctttctatggcgttctc

SEQ ID NO: 67488 - DNA, 192 bp, Zea mays
  Clone ID: LIB3076-053-Q1-E1-B3
ggccacgtgggttcctccctcgccctggccctctttgctgccgctcgccgctccgcgtcctggtccgtgcccgtcctcctccgtgcctccgcctcctctgggtccctgggcggcgccgtcctgctccggcccctcgctgccgccgtggcgccgccgtcgctccgcgtcctgtctttctcctcggcgcccgcg

SEQ ID NO: 67489 - DNA, 114 bp, Zea mays
  Clone ID: LIB3076-053-Q1-E1-B4
acggtttatttttcatcgggtcagtggtggaactgcgaggttgtggttttatcatgtaggcaaatttgccaaatgtgtacatcggaaatatgggaataaaagcctttatcgatc

SEQ ID NO: 67490 - DNA, 350 bp, Zea mays
  Clone ID: LIB3076-053-Q1-E1-B7
cccacgcgtccgcggacgcgtgggcgcgagcggccgctcgcgatctagaactagcttttttttttttttttttaaacgggaatttcagttctcatagcattagcatgaatctcagaacataacaggtgaaacacgaatcaagcagaggcgccatggggttcacagatccacacctaaaccgctaaattaaactgcgagcgatacatgataaactaagaccaccactcagatcaccagcatcttattcagatccaaaggaacggacgcagggggagtcgacgatgacggagggagggcggccgaacagaccagatcagagagatctaggagagctgtccgcagtcagcgac

SEQ ID NO: 67491 - DNA, 140 bp, Zea mays
  Clone ID: LIB3076-053-Q1-E1-B8
tctacaactatcttttttttttttttttttacgccgtaatttcaattctcatggcactggggggatccccaaaagataataagtgagacactaatcgaacagacgcgccatgtggttcatagctccacacctaaaacgct

SEQ ID NO: 67492 - DNA, 272 bp, Zea mays
  Clone ID: LIB3076-053-Q1-E1-C10
gggagctttactgcctctagcatggcattcaagctgatggtcatatacccggtcacaacactattgggggtggtgatgatgctttcaacacgttcttcaggggagactggtgctgggaagcacgtccctcatgcggtttttgttgaccttgagccaactgtcatccatgatgttcggactggtacctaacgtcatctcttccaccctgtacatcttatcaatggcaaggacgatgcagccaacaacctctcccgttggcactacaccattgg

SEQ ID NO: 67493 - DNA, 385 bp, Zea mays
  Clone ID: LIB3076-053-Q1-E1-A4
acgcggacgcgtgggggacgggagagcgacctcagcagacaagagccagacgagactcagagagcgagcaccgtgacctctctgtttctctctcttcccttctcgtcttctgcaagaagccacaacaaatgtgaccgtctctgtttctctcatccccttcatcactctgctggtctccctcttccacctctggtcttggccatggcctccagcgcctcccggttcatcaagtgcgtcacagtgggggacggcgccgtgggaaagacctgcatgctcatctgctacaccagcaacaagttccccactgattacatacccactgtcttcgataacttcagtgcaaacgtggtagtcgacggtaccacggtgaatttgggcctttggg

SEQ ID NO: 67494 - DNA, 369 bp, Zea mays
  Clone ID: LIB3076-053-Q1-E1-C2
tgtgactacctttgtttttatgcgatagacaaactaatagctattacatttgcagagttccttttttgcatattttatgtgccttgaagtacaggcacttgttccagctggttctcctaatgctaataagagtaaatccagaggaaatgacccggatgatgatctgtgtcttatggatccagatggcaacaatctgaaacctgatccaccctcccgctcgctttctagccccgtcgccatggcgtcctggctgacgtcgtggatgccaagcccatgcctgcgttgaaagagagggagaccagagacacccagtggccctggcggtagtagtgccaaggttctattcactgtgagtccgcgacgccccat

SEQ ID NO: 67495 - DNA, 263 bp, Zea mays
  Clone ID: LIB3076-053-Q1-E1-C3
tgtgactacctttgtatttatacgagagacaagctagtatctagtacatttggacagttccttttttgcacactttatgtgccgtgaagtacatgcacgtgtgcgagtggttcacctagcgctaataagagtaacgcctcaggaggtttcccggttgatgttctgtgtcataaagatccacatgacaagaatctgaaacctgatacatccgcccgcactcattctagcagcatcgggaattagttctctcatagtacctttac

SEQ ID NO: 67496 - DNA, 354 bp, Zea mays
  Clone ID: LIB3076-052-Q1-E1-G1
cccacgcgtccgcccacgcgtccgcccacgcgtccgccccgcgtccgcggacgcgtgggtgttgatgatgtcaatggagggagacttatcttctatgacttcgggatgatgggaagtatcagtcaaaatatccgggaaggattgcttgaagtattctatggagtttatgaaaaggatcctgacaaagtgcttcaagcaatggttcaaatgggtgtccttgttcctactggagatatgactgctgtcagaagaaccgctcaatttttccttaatagctttcaagagcgcctagcagcacaaaggaaggagagagaaatggcaaccgcagagcttggattcaaaaagcaattaact

SEQ ID NO: 67497 - DNA, 413 bp, Zea mays
  unsure at all n locations
  Clone ID: LIB3076-052-Q1-E1-G10
cagaatgccgggctggggtanaagtggtggtgggaactggggtagaggccctattggtaattgaggaacaacagaatgggtccggcagttggccgtggaatcgggaatggcatggttgcgccgccacccccgatgctgcctcanggaggcatgctggggcaggggtttgatcctggttatggcgccatgggaacgatgggtggtgggtttggtaacttccctgttggaccaagtgctgggccgtttcctgggatgatgcagccatttcctccggttgttgcaccacacataaacccggccttctttggtcgtggtgccaatggggctggtggggtggggatgtggcctgattccggcatgggggcttggagtgtggaagaacaatcaaatttatgggatgatgcagtgtctga

SEQ ID NO: 67498 - DNA, 431 bp, Zea mays
  Clone ID: LIB3076-052-Q1-E1-G12
cccacgcgtccggttggattttgtgcacggatggatgagaactgggtcgccaaggatgagcagttctggtacatggctctgttggttgtctcggttgtctgttacattgccacgttctgtttctcgggtctcctatttcactggttcactccatctggacatgactgcggactcaacctgttcttcattgtcttcacgttgattcttgtttttgcgtttgctattgttgccctgcacccaaagatcaatggaagcttgttgcctgcatcagttattggtatgtactgtacatatctgtgctacagtggactctccagtgagccaagggattacgaatgcaatgggcttcacaatcactcaaaagctgtgtcaactggtagccttacattgggactccttaccacggtcctctccgtggtctaatctgctgt

SEQ ID NO: 67499 - DNA, 413 bp, Zea mays
  Clone ID: LIB3076-052-Q1-E1-G2
aaccgggagattggttctgttggcaaggctatacttgagaatatccatcattttatgtgcatgctgaagggaatccatcagcttcaaaggaaatattagatgcactgcaaagtgccagcaagtctcttggttctgataatgttaaagtaaaacaagcagcttcatcaaatcctggtgttccaccatcttcattaatgtcattcataaggaagaacatgtcaacttctggagttgtgttggaggattttgattcccacttctccaataaattttatcaaaactatctgggatactctgtaaacatcaattcctcgtcaatagctgcagccgcccctttggttgccaggtcgatgtatattcttgctagtgatgactcagttgttgacctttatacactaaacactataaaagtg

SEQ ID NO: 67500 - DNA, 446 bp, Zea mays
  Clone ID: LIB3076-052-Q1-E1-G6
cgcagagataggcgtcttcgtactcgcctacctccgcggccaaacctttcccccttctcccaattcccgccgccgctccatcccgtaacgcgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattgggcaagagattgttgacc

SEQ ID NO: 67501 - DNA, 282 bp, Zea mays
  Clone ID: LIB3076-052-Q1-E1-G8
ggagattggttctgttggcaaggctatacttgagaatatccatcattttatgtgcatgctgaagggaatccatcagcttcaaaggaaatattagatgcactgcaaagtgccagcaagtctcttggttctgataatgttaaagtaaaacaagcagcttcatcaaatcctggtgttccaccatcttcattaatgtcattcataaggaagaacatgtcaacttctggagttgtgttggaggattttgattcccacttctccaataaattttatcatagctatctg

SEQ ID NO: 67502 - DNA, 283 bp, Zea mays
  Clone ID: LIB3076-052-Q1-E1-H1
ggacaggaaacacatcaaccatggcagaggcagagtgccgcgcctcggatcggccgacgacttcgagttctgcatcctgtcgtccggcggcatcgtcccggccggagagagcgcggggacggacatgtgcgtggccgacgaggtcttctgccagggcaagctcctcccgctccgcgcctcctcggccgcagcctccgacggcgccagcgtcgccacgctgccgaggtcggagtcggtggcctccaccgtgggcctggtgtctcggtccggcaacccccatctc

SEQ ID NO: 67503 - DNA, 258 bp, Zea mays
  Clone ID: LIB3076-052-Q1-E1-H10
acagatgacccctctttctgagtttgaggacagctctaaaatttttggctgttggtgatactgtttcatctgccggtttaatcatcaattcgtctactgtaataggagcggacgtcaagattttattttgttttagttgtcaaatgcacctgtttttgaacaatatttgtgatgtattgccctgccgcgcttaaagtccgaaaatattttggtacctgctgtgagtttcaaaaaaaacaaagttggttcgggttaagg

SEQ ID NO: 67504 - DNA, 139 bp, Zea mays
  Clone ID: LIB3076-052-Q1-E1-H11
atctgttagatgtcttctaccggcactatatattttttttgtttgatgtgtaatgatgttactgttcaacgcttattaccctactatactgttggatgttctttggacctgtttcatttcgcacaaggattggacttcc

SEQ ID NO: 67505 - DNA, 273 bp, Zea mays
  Clone ID: LIB3076-052-Q1-E1-H3
agaagaagctgcgcagaacgctataaaaagtcttaacggatgcttataaatgataagcctgtttttgttggaccttttgttcgcaagcaagaaagagatcattcttttgacaagacaaaatttaacaatgtctttgtgaaaaatttgtctgagtctaccacaaaggaagatttactcaaaatctttggtgaatatggggatattacaagtgctgttgtgatgattggtatggatggtaaatcaacgtgctttggtttcatcaattttgagaat

SEQ ID NO: 67506 - DNA, 280 bp, Zea mays
  Clone ID: LIB3076-052-Q1-E1-H4
aatgagcagagcgctagttctgatcttaacgggtgcttagaaatgatacgcctgtttttgttggcccttttgttctcaggcaggaagacacagttgtcttttgacaggacaggggttagcaatgtcgttgtcaaaaatttgtctgagtctaccacaaaggaagatttactcaaaatctttggtgaatatcgggatattacaagtgctgttgtgatgaatggtatggatggtaaatcaacgtgctttgggttcatcaattttgagaacccagatgcagctt

SEQ ID NO: 67507 - DNA, 306 bp, Zea mays
  Clone ID: LIB3076-052-Q1-E1-H5
cgcggacgcgtgggcaacctgctaaacaggattcagtgatgacagcagctctgagagctcctcagacgatgaaccttccaaaaaaccagttgccggtttaaaaaagcctcctgccaattgtagcagcactgatgatagcagtgacagtgatgatagtagctctgatgaggaaccaacaaagaagcccacggtccttttaaagaagcccactgtcctttcaaaaaaacctgtcacagcagtcagtaatggttcaaaacaggtttaaacctgatagcagcagctctgacagtagctcagatgaagatg

SEQ ID NO: 67508 - DNA, 281 bp, Zea mays
  Clone ID: LIB3076-052-Q1-E1-H6
gggcaacctgctaaacaggatccagtgatgacagcagctctgacagctcctcagacgatgaagcttccaaaaaaccaattgccggttcaaaaaagccgcgtgcgagtagtaccaccagtgatcataccagtgccactgacgacactagctctgatgacgaacgcaccaacgaacgcgcacggtcctttcgaagaatcccactgcccgttcacaacaacctgtcacagcagtcactcatcgttcacaacaggttaaccctgatagcaacacctctgacacta

SEQ ID NO: 67509 - DNA, 261 bp, Zea mays
  unsure at all n locations
  Clone ID: LIB3076-052-Q1-E1-H9
cgggaaaaaaataacccctctttcgattttgagcaactccaaaattttggctgttggtgatactgtttcatctgccggtttaatcatcaattcgtctactgtaatagcagcgacttcaatattttattttgttttagttgtcaaatgcacctgtttttgaacaatatttgtgatgtantgccctgccgcgcttaaagtctgagactattttgttatctgctgtgatgtttcacatgaaacagagttgatgtctggtttagt

SEQ ID NO: 67510 - DNA, 430 bp, Zea mays
  Clone ID: LIB3076-053-Q1-E1-A10
gcggtggcagcagctctagaacgacggatccccgggcagcagggatactcgacaatctcacagacatccgttactgatcaacttgtctcattaattaccgccccagaaagaaatcggaaggaaatctagagatgcatccatgaatcgggagtcggcttagaccaaaagctgacaaacttgacgaaagctgaaaatatcgatgttgaaggactttttatagttttactaatgatggggatcccattgattgatgagatacgggaaaattcagcatcaatttataaataatgaaaatgtactggagaatggatttacatacagaagacatacattggtcaccactcatgattagtgataccgtgtacagcattctcccggggcgatcgaaaggcagcactgtagggtacgtacgacagctttttcagacata

SEQ ID NO: 67511 - DNA, 322 bp, Zea mays
  Clone ID: LIB3076-053-Q1-E1-A2
acgtgcaggcctgggtaaacgccttggtatacgcattggaactgggactgtaccaggtagtgtaccacctcgacgatctgcactgctgtcagcatggctggcatcgtgtcagggactggattaagcaaaggtgtaggggcagcttgaatggcagcgttaatgagaatggccaacatgatatccacgttgctacacttcgatacatctgtcgagatctatgtcattgtcgagttccttgtcgtcatgcttgtcctcaaattcaactgcatctgaaactactgcgtcaatgatggattcgttgcggcgtgtgtattgtcagctg

SEQ ID NO: 67512 - DNA, 394 bp, Zea mays
  Clone ID: LIB3076-053-Q1-E1-A3
tcgacgcacgcgtacgcccacacgtccgtgggaagaagctggaagttaactactcaaagtaccctaacattacacctgccccagatgcccacgactacttgaactcgagcctaaaccgattcaacagcaacatggtaaaaaactaccgacattgctgctctccaacaaagatgatccacatctctgccctcccccaagagatctctgaggaagcaatcctgaaccatttgtctgagcacggtactgttgtcaacaccaagctatttgaggtgaatggcaagaggcacgctctcgttttatttgagactgaagaggcagcgaccgaggccctcgtgtcaaagcatgccagcacacttgaaggtaacacgatccgggatctctttctcccagatgc

SEQ ID NO: 67513 - DNA, 220 bp, Zea mays
  Clone ID: LIB3076-052-Q1-E1-F8
tttccggaaccacctggaggagacgctgccgcgtgggagggacaagtacctcgcctacaaggccctcaagaagctcatcaaaaacctgctgccacgctatcccgcggggggggggcctctccctcctcctgcctccgccggcgccgacacctacgggccgggggctcctgccgccgcgcaagggaacttcaacctggccaactggttcgccagcatcctt

SEQ ID NO: 67514 - DNA, 105 bp, Zea mays
  Clone ID: LIB3076-052-Q1-E1-C6
cgtccaaaaaaaaatcggcgggcgcgtggtggcgcgcacggatgcagctccgggcattcccggtgcgagacgggaagcgttgcgccggcgacggtggtgcacctg

SEQ ID NO: 67515 - DNA, 408 bp, Zea mays
  unsure at all n locations
  Clone ID: LIB3076-052-Q1-E1-C8
cccacgcgtccgcccacgcgtccgctcttactgaagttatacaatggaatcaagcagaagtggactaggccctgtgaaagccattgtcttttcccaatggactggcatgctggatttgctggagctttcactgaatatcaactgtatacagtacaggagactagatggaacaatgtctctcaatttaagagaaaaaaatgtgaaggattttaacactgacccagaggttagagttatgattatgtcactgaaagctggtaatcttggtctcaacatggtttctgcttgccatgtaattctccttgatctctggtggaacccttatgctgaggaccaagcagttgatanggcacacaggattgggcagactaggcctgttactgtatctcgcttgaccgttaaagacac

SEQ ID NO: 67516 - DNA, 243 bp, Zea mays
  Clone ID: LIB3076-052-Q1-E1-C9
atttcccccaacccaatcggccccaatctccgctctccccactcctttcacatttcgcgaaactgtaagtggcggccggcggacaccggcgaggaggcgacggaccgacggcgcactccgtcgaggggacgcggaagacgtattcggcaacctacgagccaaggaggcgacgcggtgcggcgctgaacaccgtgccggaggcccggagcggcgggcgcaaccggcttggccgggcggtgtccg

SEQ ID NO: 67517 - DNA, 401 bp, Zea mays
  unsure at all n locations
  Clone ID: LIB3076-052-Q1-E1-D1
accacgcgtccgcaccagcctcgtcgttaggacgtaaggaagacacccaggggcgagccagtgagtacagagagtagccttacgtagcgaagctcagagcaagcgagggtacggtcaaggggggtgatggcgctgtctcgacgcatggcggctcccgtcctcgtcctcatgctcctcctcgtcgccacagagctggggacgaccaaggtggcggaggcgaggcactgcctgtcgcagagccaccggttcaagggcctgtgcatgagcagcaacaactgcgccaacgtgtgccagaccgagaacttcccccgcggggagtgtaaggcgganggcgccacgcgcaagtgcttctgcaagaagatatgccagtactaccctcggctttgctggcacaagcaggt

SEQ ID NO: 67518 - DNA, 129 bp, Zea mays
  Clone ID: LIB3076-052-Q1-E1-D12
cgtccgacacgctgcgacaaacgacacgtatcctatacaggcgcttctcaccatttccacattaaagcttcgtatggtatgctcctgagagtgaccctgagggggagggggggccttcattttcaatga

SEQ ID NO: 67519 - DNA, 408 bp, Zea mays
  unsure at all n locations
  Clone ID: LIB3076-052-Q1-E1-D2
attcaataagccttggggcagcttctactgtttgtgggtggtcattggttcaatggctgttgcgcaaatattttcctctgtttacttcagtgcatggtccaacaagtcatatttcaaaccgcttgttttcagtagcattgttttgttcttggggaatgtatgctatgcaatggcatatgatatgaagtccctaacagtccttattatcggccgtttactctgtgggatgggttctgcaagagctgtcaatcgccggtacattagtgattgtgtcnctgcaagaatacgcatgcaagcttcggcaggattcgttagcgcaagtgcacttggcatggcctgtgggccagcgctagctggtttacttcaatggaaattcaagatctacatggttacgttcaatcaatcgac

SEQ ID NO: 67520 - DNA, 436 bp, Zea mays
  Clone ID: LIB3076-052-Q1-E1-D6
acctcaacgaacatcagtctgacagagaagaattcttgagctctgcaggagggttgagtacaccataagggcttggtaccatctccagtttgatgatatgatggaactgttcgctctcttcgatcctgtgcatggtgctaaaaaactcgagcagcagaacttcctacctgaggaaatcgacacgcttgagcagaacttcctgtcctatttctttcggtgcaggtgatggaaaagagcaattttaacatagtaaatgacgatgaggttgaacttgctcattctggacaatatctgttgaatcttcccattaaagttgatgaatcaaagttagatgacaaacttctgtcgaagtattttaaggagcaccgtcatgaaaacctgccccacttctcagacaaatatgttatatttcgtaggggcattggattggaccgca

SEQ ID NO: 67521 - DNA, 360 bp, Zea mays
  Clone ID: LIB3076-052-Q1-E1-D9
cccacgcgtccggaaaaaggggaaaaggggctgtgcgcaaaaccctagcacagtcgcatccatcatggcgatgtccatcttcggcggctgcgtcggcggcgactccggtgcgctcatcgcgccgtccgcgtcctcgctccgcccgccgttccgtcttgtcgctggtcccaagggccatttttgtacttttcctcatggagcatctagcaatcacagccggctatgtgttcaacatcaaaggtgttctcgcagctccacccagaactatgctctttctaggaaggatttttctcctataactcaagatgtggaaggcttccttcacaatgttgttaacatgggttttcttgaccgtctgaa

SEQ ID NO: 67522 - DNA, 230 bp, Zea mays
  Clone ID: LIB3076-052-Q1-E1-E10
gttccaccacgtgaacgctttctggtgacccaccttagacagtttgtacctagatacaagcaaggcatcttacagcaagcaagaaagcttttccatgaagctgggaacgacgctcctgcatgtgaaaagacccccgtagatttacatttggcagtccctgaaggagactctggacttgcccatcgtgctcagcatgtacttgatgaagacggtcgacctgtttcaacctc

SEQ ID NO: 67523 - DNA, 367 bp, Zea mays
  Clone ID: LIB3076-052-Q1-E1-E11
cccacgcgtccgtgtccatcaacgtcccaagttgcagagggcattgaatttgggaggcaaccaatggtcacatcctccactttggtagagctaacaactagactagatttcttcaaggagcgaaggtcgcaactgatggaacaacttcatagccttgatttgggacgtggatctgctccgcaaggttttccattcaagccaccctctccttggaaccacccaaggtaggaggatgaccgttcgatttcatgattgtaaattcttcagtagtggttcttttctccccgcctggcgattgcagaaaactgcatatacgagtgtaaatgtattttgctcttcgatatggttttagctttcgtgttgtgcg

SEQ ID NO: 67524 - DNA, 322 bp, Zea mays
  Clone ID: LIB3076-052-Q1-E1-E12
cccacgcgtccgggtaatcgagtactgcaacaacacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaatatcaagaatgacttcacccctg

SEQ ID NO: 67525 - DNA, 401 bp, Zea mays
  unsure at all n locations
  Clone ID: LIB3076-052-Q1-E1-E4
cagacgcgtgggcggacgcgtggggcgccaagctcgtcttctcccagagatatgggaatggtccgtattcanatgacagcttccagagtacgcggaggacattgaagctgggggagatgcggccccttcattttcaatgatgtcggaggttgctcgcancttacaagtcactcttgttggtgggtccatagctgaacgttcgggaaacaacttatacaatacatgctgcatctttggttcagatggcaaacttaagggtaaacatagaaagattcatctttttgacattgacattccaggaaagatcactttcaaggaatcgaagactcttactgctgggcattatcctactgttgtagacacagatgttgggcgaattggtattgggatatgttatgaca

SEQ ID NO: 67526 - DNA, 269 bp, Zea mays
  unsure at all n locations
  Clone ID: LIB3076-052-Q1-E1-E7
gacgccgccgacgagtgctccgagcatcaaccgcctcggccacgaaccctaaaccgcggaacgacgcgcgccggtcgtccccggaggtcgtcgtcgacgctaaagcgagaaggctgctgggcaggagctcgtcggacatgaacaaccaccaagacgcaagggtggccgccctggtcaggangaacgtggcgctggaagagcaactgtcggcggcgctggcgagcaaggacgaagcggagaagaacctgtccctggtcatcgacagcaaa

SEQ ID NO: 67527 - DNA, 168 bp, Zea mays
  Clone ID: LIB3076-052-Q1-E1-E8
ccgccgaggcagtgctccgagcatcacccgcctctggcactacccctaaatcgcggaaccacccccgccggtcctccccggaggtcctcatcgacgctaaacctaggaggctgctgggcaagacctcttctgacataaagaaccaccaccactcactggtggccgccc

SEQ ID NO: 67528 - DNA, 349 bp, Zea mays
  unsure at all n locations
  Clone ID: LIB3076-052-Q1-E1-C1
cggacgagtgggcggagcctctccttcccggtctcctcccccgttgccttcgtcncctccatctccggctgcgacgccggcgagcccgacaccgcgaatcggatccgccgacaaggcgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacaaga

SEQ ID NO: 67529 - DNA, 342 bp, Zea mays
  Clone ID: LIB3076-052-Q1-E1-E9
ccgcattcgttccaactcctgagcactttctcccgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccacggacaacaagaagactcgc

SEQ ID NO: 67530 - DNA, 79 bp, Zea mays
  Clone ID: LIB3076-052-Q1-E1-F3
aaaatgtatacagtcctaggtttttagtaacaatgatacttgcaacctttgtctggctgttatcaggttctaatggcgc

SEQ ID NO: 67531 - DNA, 56 bp, Zea mays
  Clone ID: LIB3076-052-Q1-E1-F4
aaaataagggcaactcgtgcagcttttggaatcatccgacacccagcaaatctgaa

SEQ ID NO: 67532 - DNA, 383 bp, Zea mays
  unsure at all n locations
  Clone ID: LIB3076-052-Q1-E1-F7
ggatttccggaaccacctggaggagacgctgccgcgtggagggacaagtacctcgcctacaaggccctcaagaagctcatcaagaacctggtgccacgcgagcccgcagcggcccctcctctccctcctcctgcccccgccgccgccgacgccgaggggccgggggctcctgccgccgcgcacgggaacgtcaacctggccaactggttcgccagcatcctcgacgcggagctgcacaagctcaacgagttctacatcgagagggaggagtggtacgtcatccgcctccangtgctcaaggagaggattgagcgcgtcaaggctaanaagaatgacgcttttacatccaggagtgagttttacgaagaaatgttagagatacg

SEQ ID NO: 67533 - DNA, 371 bp, Zea mays
  Clone ID: LIB3076-049-Q1-K1-G11
aaaacggagagaggaggctgcagcaagagctggcattgtcattgaggagaaaaaattggcctgcttttatgccactcatgcatcatgatatcatcaatgagataccgagtcaccttcaaagaatgcaatatgttgcatttgcctcgtttcttgagttggtttgctgcctcttctggaatgtcatagcagttactacagcttggatcaagggggaaggtgttaagatctggttattggcaataatttacttcatatctggtgttcctggtgcatatgttttgtggtatcgtcctctgtataatgcaatgaggactgatagtgcattgaagtttggattggtcttcttgctttacttgttccatattcttttc

SEQ ID NO: 67534 - DNA, 267 bp, Zea mays
  Clone ID: LIB3076-049-Q1-K1-G12
gagagaccaggctgcagcacgatcttgcattgacattgaggacaaaaatttgccgcgcctttatgggactcatgcatcatgatatcatcaatgatataccgactcaccttcaaagaatgcaatacgttgcatttgcctcgtttcttgagccagtttgctacctactctggaatgtcataacacttactacagcttggatcaaggtggaaagtgttaatatctggctatcggcaataatttacttcatatctgacgacactggtgcat

SEQ ID NO: 67535 - DNA, 375 bp, Zea mays
  Clone ID: LIB3076-049-Q1-K1-H11
ctgaatgtgtttcccaaaatacatgatgccgatctagacaagattagccatgtttatgctgaactccggcgtgaatcctctcatggccaaggggttcctattgcagtaaggcatatagagtcaatcatccggatgtcggaggcacatgcaaggatgcatctgaggagctacgtgtctcaggaagatgttgacatggccatccgtgtcttgcttgactcttttatttcgactcagaagttcggtgtgcagaaagcacttcaaaagaatttccggaagtacatgacattcaagaaggactacaacgagctgctcctgctgctcctgcgcacactggtcaaggacgccgtgcacttcgaagaaatcatggcaggatca

SEQ ID NO: 67536 - DNA, 286 bp, Zea mays
  Clone ID: LIB3076-049-Q1-K1-H9
actagttctagatcgcgagcagattttcgtccaaaaaaaataaaaaaaaaaaaaaaaaagggcaaacaatgtaaaaaagtccaaccttacatactcgatcatgcaacataatcacctccattatactgtaaactaaattcaatttactacccaaattcatacaacttcccgactgttaaaaccctggcgactcccaaatcaatggccttacccaacataatcgtttcgcaagatatcctaatttcgaaaagtcccgtaccaatcaacattcccaacactttcgcac

SEQ ID NO: 67537 - DNA, 395 bp, Zea mays
  Clone ID: LIB3076-052-Q1-E1-A10
atccactccaaacaaggggaaggcgagcgacagcaaacccaccccatcgcccctcctctgtctcctctcttgcccacccgccccaatgtcgccgcccctcgagccccacgactacatcggcctctccgcctccaggagcaaggcgccggcggaggaggccgcgtccggagctgggcccatgtacgtgaaggtgagcatggatggcgcgccctacctcaggaaggtggacatcaagatgtactccagctacgaggacctctccctggcgctcgagaagatgttcagctgcttcatcgctggtcaaagtggtctgcataaatcatcgagcaaagacaggctgactaatggctcacaggtggatgccctcaaaagacaggagtatgtccttacatatg

SEQ ID NO: 67538 - DNA, 254 bp, Zea mays
  Clone ID: LIB3076-052-Q1-E1-A11
ccacgcatccgaggacgcgtgggcggacgcgtgggaaaaaaaaaaaaaaaaaaaaaataaaaaaaaaaaaaataataacaatattatagcacaacaaaaaaaataaaataataattaaaaggggggggggaaatattaacaacaggggcggcccctctaaaaatttcaactttacttatccttttatgcaacttcaaacctcttctaaattttcccctaaatttaattccctgggccttttttttaaaactttt

SEQ ID NO: 67539 - DNA, 372 bp, Zea mays
  Clone ID: LIB3076-052-Q1-E1-A12
aaccacgcgtccgcttatatgaattgaaactagattgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttctcgaattttggcggtatgggtggtatgggtggcatgggtgatatggctggcttgggtggtcttggtggcatgggtggaatgggcggtatgggtggtatgggaatggatgattttgaggatgatagtgatga

SEQ ID NO: 67540 - DNA, 402 bp, Zea mays
  unsure at all n locations
  Clone ID: LIB3076-052-Q1-E1-A3
aggacgcgtgggctcccatctcccaagacctcctcagaccgagaagcgcagctgcggccatggacgccaccggcactggagctggagggaaggcgaagaagggagcggccggtcgcaaggccggcgggccgaggaagaagtcggtgacgaggtccgtgaaggccgggctccanttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcancgacgaggagctcgggaagctgctgaccggcgtga

SEQ ID NO: 67541 - DNA, 324 bp, Zea mays
  unsure at all n locations
  Clone ID: LIB3076-052-Q1-E1-A7
agggacagtgggcggagagctcgatcgctgcacactacttcactggaggtccgcccactcccatggaggagatcacgcaacacttttggagttggcgcaagcagccacgggccatgggcacggggcagcanncacatcatcancagcaacaacaacccgtgggcatcctccctcagcgccgtcgtancgccgctgccgccgcaaccgccaagcgcaggcctgccgctgaccctgaacacggtggcggccactgggaacagcggcggtagcggcaacccggtgctgcagcttgccaacggtggcgggcctcctcgacgcatgcgt

SEQ ID NO: 67542 - DNA, 394 bp, Zea mays
  unsure at all n locations
  Clone ID: LIB3076-052-Q1-E1-A8
cgctgctcccacctctagcccgacaggtgaagccccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcatgtgatatggttcttgcttctgcttactcgcatgagttgccacgatatggtcttgaagttggtctgnacaactatgcagctgcctactgcactggccttctgttggct

SEQ ID NO: 67543 - DNA, 271 bp, Zea mays
  unsure at all n locations
  Clone ID: LIB3076-052-Q1-E1-A9
aatccgaaaacgtattagtttgtataatggggagtcctattcgttgaaactattatcgtgaactagtctggaactgtaattcgtgtctaatatctaattctcgtctgcaattgctctcggtttagggttcactanaataaaaaaaaaaagaaaaataaaaaaaaaaaaaaaaaaaacaaaaaaaaagaaaaataanaaaaaaaaaaaaaaataaaataaaaccaaaataaaaatttgttatacaaattaaaaacgggggggcggctcaaaa

SEQ ID NO: 67544 - DNA, 354 bp, Zea mays
  Clone ID: LIB3076-052-Q1-E1-B10
accaagcgtccgggcgagtttcaggatttgggtcagaagaatcgggaaattccgaacatggagacgaacatggtgaagatgagaaattggcaaacaattccattagcagagggtcagggccaaataaatcttgtgattatggcagacaattcgggaatttgcactcaattcctgaaacaggaaatgatcatcttgtactgaacatggatgctattgtcagatgtgatgcacaaatatctgttaccagggctcaagccgtcacttattaataaattgtggattggaatgaaactccgctgcctgacaatgacagtgtccaccctgggaaaaagagaaaacgccttctgacagaag

SEQ ID NO: 67545 - DNA, 97 bp, Zea mays
  unsure at all n locations
  Clone ID: LIB3076-052-Q1-E1-B12
aaatnngacctcctttctctttctttttccctcctttcattgactgtacaaaagaacagagcctaacctttaattttcattttctattaaaatgccc

SEQ ID NO: 67546 - DNA, 368 bp, Zea mays
  Clone ID: LIB3076-052-Q1-E1-B2
cacacgagtccgcggacgcgtgggcgcgcgccagaccgctccccttccccgcctccggtgcccaagccaggccaacagttttgaggtggtaatggcggaccaagctaaccaacccactgtccttcataagctaggtggccagttccacctgagctccagcttctctgaaggtgtacgggcccgtaacatctgcctttctttctcatcttatgaaaggagatttgccacgaggaactacatgacccaaagcctttggggcccttcaatgtctgttagcggtggcatcaatgttccagtgatgccgactccgctttttgccaatgctccagccgagaaaggtggcaaaaacttcatgattgatttcatga

SEQ ID NO: 67547 - DNA, 133 bp, Zea mays
  unsure at all n locations
  Clone ID: LIB3076-052-Q1-E1-B4
aactaattctagatagctcttcctttttctttccttttccctccttttantgantgtaaaaggaccacggcctaacctttaattttcgctttctaataaaatgcgcactacgggtttcccctcctgatccttc

SEQ ID NO: 67548 - DNA, 195 bp, Zea mays
  unsure at all n locations
  Clone ID: LIB3076-052-Q1-E1-B5
cccccccnaatgttttttgcagtccggtcaaaaaaccgggtccagccacgcgtccgatgcaacgtacgatcaagtgtgcagtctgtcctgggtaatggcccaaatatccttgggatgctccacccgattcttccacattgggtcgtcctccctctcaacggggaacaagccaatggggtgggtaaccaactccaa

SEQ ID NO: 67549 - DNA, 427 bp, Zea mays
  Clone ID: LIB3076-049-Q1-K1-G10
ttcccgggtggcacatgctactgcagttgcaagataccgtacgaaatatcaggctgctcagaagggtaaggtcggaatagtcctggacttcaactggtacgaggctcttacaaactcacctgatgaccaagcagcagcccaaagagccagggacttccacattggctggtttgttgatccattgataaacggacactatccacagataatgcaagatctcgtgaaggagaggctgcccaggttcactcctgagcaggctaaactggtgaagggctcggcagactacatcggtatcaacgagtacacatccagctacatgaaggggcagaagctggtccagctggcgcccagtagctactctgccgattggcaagttcaatatgtttttgcacgcaatggcaaaccgattggaccacaggcgaattct

SEQ ID NO: 67550 - DNA, 361 bp, Zea mays
  Clone ID: LIB3076-052-Q1-E1-B6
accacggcaacgaccagacctcgtacggcgtgagcgtggggacggcttcaacgtgggcctgtccgtgaccccgcaggagggccgcggcaactgccccgtcctcgcctgccgcaagaacctcaccgagacctgccccggcgagctgcagctgcgctccccggccggcagcgtcctcgcgtgcaagagcggctgcgaggccttccgcaccgacgagctgtgctgccgcaacatgtataacagcccgcacacctgccgcgcctccaagtactcggagttcttcaagcgagagtgcccgcaggccttcacctacgcgcacgacagcccctcgctcacccacaaatgcgccgcgccgcgcgagctc

SEQ ID NO: 67551 - DNA, 309 bp, Zea mays
  Clone ID: LIB3076-052-Q1-E1-B9
cccacgcgtccgggcgagtttcaggatttgggtcagaagaatctggaaattccgaacatggagacgaagatggtgaagatgagaaattggaagacaattccattagcagaggctcagggccaaataaatcttgtgattatggcacacaattcgggaatttgcactcaattcctgaaacaggaaatgatcatcttgtactgaacatggatgctattgtcagaggtgatgcacaaatatctgttaccagggctcaagccgtcacttatgatgaagttgtggattggaatgagactccgctgcctgacaatg

SEQ ID NO: 67552 - DNA, 397 bp, Zea mays
  Clone ID: LIB3076-004-Q1-K1-D1
gcgaccagcgctcgtgacctccagtcaacagattcccaatccggcgcttctcatcccgggtgggccgctccatttggtcgaatggccgatggcgcccaaggccgagaagaagcccgcggagaagaagccgacggaggagaaggccgagaagaagcccagggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctggctgccgaggccgacaagctcgcccgctacaacaagaattccaccataacc

SEQ ID NO: 67553 - DNA, 288 bp, Zea mays
  unsure at all n locations
  Clone ID: LIB3076-004-Q1-K1-D10
cggacgcgtgggtgcgaatggggagttctggatctgttgcgatatctgcgagaagtggggccatggcaagtgtggcctgggcacccctgcaaaggcagagcacatcaatcagtacaagtgtcccagctgcagcaccaagcggagcctggaatgacatgctccctggggcaagactcgcttccacttgactaagcatttagaatcattaggatcattgaaagtgtgaaactgtgtcattagaatcacttcctctgtttagtggaccantattttttctatttttttaat

SEQ ID NO: 67554 - DNA, 357 bp, Zea mays
  Clone ID: LIB3076-004-Q1-K1-D12
gcgcccacgcgtccgagcgaatccctcgcatcgcattcgcagcctttgctgcatcacaccagcgcgaaaccccaggggccggagcgatggcgcccaaggcggagaagaagccggctgcgaagaagccagcggaggaggagcccgctgccgcgaaggccccggcggggaagaagcccaaggccgagaagcgcctcccggcggccaagtcgtccggcagagaaggcggcgacaagaagggtaagaagaaggcgaagaagtcggtggagacctacaagatctacatcttcaaggtgctgaagcaggtccaccccgacatcggcatctcttccaagggcatgtccatcatgaactccttca

SEQ ID NO: 67555 - DNA, 92 bp, Zea mays
  Clone ID: LIB3076-004-Q1-K1-D2
acataaacaatggcgaaggctgtttctgttctcaatccgtctctttctattccgggttggctgtttcattatggtcgaagggcctatttctc

SEQ ID NO: 67556 - DNA, 428 bp, Zea mays
  Clone ID: LIB3076-004-Q1-K1-D7
cccacgcgtccgcgcgccctcgccgcgatgatctccctgctccgacgcgccctcgccgcctccgcctccgcctcgtatccggcggccacgtaccggagactcctcgtcgtcgtgccactctctccgcccgcggcccctccaggcccatgccaggcgcccgcggcagggtcgcaggagccgccgaggcgggcgttccactgttctacgccccccctggggttcaggtccacccccgcgtcgtgggccggtccctatccgggggagggcgagggcgagggcgtggatacgggggctgagaaggggctggagatcgcgaggctggggacctcgccgcggatcgtggagaagctcgccgcgcggggcatcaccaggctcttccccatccagagggctgttcttgagccagcaatgcaaggaaaagacatgat

SEQ ID NO: 67557 - DNA, 425 bp, Zea mays
  Clone ID: LIB3076-004-Q1-K1-E1
gtgagaacaagggccacacatggcttaattatgggaaggctgtagaataggagtggtagcttctgtaagatgacgtgaaggctctagaagagatgtatcatcaatgagaacaggctgatgctacttgggcattcacagtccttgggtacatcggcgaacttttatgcggagtcgtaggtagaattgcttcaatagcttggcttgcacatagtggcatatacatggtgattgatccttcactatctcctatcctgaatgatgtcatctttaagttgtattgtgtttggcgtctgacttgcactgcttatttggcattctacagcgtctatgcttcttatttgcaagtttcgctgtcgagaagattcttgcagttaatttagcgtttataacattttacccgttaaaatggggatgctctttaatta

SEQ ID NO: 67558 - DNA, 307 bp, Zea mays
  Clone ID: LIB3076-004-Q1-K1-E10
ggagaagcaagaagtggtcattgagaagattgtccgtaacaagcgcaaatgtgttactggggtgaaagggcttggattggggggtgtaaagcttagtgatgcttctaagaagcttgggaagaagtttgcaaccggagcttctgttgttaagggccctacggataaggagcaaatcgacgtacaaggggacatctcatatgatattgtggagttcattacagatacatggcctgatgtacctgagtcggccattttcttcattgaagattgaaggaatgttcctgctgcttgatgccatatggtttat

SEQ ID NO: 67559 - DNA, 136 bp, Zea mays
  Clone ID: LIB3076-004-Q1-K1-E11
cggactcttgggtcaaaacccttttcccttctcccttctcccctctctgatctagtgcgggaactcctaccaaagctcgcgtcatctacaattccaatccctaatagctgatcatgctatgactactccttctatt

SEQ ID NO: 67560 - DNA, 160 bp, Zea mays
  Clone ID: LIB3076-004-Q1-K1-E2
ttgacaacaacggccgcaaatggcggaattatgtgtatgcttcaaaacacgatttattagtccgggtacatctcatatagggtctggacgaaacgtatactcatcgagaacatgcctctgtctcttgtccattcacattcatgcccatcataggcaaact

SEQ ID NO: 67561 - DNA, 425 bp, Zea mays
  Clone ID: LIB3076-004-Q1-K1-E4
gtgggaacaagggccggaaatggcggaaaaatgtgaaggctttagaaaaggagttattactcctggaagatgacatgaaggctctagaagagatgtatcctcaaggagaacaggctgaggctacttgggcattcacagtccttgggtacatcgggaaacttctatttggtgttgttgggttaattgtttcaatagcttgggttgcacatattgtcatatacttgttgattgatcctcctctatcttctttcctgaatgaagtcttcataaagttggatggtgtttggggtctgcttgggactgctgctttcgcattcttctgcttctatcttcttattgcagtgattgctggggagatgatgcttggattgaagctagtttttatcacaattcacccgatgaaatggggaggcactttaatgaac

SEQ ID NO: 67562 - DNA, 361 bp, Zea mays
  Clone ID: LIB3076-004-Q1-K1-E5
cccacgcgtccgcgcgctctcgccgcgattatcttcctgctccgacgcgccctcgccgggtgcggctccgactcgtatgcggcgggcacgaaccggagactcctcgttgtcgtgccactctctccgcccgcggcccctccaggcccatgccacgcgcccgcggcagggtcgcatgagccgccgatgcgggcgttccactgctctacgccccccctggggttcatgttcacccccgcgtcgtgggccggtccctatccgggggagggcgagggcgagggcgtggatacggtggctgagaaggggctggagatcgctaggctgtggacctctccgtggatcgtggagaagcttggctcgcggg

SEQ ID NO: 67563 - DNA, 450 bp, Zea mays
  Clone ID: LIB3076-004-Q1-K1-E6
cagcaatagaatgggtggcggcggctggagcccggcagcgagcggcgggagcagcgtcagcgaggatgactgagacgccgggtagaaagctgtcattgactccatcacgtccgggggattctgctgtttttagtactttggttcatctcaggtcttctatattgtgaggctttgtttattgaattaatctcattggttgctctttttgtcttatactctgtttgttatttctactctttatttttttctgtattaaatctttttatatttttattgagtttttttgttttttttgactttttttgtttctatattttttgtttttatcttttttttgtattgttatttttgtttattattcttttgtttgtaatctatttttttatattatttttccttcttttatatgtttgtggttctttttattttatattctttttcttttttttt

SEQ ID NO: 67564 - DNA, 376 bp, Zea mays
  Clone ID: LIB3076-004-Q1-K1-E7
aggaaaatcatcggcttatggatatggagttcacatatgaattgcacgagttatctggcaggaagcacccagcagtcaaaaccaagatgtacttagagtagaacaagatggaaagacggaacctcacgacgccgttgctgaaacctttgctcagaagctgagcatgtagtgtgcttgttacacccatgatgggtacattgagaccatttatgttgtattagtaatatattgtttgattgcccaattaacggggtgagccattgtttcatcacaacatcgatgtgttagcagataaccacatcgccgttttaagcaaacattgagtgcggaattttgttgtctttgtgaagtccgatgaaagcatcttcttctgatc

SEQ ID NO: 67565 - DNA, 216 bp, Zea mays
  Clone ID: LIB3076-004-Q1-K1-E8
ataaaaggagttattagttctggaagataacgatgaagggtctggaagagatgtattctcaaagagaacaggctgaggctacttgggcattcacagtccttgggttcatctggaaacttctatttggtgtagttgggttaattgtttcaatagctttggttgcacatattgtcatatactagttgattgatccttccctaacttcttttcttgaat

SEQ ID NO: 67566 - DNA, 426 bp, Zea mays
  Clone ID: LIB3076-004-Q1-K1-F1
atacatttttcagttagaccaaggtctaggtattggatgcaaaaacccgttctttaaccgtcatcaacttactctgaccaggttcatcaatttaaataagcaagagaaaggtgtccgcaagccactaccagctgttttgaatctatcatggtcattatgctgtttgcgtgggtgatttgccgagctattacgccatggcacttggagggccttattctgctaggagctttagtaatggtgaactgggcgctactaagaatatacttgaggttgctactgaactgtgtgtacctgtctgaaacacacccgtttatgcatatgtagaacatgggactgaccttgggagttccaaggatgtcaaagggtaccctacagagtttttaaagcgtgctggtcatggatcttcatatggtgctgggggtaatc

SEQ ID NO: 67567 - DNA, 274 bp, Zea mays
  Clone ID: LIB3076-004-Q1-K1-F11
cttcctcaaggcggccaaggcggccaatggcgccggcatggcggactgcagctacacgagcatgcacctggacgtggcctggctcgacagcgtgcggcagttcatggacagcttccggcgcgcctgcatgccgctcgactcgctcttctgcaacgccgccatctaccggcccactgcaaggactcctacattcacggctgactgatactatttgagcgtctgcgtcaaccacctgttccacttcctgctggcacgcctgctcctggacgacatg

SEQ ID NO: 67568 - DNA, 353 bp, Zea mays
  unsure at all n locations
  Clone ID: LIB3076-004-Q1-K1-F12
tgaagataactataggctgatggctgcatgtagggatgcaaattggtctaaacaacatggtcccaagtgacctgagccatgccacatgtagctcatgtcctaagctgcccataaattccattatgtttctagtcgtccacctcctagtcggacgactaatcgtcatcagtcaatgattaatcggatggccagaaactaatcaacttattgagttgtagctcccctgcgaacagcccctggtctaactggttaggtgatgtagtagcaaactctcanggtctgagttcaattcctagtggaagcgaattttcatacctgggttaaaaaatccccttgctggttctcacccgctc

SEQ ID NO: 67569 - DNA, 365 bp, Zea mays
  Clone ID: LIB3076-004-Q1-K1-F2
ctgacgcctgggccgacgcgtggctcgaatgaatatcatcggcttatggatatggagtgcacatgtgaattgcacgagttgtctggcatgaagcacccagcagtcaaaaccaagatgtacttacagtagaacaagatggaatgacggaacctgacgacgccgttgctgaaacctttgctcagaagctgagcatgtagtgtgcttgttacacccatgatgggtacattgagaccatttatgttggattagtaatatattgtttgattgcccaattaacggggtgagccattgtttcatcacaacattgatgtgttagcagataaccacattgtcgttttaagcatactttgaattgctgaattttg

SEQ ID NO: 67570 - DNA, 449 bp, Zea mays
  Clone ID: LIB3076-004-Q1-K1-A2
ggcggcctcccccacttcctccctcgccccgccggtggtgcctatgtgagcttcacgccggcaaccgcgaccgcctggtcgccgcgctccgcggccacatctccgcctccgcgcgcccgctccacggcctcgtcctccttcagggcggggaggagaagacacggtactgcaccgatcacctcgagctcttcaggcaggagagctacttcgcctatctctttggagtgcaggaaccagggttctacggcgcaattgacatcgcctctggacagtcaattttgttcgctccaagattgccagctgactatgctgtttggatgggtgaaataaaacctttgtcgtacttcagggatacatacaaggttgatatggtctcctatgttgatgagattgcaagggttgtgcaagatcatttcgggaaccatggaaagcctcttctggttctgcta

SEQ ID NO: 67571 - DNA, 421 bp, Zea mays
  Clone ID: LIB3076-004-Q1-K1-A4
acttccacgcttgcgaagacggtggtgcctatttagcttcacgccggcaaccgagaccagcgtggtcgccgcgctccggggccacgtttacgtctgcgtgcgcgcgatgcacgggctcgtccttcttgagggcgaagaggagaagacacggcactgcaccgaacacctggagctgttaaagcacgagagctacttagcctatctgtttggagtgcaagaaccatggttctacggggcaattgacatagcctgtggacagtcaattgtgcttgctacaagattgccagctgactatgctgtgtggatgggtgaaataaaacctatgtagtacttcagggatacatacaacgttgaaatggtcttgtatgttgatgagattgcaagggttgtgcaagatcattttgggaactatggaaagcct

SEQ ID NO: 67572 - DNA, 422 bp, Zea mays
  Clone ID: LIB3076-004-Q1-K1-A7
cggacgcgtgggcggacgcgtgggcggacgcgtgggttccccgcgtcaatcctgccgcctcctgctcgcgcgcttactgtagccgcagctttctccacccttggcgatggaggccgcgatcgctcacgctccatctgctccggtcctgcgccgctcgcgcagcctcaaccccacgcccgccgtccggccgcacccaaaatcctggcagggggtgctttcggcgaggcacccgtcgaacgccgtcaggtgcgagccgtcccagcgcccagaggcgcgcccgcgcctgcgcgcggcgcagccggctggcgctgacgcggcggccgggaggaagcggctggcggtgttcgtgtccggagggggatcaaacttccgggcgatccatgaggccgcgctgggcggcgccgtgcacggagatgtcgtcg

SEQ ID NO: 67573 - DNA, 425 bp, Zea mays
  Clone ID: LIB3076-004-Q1-K1-A8
cggacgcgtgggcggacgcgtgggcggacgcgtgggttccccgcgtcaatcctgccgcctgctgctcgcgcgcttactgtggccgcagctttctccacccttggcgatggaggccgcgatcgatcacgctccatctgctccggtcctgcgccgctcgcgcagcctcaaccccacgcccgccgtccggccgcacccaaaatcctggcagggggtgctttcggcgaggcacccgtcgaacgccgtcaggtgcgagccgtcccagcgcccagaggcgcgcccgcgcctgcgcgcggcgcagccggctggcgctgacgcggcggccgggaggaagcggctggcggtgttcgtgtccggagggggatcaaactttcgggcgatccatgaggccgtgctgggcggagccgtgcacggagatgtcgtcgcgc

SEQ ID NO: 67574 - DNA, 329 bp, Zea mays
  Clone ID: LIB3076-004-Q1-K1-A9
aagaactgtcgatgtattgtagaagatgatcttgtagattgttgcaaacctggcgaccgtgtctcaattgtcggtgtgtgcaaggctctaccagggaaaagcaagggaagtgttagtggtgtcttcagaactgtccttatcgcaaataatgtgtcgcttcttaacaaagaggcaaatgcacctgtctacactcgggaagatctgaagcggatgaaagaaatatcaaggagaaatgacacctttgacttactgggaaattctcttgctccatccatatatggtcatctatggataaagaaggcagtagtactgttgatgctaggtggtgt

SEQ ID NO: 67575 - DNA, 414 bp, Zea mays
  unsure at all n locations
  Clone ID: LIB3076-004-Q1-K1-B1
cggacgcgtgggcggacgcgtggggtttcgctctcgcgggggtcgacttcctagggttcgaggaacgtccgtccgtccgtccggggaaggtgcaggagggaggcggagatgatcgaggtggtgctcaacgaccgcctggggaagaaggtgcgggtcaagtgcaacgaggacgacaccatcggcgacctcaagaagctggtggcggcgcatacggggacgcgccccgagaagatccgcatccagaagtggtacaacatctacaaggaccacatcaccctcaaggactacgaggtccacgacggcatgggcctcgagctctactacaactgagccgnncgccctctctccctctcgtcaggttggtctgaattctgaagtcatgggtgcaattcgcttcgcggtgatctcttaagc

SEQ ID NO: 67576 - DNA, 340 bp, Zea mays
  Clone ID: LIB3076-004-Q1-K1-B10
cccacgcgtccgcccacgcgtccgcggacgcgtgggggaaaaatatccccaaaccctaggtcccgatctcgatggcgaacgctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagtt

SEQ ID NO: 67577 - DNA, 441 bp, Zea mays
  Clone ID: LIB3076-004-Q1-K1-B2
cccacgcgtccggtttttgaagtttgggagcagtacattttaatggagataaaaatggaccatgtacatgaggcgagatccctttataagcgttgttatagcaaaagatttgctgggtctggatcagaggagatatgctactcatggataagatttgaagaggagaatggcaccttggatgattatgatcttgctgtaaagaaggttaccactgggctaaaggagcttatgacattcatgtctcaagaggaggctaaagttgaggcttaccttaacctcaatgataattctaatgcaaatgattcctctcagaagctataaccaagctgcaataaacagcatctctctgctaagaaaagaaatgtgaatccatcaaatagtaccatgccatcagatgaccaaggatcaaatgtgcaaagtggtctcagtaggtgctgttac

SEQ ID NO: 67578 - DNA, 443 bp, Zea mays
  Clone ID: LIB3076-004-Q1-K1-B4
cccacgcgtccgcggacgcgtgggcccgagtgggcgaccgccgccgccgccccacgccaggtgcacagatcttcgtggggcacttggccggcgacgaacgcccagcagattatcgggtatacatgcgcccaaccatgtcctttaccgggtccgcccctgccaatgatccctgcctcgccaagatcctgtccaagcaaggggacaacaaagttctcttcgcggacaaggtattaaagttcacccaatctggaaagatgaaaagacgcatcctagtgatcacagactttgctctataccttgttgaccctgaggccaacatattgaagaggaggatagcacttgcagctgtggataagctatgcattagcaacctcagtgataacttctttgcgatcattgtgccgactgagtacgattgtttaatggccagcactagaaagaag

SEQ ID NO: 67579 - DNA, 381 bp, Zea mays
  Clone ID: LIB3076-004-Q1-K1-B5
cggacgcgtgggcggacgcgtgggcggactcgtgtgttccccgcgtcaatcctgccgcgtgctgcgcgcgcgcttactgtggccggggctttctccacccttggcgatggaggccgcgatcgctcacgctccatctgctccggtcctgcgccgctcgcgcagcctcaaccccacgcccgccgttcggccgcacccaaaatcctggcagggggtgctttcggcgaggcacccgtcgaacgccgtcaggtgcgagccgtcccagcgcccagaggcgcgcccgcgcctgcgcgcggcgcatccggctggcgctgacgctgcggcctgtaagaagcggctggctgtgtttgtgttcgtatggggatcaaactttcgggcgatcca

SEQ ID NO: 67580 - DNA, 446 bp, Zea mays
  Clone ID: LIB3076-004-Q1-K1-B6
actccacccgcgcacaacagatcgcacgcctcggttccctccactcgacgcttctcccgctcctaacccctagtaccttcgctcgctctgccgcctccgccgacgacgcgccagatccgcgcagcagtggtgtcctccgccgcggatcgagctcccgatccgcgcagtgggagtggcggcgagcgcaggagcgctcggccgggggttccgcgaggctggagacggaggaggaagggagcggtagttccgcggtggtagatccgccggtcctgtcgccggagatggactcatctgtcgagaagcaggggagcgtggcgctggatccggacgagcgcgcgccggcgtccggcgaaaccaaggcctgcaccgagtgccacaccaccaagaccccgctctggcgcggggggccctgcggacccatgtcgctgtgcaacgcgtgcgggatc

SEQ ID NO: 67581 - DNA, 420 bp, Zea mays
  Clone ID: LIB3076-004-Q1-K1-C1
aggaaacgcaacatcacctgtcagctagctgtcatgatattgctaatgtagcttctggtgtgtctgagtctggatctgctgatcaaacacaatcttctttgctttgtgggtcatcataccaacagatctatgatggaaacagtggtccaggtctgcatgtgcacaacggtttccacaactgttcaagccaagagtcctccaaccttcttaatctctcaagaagtggacaattcatggcatcagagggatggcctttgaagaggttggctgtggaatctctttctggtcatgagctccaacctatgcagcacaagtttgagaaagtgaatcaccaaagtaatgtgtctcacatttctagcaccttgcccccactgtcagcaagagacagttatagtgcccaggctagtggtacaaatgatc

SEQ ID NO: 67582 - DNA, 330 bp, Zea mays
  Clone ID: LIB3076-004-Q1-K1-C12
cccacgcgtccgcggacgcgtggggttgttcccatgcttactgcacctaacaaacgacggagatgaagacatggggtttgtgcttaatccagcagagagtgtggacgaatgctggttggagcagtttcttgaacgggacgccattgtggctgcgcgatccacttacactctcattctgacggtgtcatgggagcaggacaatattcctgaatacagattttgtgaaatgatcctcgagagctggcctaatcaaaactcgtatgactctgaagctaataaggaggtgaaactgacagcttatttgtcgacttaacacagacagtcgacaac

SEQ ID NO: 67583 - DNA, 292 bp, Zea mays
  Clone ID: LIB3076-004-Q1-K1-C2
aggaaacgcaccatcacttatcatttggctttcatgatcttgataatgtagctggtggggtgtctgagtctgggtctggtggtcaaacacaatcatctttgctatgtgtgtcatcataccaacatatctatgatggaaacagtggtccaagtctgcatgtgcacaatggttttcacaactgtccaagccattagtccttcatccttcttaatttctcatagaagtggacatttcatggtatcatatggaaggcctttgaataggttggctgatgaatctctttctgttcatg

SEQ ID NO: 67584 - DNA, 402 bp, Zea mays
  Clone ID: LIB3076-004-Q1-K1-A12
caggagttagtttcaatgatgctcctactcccagggataactatgcaaatgccccaagtccatacgtgccttcgacgcctgttggccagaccaatgacgccaaactcagcctcatatcttccaggcacacctggtggtcaaccaatgaccccaggcaatgctggaatggatatgatgtcgccgataataggtggtgagggtgaagctacatggctgctgccggatgttttggtcaatgtgttgagcggaggtgatgacggtcctggtgtggttagggaggtactcggggatggatcttgccgagttgcacttgggtcttcgggcaacggtgacatggtgactgtcctttcgaacgaggtcgaggtcatcatgcccaagaagagtgacagggtcaagatactg

SEQ ID NO: 67585 - DNA, 316 bp, Zea mays
  Clone ID: LIB3076-003-Q1-K1-G4
cggacgcgtggggcacattatgttttctgtcaaaaagttgcatatggattatatgaacatgttttcaaaaattcattactgtggttcttagttctgtgactggaaaaataattttcgggttactttaggaatgaacacattaaaggagctggagttgtcaaggtgcaaaaagatctctgaggctagcacatgtgagttgtgagaaacaggcacaactaggagccttttggtccagaactttatctctgaacaaatctgaattgttttgatgttcagtgatgaacaggcgatatattcttcttaagaaccagtcctc

SEQ ID NO: 67586 - DNA, 307 bp, Zea mays
  Clone ID: LIB3076-003-Q1-K1-G5
cttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgccggcgcggagaaggttaagctggagaacaagacatggaaaatcgatactggaacaaggacatttgagatagaattggc

SEQ ID NO: 67587 - DNA, 426 bp, Zea mays
  Clone ID: LIB3076-003-Q1-K1-G6
actcatgcgatcagcacattatgttttctgttttaaactttcatatcgattatatgaacatggattgggaaattgattactggggttctgagttctgtgactggaaaaataatttccagcttactttaggaatgaacacattaaaggagctggacttgtcaatgtgcaaatagatctctgaagctatcacatcttagttgtgagaaacaggcacaactaggagccttttggtccagaactttatctctgaacaaatctgaattgttttgatgttcattgatgaacatgccatatattcttcttaagaaccattcctccttgtaaataattttttaaaaaaggtcttgctatttgtcccaaatttttttttcttttaaaaaaaattttgggttttttaaaatttatttttttttccccttttttttt

SEQ ID NO: 67588 - DNA, 322 bp, Zea mays
  Clone ID: LIB3076-003-Q1-K1-G8
atcataagcaaatgtcggcaagttgggactattctgtcaagcaaccttctcagggaatgggtcagcaaaactcggggaactgggaagtgtacaaggaacagcaggatcaagccagcaaccggagggagcatacgaatctttgcagtaccaactgggtcatggatggcttccaggatgcttggaagcatggctatggctggggtcctgcatctatccagaccgatccatgggacaactgtcaatatagctatcaagtacctgacagccagggctcgtacggacactggactcactggaaaacgtgaaacattggacttttttt

SEQ ID NO: 67589 - DNA, 366 bp, Zea mays
  Clone ID: LIB3076-003-Q1-K1-G9
gatattataaaggtcaccttgatagggttgtctgcatcggactttgctctggaagagaagggtttctctcatgtgcgcttggtcgtaccattctcttatgggaccatccggctgaaaaaccgcaaggcttactgcgcgcgcaaaggaggcctacagtttcgtacgacgcccaaggcatggtatttgctgtcgcctatggtggccgcataaagatgtttgatattccgaaattcggaatggggccttttgcgaccttctctgtctgcactgatgattccgaagcccatgtcgtacagttcaacggtgattgcaagcggattctgttaaccactaaagctgggcgtgttcatgtgctagaatcttttg

SEQ ID NO: 67590 - DNA, 446 bp, Zea mays
  Clone ID: LIB3076-003-Q1-K1-H10
gagagaggcggagttgcggagattatgcttagcagcagcatgaagagggagatcagcggggcccacgacaccaggcgctggggcatcaacgccggcgtcaaagccgacctcgccccgccgcacccgctccagtctaccatccaatcggagaccaagttctgggcggacaagaagaagttcgggacagatgccatatacggatccgccctcaacatccgcaaggatctcgatgcccaaatcctctccaggttccaaaggccccctggtgctttgccgtcatctctgcttggatacgaggcactgacaggttccttggatgattgtggatttgaagattatcttaacatgcctcatgattctgacagtttccgtcaacctgacctgcaccatggaatggaggtttgccttgggttgtccatgggacctatctgtcctaccttcaattg

SEQ ID NO: 67591 - DNA, 435 bp, Zea mays
  Clone ID: LIB3076-003-Q1-K1-H11
gcgacaagttcctgtcctacaaggacctcaagaagcggctgaagcagatcggcgccggctctggcgagcggcggagcaagcgccagcgggtgggggacgggcgcggcggatcctcgccgcctgcgatgaccccggaggaggccggattcgtcgcgctcctcgacgccgagctcgacaagttcaacgccttcttcctcgagaaggaggaggactacgtcatccggctgaaggagttgcaggacagggtggtgagcgccgcggaggtggggtcggcggaggagctgctgcgggtgcgcaaggagatcgtcgacttccacggcgagatggtcttgctggagaactacagcgcgctcaactacaccgggctggtcaagatcctcaagaagtacgacatgaggaccggcgcgctgatcccgcctgcctttatccggaacg

SEQ ID NO: 67592 - DNA, 88 bp, Zea mays
  Clone ID: LIB3076-003-Q1-K1-H12
gttctagatcgcgagcggcgccctattgtaatcaggtttctgaaaaaaaaaataaaagaggaaaaaaacaaaaagtaaaatgggacat

SEQ ID NO: 67593 - DNA, 248 bp, Zea mays
  Clone ID: LIB3076-003-Q1-K1-H2
cccacgcgtacgtgcatcggctttaagtttatatccatggggacttgtatcgagttatcgtttcctatgaccggggtcctggtcccagcgcacaaggctatcttatccgagctgctggccgttgagtgcgagctcccgttgacggtggagatggacatgttgctgcaattcatgcggaaggcatggttcatcttgcgtgtgctgtctggttactagtataagatgatccgatcctacaatcttgtagc

SEQ ID NO: 67594 - DNA, 173 bp, Zea mays
  Clone ID: LIB3076-003-Q1-K1-H3
gccgggtcgaccgactcttacgatcataaacaatatgtcatcatttttgacttttctgtcaagcaaccttctcaggaattggtcaacataactcaggccactggtaaatgtacaatgaacatcttgatcaagccattaaccttttggagcatactaatctttgcagtaccaac

SEQ ID NO: 67595 - DNA, 337 bp, Zea mays
  Clone ID: LIB3076-003-Q1-K1-H4
gccggctggacgcacgcgtccgccacgcgtccgtgcagcggctttaagtatatatccacggggacttgtatcgggttatcggttcctaggtacttgttcctggtcccagcgcacaaggctatcttatccgagctgctgggggttgagtgcgaggtcccgttgacggtggagatggacaagttgcggcaattcgggcggaaggcatggttcatcgtgcgtgtgctgtctggttacgaggagaagaggatccggtcctacaggctgcagctgcagaagcgcatcgagatggcacaagctagaacggaagagctgcataaactgccagaaaaggttatct

SEQ ID NO: 67596 - DNA, 405 bp, Zea mays
  Clone ID: LIB3076-003-Q1-K1-H5
cccacgcgtccgtgcagcggcgtgaagtatatatccagggggacttggatcgttttatcggttcctaggtcctggttcctggtcccagcgcacaaggctatcttatccgagctgctgggggttgagtgcgaggtcccgttgacggtggagatggacaagttgcggcaattcgggcggaaggcatggttcatcgtgcgtgtgctgtctggttacgaggagaagaggatccggtcctacaggctgcagctgcagaagcgcatcgagatggcacaagctagaaaggaagagctgcagaaactgccagaaaaagggggggtttttttaaaaattctttgggtccgggggaaaaagggggtttttttttaccccgggttttttcccccaataaaatgggggccccccaaa

SEQ ID NO: 67597 - DNA, 315 bp, Zea mays
  Clone ID: LIB3076-003-Q1-K1-H6
cccacgcgtccgtgcagcggcgtgaagtatagatccagggggacttggatcgttttatccgttcctaggtccttcttcctattcccagcgcacaaggctatcttatccgagctgctgggggttgagtgcgaggtcccgttgacggtggagatggacaagttgcggcaattcgggcggaaggcatggttcatcgtgcgtgtgctgtctggttacgaggagaagaggatccggtcctacaggctgcagctgcagaagcgcatcgagatggcacaagctagaaaggaagagctgcagaaactgccagaaaaggttatc

SEQ ID NO: 67598 - DNA, 346 bp, Zea mays
  Clone ID: LIB3076-003-Q1-K1-H7
atcataagcaaatgtcggcaagttgggactattctgtcaagcaaccttctcaaagaattggtcagcaaaactcagggaactgggaagtgtacaaggaacagcaggatcaagccagcaaccggggggagcagacgaatctttgcagtaccaactgggtcatggatggctcccaggatgcttggaagcatggctatggctggggtcctgcagctattcagaccgatccatgggacaactgtcaatatagctatcaggttcctgacagccagggctcgtatggacactggactcactggagaagggcgaaaccaaaaaattttgggggaaccctttgggggttaagggg

SEQ ID NO: 67599 - DNA, 251 bp, Zea mays
  Clone ID: LIB3076-003-Q1-K1-H8
tgggagtctaccacaccgtcttttactattgcaagctgagggttggcttagcagagtcgggctaggtatatggggtgtcagctacccgtacacaggcaaacgcgtaatttgtgtgtttatgcgaccggcgatgtgtgtatatatgctactacatgtttagtgatgctttccgagacctgagacaacgcccgtctgttttaacgtggcgcatgaataattctggatctggatgtaatacaagatataactaa

SEQ ID NO: 67600 - DNA, 395 bp, Zea mays
  Clone ID: LIB3076-003-Q1-K1-H9
gagagaggcggagttgcggagaagatgcatagcagcagcatgaagagggagatcagcgaggcccacgacaccattcgcttgggcatcaacgccggcgtcaaagccgacctcgccccgccgcacccgctccagtctaccatccaatcggagaccaagttctgggcggacaagaagaagttcgggacagatgccatatacggatccgccctcaacatccgcaaggatctcgatgcccaaatcctctccaggttccaaaggccccctggtgctttgccgtcatctctgcttggatacgaggcactgacaggttccttggatgattttggatttgaagattatcttaacatgcctcatgattctgacagtttccgtcaacctgacatgcaccatggaat

SEQ ID NO: 67601 - DNA, 450 bp, Zea mays
  Clone ID: LIB3076-004-Q1-K1-A1
ggcggcctcccccacttcctccctcgccccgccggtggtgcctatggagcttcacgccggcaaccgcgaccgcctcgtcgccgcgctccgcggccacatctccgcctccgcgcgcccgctccacggcctcgtcctccttcagggcggggaggagaagacacggtactgcaccgatcacctcgagctcttcaggcaggagagctacttcgcctatctctttggagtgcaggaaccagggttctacggcgcaattgacatcgcctctggacagtcaattttgttcgctccaagattgccagctgactatgctgtttggatgggtgaaataaaacctttgtcgtacttcagggatacatacaaggttgatatggtcttctatgttgatgagattgcaagggttgtgcaagatcatttcgggaaccatggaaagcctcttctgtttctgctaca

SEQ ID NO: 67602 - DNA, 384 bp, Zea mays
  Clone ID: LIB3076-004-Q1-K1-A10
attccgcattcgttccaactcctgagcactttctcctcgtcccagacaagccaatcgaagccgagatacgaccatggactgcaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacga

SEQ ID NO: 67603 - DNA, 351 bp, Zea mays
  Clone ID: LIB3076-004-Q1-K1-A11
gcgacgccactgcgtgccgatctccgcatgtcgttaccatactgcttgagcgactttctacctcgtgcccagacaagtccatatcgagagcgcgagatactgaccagtggacgtgcacctggcacctggagcagcggggtaatggggaagaagtggagctggcctggcgcaaggtgctgcgggccataggaagaagtcaggagtctaggtccgtgaaagccgtgctccagttccccgtcggccgcatcgtgcgctacttgaagaatggccgctactcgcagtgtgtatgctccggctcccgcatctacctcgacgctgtactagaatacctaggcgatgacgatttttagc

SEQ ID NO: 67604 - DNA, 310 bp, Zea mays
  Clone ID: LIB3076-003-Q1-K1-G3
cggacgcgtggggcacattatgttttctgtcagaaagttgcatatggattatatgaacagggtttcaaaaattcattactggggctctgtagttctgtgactggaaaaataattttcgggttactttaggaatgaacacattaaaggagctggagttgtcaaggtgcaaaaagatctctgaggctagcacatgtgagttgtgagaaacaggcacaactaggagccttttggtccagaactttatctctgaacaaatctgaattgttttgatgttcagtgatgaacaggcgatatattcttcttaagaacc

SEQ ID NO: 67605 - DNA, 457 bp, Zea mays
  Clone ID: LIB3076-003-Q1-K1-E12
cctccacaaggctttggcctctgtgttgtaagttttaagcttcacctccagccatgggtaaagagaagtcccacgtgcaacattgtggttattggccgtgtcgactctggcaagtcaaccaccactggccacctgatctacaagcttggaggcattgacaagcgtgtgattgagaggttcgagaaggaagccgctgaaatgaacaaacggtccttcaagtacgcctgggtgcttgacaagctcaaggctgagcgtgagagaggtatcaccattgatattgctctgtggaagtttgagaccaccaagtactactgcactgtcattgatgcccctggacatcgcgacttcatcaagaacatgatcacgggtacctcccaggctgactgtgctgtcctgatcattgactccaccactggtggttttgaggccgggatctctaaggatggccagacccgtg

SEQ ID NO: 67606 - DNA, 413 bp, Zea mays
  Clone ID: LIB3076-003-Q1-K1-E3
ctcagttctagatagttcttcgcggcttggactaaagccatggcaaaaaacaaagccatggattgagatattgtgcaataaccaggttctatcaccagagatgagtttggctactgtgcgaacatatatatggaaaaagccagaagatttgattcttcattacagagtggtccaaccgagatgatcacggcttcagatcacatggttctcagcatgcctgcaccataaacggtgtggttgaagacacccttggcttagcgaggaaaccgtcagaaatattttgctcttgggctccggtagcctttctcctagaaattccccccccccggggaaaaccttttcggttttggggcccttttttttccccttttttttttttgggggtttttaaaaaaaaaaaagggggttttttt

SEQ ID NO: 67607 - DNA, 150 bp, Zea mays
  Clone ID: LIB3076-003-Q1-K1-E5
tccacacctactctctctcattttttaatttcccattcattatcactacctgggaccattgtaacatgttcccggatattgcactcctataccaccaatcatccttcctactcagcaatttcccattatcccttaatctcttatactccc

SEQ ID NO: 67608 - DNA, 175 bp, Zea mays
  Clone ID: LIB3076-003-Q1-K1-E6
tccacacctgctctctctcatttgtgagttttccactctctatcactacttctgaccggggtctcattctctggaatttcggacacctatctcacttctcatcttccctactacgtgatatcacaatttccctaaaactcctatcatcccttactactctctcctttatatcaca

SEQ ID NO: 67609 - DNA, 299 bp, Zea mays
  Clone ID: LIB3076-003-Q1-K1-E7
tccccacctgctctctctcactcgtccccatcaccgtcgccatcactaccccggtcctgtgctctcatcggctgcaatggcggacgccgacgccaagtcccagccgcccgacgccgcggcatccccggatgcctcgatctcctccccctcctccctaggcggcggcggcggcgacgcggccgacgcggacgcgatcgagaagcagctcggcggcctgggcatcgccggcggcggtgggttccccgagccatcgggatgggacgatggccccgtaccagtccccatcccgggcgatgtcc

SEQ ID NO: 67610 - DNA, 334 bp, Zea mays
  Clone ID: LIB3076-003-Q1-K1-E8
ctcactcgtgcgctcacacgtacctggattcaccaatctgtatcaccttttcggaccgggggagattctccgtggattaggcataactatctgaccacacatctccctttataagggctattagaatgaccctaacagaaagatcaactacgactccagcatgctttagatcaaacaaatcctgatgcacgtaaagaacttaatcttgtaagtaaaattcaactcataacgatctcactactactcagctcctactgcataatgagtgctacgcaatttgatactcacttaccttgattgaggacgcatatgcattacacaaaccccccttttt

SEQ ID NO: 67611 - DNA, 238 bp, Zea mays
  Clone ID: LIB3076-003-Q1-K1-E9
attcccaactcgacgccacccttcctcctacacgaattattcactacattttgttttccacaatttatatatcttattatatatggctattatttcaaccgcttcaggcaatacaactttatcattaaatccaataatattttgcataccaatcctcacttctaacaactaatgtcatagctaaactttgttccactatcaactatactcatcatacaaaacataacgtaacttctac

SEQ ID NO: 67612 - DNA, 247 bp, Zea mays
  Clone ID: LIB3076-003-Q1-K1-F1
cgtcgcgcctgaattactagaacatgatcgcgcacggctcgttacgaagcttcgaatcattacggccactcttcggggagttagatcttgtgaaagagtgccagagagctggtaacatcaaaagagctatgcatatctgtgctttaccatagacactcacacgtcgactgacatacgcttagtgctgcaactacaataggtatcacagactgggtgacataaaccgcttacatgtcaagactgagca

SEQ ID NO: 67613 - DNA, 296 bp, Zea mays
  Clone ID: LIB3076-003-Q1-K1-F11
gcgcccacgcgttcgcccacgcgtccgcacgattcacgcttagccgcagagatccgtcacacggcaagttttgaaaactgaactgtaagagggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatc

SEQ ID NO: 67614 - DNA, 316 bp, Zea mays
  Clone ID: LIB3076-003-Q1-K1-F2
ccgtattacttcactgaagcgcaagttcgggagttgcttgaatcattcggtcctcttcgagggtttgatcttgtgaaggatagggaaactggtaactcaaaaggctatgcattctgtgtttaccaggacctcaccgtcactgacatcgcttgtgctgcactaaatggtatcaagatgggtgacaaaacccttactgtcagacgagcaaaccagggggcatctcagcccagaccagagcaggaaagtatcctattgcaggcacaacaacaggtgcagttgcagaaacttgtgtatcaagttggagcgcttcctacaa

SEQ ID NO: 67615 - DNA, 384 bp, Zea mays
  Clone ID: LIB3076-003-Q1-K1-F5
cggacgcgtgggcaccacggcaccagcggttcagcggccaccctagtcagtcagtcggagcgaagccgcgcctcgcgccctggcctcgcgaccaccactgcttccagttctggtgcagtgtggaagagcgcccagtgggagagattcagagagaggcggcgatggcgcggcatttcgtgctgaacaccggcgccaaggtcccctatgttgggctcggcacatggcagtctgaccccggcgtcgtcggcaacgccgtctacgccgtcgtcaaggcgggttaccgacacatcgattgtgccagagtttacggggaaaaaaaaaatttttggaaggaaagggaagggtaaatttttttggggggggatattttttttttgggggggg

SEQ ID NO: 67616 - DNA, 440 bp, Zea mays
  Clone ID: LIB3076-003-Q1-K1-F6
gaatgaccggacgcgaagcaccctattacttaactgaagcacaagttctttataagcttgaatcattcggtcctcttagcgggtttggtcttatgaaagggggggcagctggtaactcaaaaggctatgcattctgtgtttaccactacctcaccgtcactgacatcacttgtgctgcactaaatggtatcaatatgggtgacaaaacccttactgtcacacgagcaaaccaaggggcatctcatcccataccagaacaggaaagtatcctattgcaagcacaacaacatgtgcaattgcataaacttgtgtatcaagttggagcgctgcctacaaaaggtttttttggggttttaaatttgccccttaaaccaaaccccaaaaggggggtttttttttgggggttttttataataaaaacccccttttttgggttctcc

SEQ ID NO: 67617 - DNA, 326 bp, Zea mays
  Clone ID: LIB3076-003-Q1-K1-F7
ggaaagtgggtgacaccgcacaagtctcaccattccctcatagctacagtgcatctgcaccttccgaacaaaacggtgatcagtcaaacagctccaggtattgcttagttgccagcaaacaaatggtcggcatatttctcacggtctgggtgcgcaatgaaataagagacgacgtcaggaacttgaaagtctcttgtgtgggtagaggattgatgggttatctcggaaacaagggttcgatttcagtgagcatgtgcctgcaccagacgagcttctgcttcgtatgttgccacctgacctctggggagaaggaaggcgactagctt

SEQ ID NO: 67618 - DNA, 248 bp, Zea mays
  Clone ID: LIB3076-003-Q1-K1-F8
acgctcacgcgttctaaagctacttgttcagctatatgacctcagaagcaatgaacaagatgggcttgatgtaaatggagacctaatgaagcagctgcaagatacaaggtcagagaacgcgacttgtgtagtactgtaacgaaagcgtgcacactgtcgcaagtgtgaatgtgatctatccttataaacggctatttcagcgactgtacaacgtttcttatctgtaattgccataccatcatcatgtc

SEQ ID NO: 67619 - DNA, 301 bp, Zea mays
  Clone ID: LIB3076-003-Q1-K1-F9
ggcgcccacgcgttcgtccacgcgtgcgcacgattcacgcttagccgcagagatccgtcacactgcaaggtttgaaaactgaacggggagagggcattagcagagctttcccgtgaggaaaatgtgtacatggcgaagctcgcctagcaagcagagaggtacgaggaaatggctgagttcatggagaaggtagcgaaaactgttgactcggaggagctcactgtggaggagcgcaacctcctgtctgctgcatacaagaacgttattggagcccgtcgtgccctatggcgcatcatcttct

SEQ ID NO: 67620 - DNA, 329 bp, Zea mays
  Clone ID: LIB3076-003-Q1-K1-G1
cttctctagcttctagtctagtttttgattttgagctagcgtccatgatgttgtgaataggtaaattctcaacggaaaccggatacaaggtcaccgtgcacgaccaggttgctcagaacctcatgaagtttgtgtcggatcaggattgcccgcacctgttgttctattggccttctttttccggtaagaaaaccctaatcctagcgctcatcaatcagatgttcttctccttctctgagaacgttaatctgtataacaagacatggataatcgatacttgaacaaggacatttgagatataattggcttaaaatttttttttttttttt

SEQ ID NO: 67621 - DNA, 229 bp, Zea mays
  Clone ID: LIB3076-003-Q1-K1-G10
gatattataaaggtcaccttgatatggttttctgcatcgcactatgctctggagaacagggttatctctcatgtgggctggatcgtaccattctcttatgggaccatccttctgaaaaaccgcatttcttactgctcgctcaaaggacgcctacagtttcttactacgcccattgcattctatttgctctctcctatggatgccgtatacacatgtatgatattcccaa

SEQ ID NO: 67622 - DNA, 385 bp, Zea mays
  Clone ID: LIB3076-003-Q1-K1-G11
gatattataaacgtcaccttgatagcgttttctgcatcgcacttcgctctggaaaagaagattttctctcatgggccctgggtcgtaccattctcttatggcaccatcgatcttaaaaacctcatggcttactgcacgctcacaggatgcctacactttcttacgacgcccacggcatggtatttgctgtctcctatggtagccgtataaacatcgttgatattctgaaattctgaatgactccttttgctaccttctctgtctgcacttatgattctgaagcccatgtcgtacactttcaacattgattgcaggctgattctgttaaccactaaatctagtcctgttcatgtactagattctttttaatgcaacatcatttcat

SEQ ID NO: 67623 - DNA, 239 bp, Zea mays
  Clone ID: LIB3076-003-Q1-K1-E10
cccacgcgtccggaggtcactgcttgaggtgaacaaggctctgcagaaggaacttgcggagaggcataaggccggggcgaggctgcagcatcaggtgcagtgggaccagcatacacatgcccaggcccagacatgctcatcatcgtcctccttcatgatgaggcatgatcagcatggattgccttcttcacacaacatctgcttcccgtcgttgacaatggtagatagaggttaagagc

SEQ ID NO: 67624 - DNA, 295 bp, Zea mays
  Clone ID: LIB3076-003-Q1-K1-G12
gatattataaacgtcaccttgatattgatttctgcatctcactatcctctggggtatatgtttttttctaatgggggctggaccttccaatactttaatgggaccatcgggcttaataacctctatgcttactgttcgctcataggatgcctacattttcatactactcccattgcatgatatttgctgtcgcctattgtttcctgatacacatttttgatattccttaaattcttaatttgtccatttgccaccttctctgtcatctctgattatttgtaatcccatgttttac

SEQ ID NO: 67625 - DNA, 444 bp, Zea mays
  Clone ID: LIB3076-003-Q1-K1-G2
aatatccggctcgaggcacgcgtgcgctgacgcgtggggcacattatgttctctgtcataattttgcatatggattatatgaacaggattttggaaaatggattactgtgcttgttaattctgtgactggaaaaataattttcgggatactttatgaatgaacacattaaaggagctgtagtcttcaatgtttcaaaaagatctctgatgctatctcatgttaaattgtcagaaacttccacatctaggatcctttttgtccataactttatctctttacacatcttaattgttttgattttcacttattaacatgctatatatttttttttataaaccattactccttttttttctaaatatttttaaatagcttgatctattttgttccccaatatttttttctttttatctatatatttttttgatattttttcaatattt

SEQ ID NO: 67626 - DNA, 231 bp, Zea mays
  Clone ID: LIB3076-003-Q1-K1-B12
catggccgccataaacatctctttcaaagtctttatcttctggttccgatcgcgcacatgatatgatatcaagggggctggggctaatcatgaactctttgatgcatatgacgattgcatgaggatgcatccacgatcttcattcatggccttctttgaggtggttaaatggattaagtgttacctgctaagatgtttaaatgtatgctatccattctttgctgttaatat

SEQ ID NO: 67627 - DNA, 110 bp, Zea mays
  Clone ID: LIB3076-003-Q1-K1-B2
tttgggtttttgagggggtttttacggccgccccaaaaatccttttttttggtggaaacccccctcccggggggtttttttttataaccccaaaaaaccctttttttttt

SEQ ID NO: 67628 - DNA, 313 bp, Zea mays
  Clone ID: LIB3076-003-Q1-K1-B4
gcgcccacgcgtccgccaacgcgtccgcggacgcgtgggtgcaaccagatgacgttgtggctgacgaagatatgcgatatgaatgtgatgataatcgtgaactgaaaccaaaagagaaaccagtcggtccaccactagacttggtggttccatttaagcaaccaccagctcgacctgacaaaatgaatgtgatcaaggtatcaaacattatggggattgaccctaaaccctttgatccaaaaacgtatgtggaagaagatgtttttgttacagatgaatctgggactaagaaaaggatacggctagaggacaa

SEQ ID NO: 67629 - DNA, 257 bp, Zea mays
  Clone ID: LIB3076-003-Q1-K1-B5
cggacgcgtgggcgccgtctgccttctgttcctccatttcggcctctgtcccttgcaagtgcactctcgcctgcaaccatgggtaaagagaagtcccacatcaacatttgggttattggcccattcgactcttgcaagtcgaccaccacaggacaccttaactacaaactttgaagcattgacaagcgtgtgatccataggtttgagaatgatgctgctgaaatgaacaagctggccttcaagtacgccttggtgct

SEQ ID NO: 67630 - DNA, 320 bp, Zea mays
  unsure at all n locations
  Clone ID: LIB3076-003-Q1-K1-B6
cggacgcgtgggcgccgtctgccttctgcgcctccatttcggcctctgtccctggcaaggtcagtctcgcctcgaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaacaagcggtcctttaagtacgcctgggtgctcgacaagctcaaggctgagcgtgagagaggtatcaccattgatattgctctggnggggggggg

SEQ ID NO: 67631 - DNA, 322 bp, Zea mays
  Clone ID: LIB3076-003-Q1-K1-B7
catgaaatgcagcatctgtcatgaagagttcgcggagggcgaagaggttgcgaggctgcgatgcgatcaccggtgccatgggtgctgcataggccattggcttgggcagaagaactggtgtccagtatgcaaagcgtctgccgtgccttccaagggctgaagcattggggatgctggaaaccccgttccggattacaaaccattcttgcttttgtctacgtacattgatcttttacctatatgcattatatatagatcatgtctagattgatgacgctagaacagcttgcgatttgggaggaagctaataataattgttttt

SEQ ID NO: 67632 - DNA, 408 bp, Zea mays
  Clone ID: LIB3076-003-Q1-K1-B8
catgaaatgcagcatctgtcaggaagagttctcggagggcgaagaggttgctaggctgccgtgcgagcaccggtgccatgtgtgctgcataggccaatggcttgggcagaagaactggtgtccagtatgcaaagcgtctgccgtgccttccaagggctgaagcattggggatgctggaaaccccgttccggattacaaaccattcttgcttttgactacgtacattgttcttttccctatatgcattagatatagatcatgtctagatgtatgacgctagaacagcttgcgatttgggaggaagcttatacccaaaagggttttaatattagtttaagaacccttttgggggggtttttttttaaaaaaatttttataaaatatttttaataaaggattttttttttc

SEQ ID NO: 67633 - DNA, 349 bp, Zea mays
  Clone ID: LIB3076-003-Q1-K1-C11
cccacgcgtccgcccacgcgtccgcccactcgtccgcccacgcgtccgtgtaccttgaagatagaactgtgaggctccaagtctgggatactgctggtcaggaaagattcaggagtttaattccaagctatattagagactcttcagttgctgtcattgtattcgatgttgcaagcaggcagtccttcttaaatacatctaagtggatagaggaagttcgcactgagaggggcagtgatgttatcattgtgcttgttgggaacaaaactgaccttgttgacaagaggcaagtctcaatagatgaaggggtaggcaaggcttatgaccttggagtcatgtttattggaac

SEQ ID NO: 67634 - DNA, 195 bp, Zea mays
  Clone ID: LIB3076-003-Q1-K1-C4
gattcaaacccttttgatggatatacttcgttccagataggaagtttggtttgttaatctgtagtctcgagtatttgctcgaggagaccacccaccagaacggagccttcttgtcgccggaccaggcatcgattcgcacactgtatgaggcgatgctgaaagaaaaaaaaaggaaggcagcaccgatgttcggtc

SEQ ID NO: 67635 - DNA, 115 bp, Zea mays
  Clone ID: LIB3076-003-Q1-K1-C5
ccagcttcagcgacctcaaccatctcattttcgccaccatgagcggcatcacctgctgcgtcctctttccaagggagctggactctaacctttgtaagctgtccgacaacctgat

SEQ ID NO: 67636 - DNA, 303 bp, Zea mays
  Clone ID: LIB3076-003-Q1-K1-C6
ccagcttcggcgacctcaaccacctcatctccgccaccatgagcggcgtcacctgctgcgggcgcttcccggggcagctcagctcggacctccgcaagctggccgtcaacctgatcccgttcccgcgcctgcacttcttcatggtggggttcgcgccgctcacctccaggggctcccagcagtaccgcgccctgacggtgccggagcttacccagcagatgtgggacgccaagaacatgatgtgcgccgcggacccgcgccacggacggtacctgacggcgtccgacatgttccgcggcaaga

SEQ ID NO: 67637 - DNA, 268 bp, Zea mays
  Clone ID: LIB3076-003-Q1-K1-C7
cccacgcgtccgaccacgcgtactccggatatgatcaacgaggtcgatgctgatggcaggggcaccattgatggcccagagtgtctcaaccttatggatctcaatatgaacgacaccgcctctgatgaagatcatcacggaggccttccgtgtgtcagacacggaccagaacggcttcatctcggccgacgagctccgccatgtcattacaaatcttggctaaaagctatctgattaacaagtgaccgatatgaaccaataggctcat

SEQ ID NO: 67638 - DNA, 293 bp, Zea mays
  Clone ID: LIB3076-003-Q1-K1-C8
cccacgcgtgcgaccacgcgtccgccggacatgatcaacgaggtcgatgctgatggcaggggcaccatagattgcccagagtggctcaaccttatggatcgcaatatgaacgacaccgactctgatgaagatctcacggaggccttccgtgtgtcagacacggaccagaacggcttcatctccgccgacgagctccgccatgtcatgactaatcttggctagaacctaactgattagcaggtgaccgatatgatccaataggctcatctcgctggtgacatgcagatcaacta

SEQ ID NO: 67639 - DNA, 314 bp, Zea mays
  Clone ID: LIB3076-003-Q1-K1-D3
ctgacgcgtggactcctgtacgcatcgaaatgctggtgaccgtacttacagagcttcaagcgtacttgctagccgaatgcgggtatgataccagtgtagtgattactgcacatgttcacaaaattgccggaaccgagttgtacagaaaggtacgcagatccgttttgaagtttttaagacaggacatcgtcgttggggcctccgtagttgagatccaattccagcacgcacatttatctgtgaatatgcacgtgaaatcattgacgtaaatcgagtgaatggtcaagatcactacatatttgagacttctgctt

SEQ ID NO: 67640 - DNA, 400 bp, Zea mays
  Clone ID: LIB3076-003-Q1-K1-B11
catggcggccataaagatctcttccaaagattttatcttctggttccgatcgcacacaacaaaggagatcaagtggggtggggctaagcatgaaccggttgatgcagatgacgatggcaggaggatgcatccacgatcttcattcaaggccttcttggaggtggttaaatggagaagtgttccctgggaagatgttgaaatggatgctatccattctttgcagttaatattacgtggctccctgccagatgaagatgccaacagaaacaatgtaaggtccattgtaaaagctccatctgatgatatgaagaagatacaggggctacttgaactgagaacagttacaaatgagatggtccgcttaattgagacagcaacttgccccgtcttggctgtcgac

SEQ ID NO: 67641 - DNA, 315 bp, Zea mays
  Clone ID: LIB3076-003-Q1-K1-D4
cggacgcgtgggctcctgtacgcatcgaaatgctggtgaccttccttacagtgcttcaggcgtacttgttagccgaatgcccgttttatacgagtgtggtgattcctgcacatgttcacaaaattgccggaaccgggttgtacagaaaggtacgcagatccgttttgaagtttttaagacaggagatcgtggttggggcctccgtagttgggatccaattcgagcaggcacatttatctgtgaatatgcaggtgaaatcattgacataaatagagtgaatggtgaagatgactacatatttgagacttctccttt

SEQ ID NO: 67642 - DNA, 306 bp, Zea mays
  Clone ID: LIB3076-003-Q1-K1-D6
tccactcgtccgcccacgcgtatttccatttatgtggatctgaggatctccagggtcatggggaaccagcaccgggccgagcacgagcttcagtctctctgagaatacgtgaaggagatcctcataccagagtgcaacgttcaacccgtgaatagccctgtgacggtttgcggcgacatccatgggcagttccatgacctgatgaaactcttcgcgactgggggccactttctatagaccaactatattatcatgggtgatattgagtaccgtggctttaacagactggaggttatcaccatcctg

SEQ ID NO: 67643 - DNA, 381 bp, Zea mays
  Clone ID: LIB3076-003-Q1-K1-D7
cccacgcgtccgcccacgcgtcctgccatttatgtggatctgtggatctccagggtcagggaggaccagcaccgggccgagcacgagcttcagtctctctgcgaatacgtgaaggagatcctcatcgaagagtctaacgttcaaccggtgaatagccctgtgacggtttgcggtgacatccatgggcagtaccatgacctgatgaaactcttcgcgactgtgggccacgttccatatactaactatattttcatgggtgattttgtggaccgtggcttcaacagtctggaggttttcaccatcctgttagcttttaaaccctttttaaaaaataatcgaaagaggtattaaaatttttctatccttttttgggatcctcat

SEQ ID NO: 67644 - DNA, 324 bp, Zea mays
  Clone ID: LIB3076-003-Q1-K1-D8
cccacgcgtccgcccacgcgtccggccatggatgtggatctgtggatctccaaggtcaaggagggccagcacctcgccgagcacgagcttcagtcgctctgcgaatacgtgaaggagatcctcatcgaagagtcgaacgttcaaccggtgaatagccctgtgacggtttgcggtgacatccatgggcagttccatgacctgatgaagctcttcgcgacggggggccacgtcccagagacgaactatattttcatgggtgattttgtggaccgtggcttcaacagtctggaggttttcaccatcctgttgcttttaaaccccttt

SEQ ID NO: 67645 - DNA, 433 bp, Zea mays
  Clone ID: LIB3076-003-Q1-K1-D9
gctggatctcagacctgcagccttgcaagtgattaatagactgcatcaagtgctgtatcgaaattcaccaagcgggctaggggctactaaaagttcctagggctcaatggttattcctaccgttcatgaatcacttcatcaatacaatccatgatctactgtgttatgtattgctgaactaactaatgcaactgcatctcaattatttaactggacttgatttttattgtcatatgatcctgtgttggctattggtaccgtttatgttgctacttcaactcaagctcattaatttcattgtgtgttgatgaaattgcttcatgattatgttattccctattttcttgcattaaccctgattatttattaagtttccttacctctttaatacttttttgttccttgctttttattcttattatatttttttctt

SEQ ID NO: 67646 - DNA, 337 bp, Zea mays
  Clone ID: LIB3076-003-Q1-K1-E1
ctccagggaccagaactagggtttgcgaaatcgtgacgcgagcacttgaagattcgcgaaagacagcgcgaccgacccacggcgatggccaccgtccaccctcaatccccggcgggtcccacccatctcccgcaggaggagcgacacggggacgccccggtaccgcccgccgtctccggcgaacccgccgccgcagcggaggcgggcggcgagatcgccgcgctcgacaagcagctcgccgtcgtcggcggcggcgaggagaggaggccggccggggccggggccggggccgtcagcgcaggcgggggagggaaagcctttttggggtttttggggg

SEQ ID NO: 67647 - DNA, 296 bp, Zea mays
  unsure at all n locations
  Clone ID: LIB3076-002-Q1-K1-E4
gcctgaagctgtgcgccccggttcggtgggcgtgaaaggggagaaaagagggcgggaaggaccgcggattttgctagggtttgcggtttctgcttcacactgcctcctcagtcctcaccaccacagccgtcgcgcgcaggagggtagggaggatgccacgtaagatcaccttggtcaaggagggtgagccgcagccggtggacgctggtcaaggggagcccgctccggcaccggcggcaccgacgtgtcgtgttgacggatgcggangtggacgagctgcccagggccatcgtgcg

SEQ ID NO: 67648 - DNA, 173 bp, Zea mays
  Clone ID: LIB3076-002-Q1-K1-E7
gcgcccacgcgtccgctgacactcttaagaatgtatctcggccgtgggtgtatgtttgcggcgggacgatcaaccctactggctttctggacagtgacagtgacattcgagagctggtcttcgtatgcgctgaatatggagccagggtagtgagagatacatacttttctggg

SEQ ID NO: 67649 - DNA, 373 bp, Zea mays
  unsure at all n locations
  Clone ID: LIB3076-002-Q1-K1-F2
cccacgcgtccgcaagaagtttgctcaccaggatgagtatgattcctcgattggcgtcgctgaaggggcaccaccagagctcacgtccccaaatccagcccaatgaacctctgtttctgttttctctttggcgccttaatcattttctgttggacagtgctggatcgttgatcggggtactgttagatgacactggtggtttatgttgacttttcctccccaataatcttggatcgagcgatgtgataaagctggccatgcacttcttccagattctgtattcggtatggntaaaatgggctccctttcataacctctgaagaagagttttagcaccgtccatattcgtcatgagttctgtactatgctttct

SEQ ID NO: 67650 - DNA, 121 bp, Zea mays
  Clone ID: LIB3076-002-Q1-K1-F6
tgtcaaacatgctgacctgcggtcgaagaatcgatatatatatatcttatcttgcttcgtgctgtctgaagataaacattatatatcttgtttcctttggagaaatattagcaattttagc

SEQ ID NO: 67651 - DNA, 385 bp, Zea mays
  Clone ID: LIB3076-002-Q1-K1-F7
ctcctgagcactttctcctcgtcccagacaagccaatcgaagccgagatacgaccatggggtccaccggcaccggagcagggggtaaggggaagaagggagcggccgggcgcaaggtcggcgggccaaggaagaagtcggtgtcgaggtccgtgaaggccggtctccagttccccgtcggccgtgtcgggcgctacttgaagaagggccgctacgcgcagcgtgtctgcaccggcgcccccggttacctaggcgctgtgctcgaatacctcggcgctgaaggtctggagctcgccgggaatgctgccaaggacaacaagaagactcgcattattccgcgccaagtgcttctggcgatccggaacgacgaggagctttgggaagct

SEQ ID NO: 67652 - DNA, 395 bp, Zea mays
  Clone ID: LIB3076-002-Q1-K1-G2
gtgcttaaatgtaaatcaatgcccatggatgaacaaagtgcaaatcttcaacaaaggtatgtttctaagtcttagtacattggttttgtgtactaatatatttgtctaagtgttagaaacagaaagaagaagagaagagaagacttggctgtgtgcagccaaggggctgcttcggtctagggcaccggactgtccggtggtgcaccggacagtgtccgatggtgcaccggacagtgtccggtgcgccaggccggcttggccgaagaggccgctctcgggtttttctccggcgacttcggctaaaattcaccggactgtccggtgtgcaccggactgtccggtgagccaacggtcgggcgggccaacggtcgggcgcgtgatcggcgcgcgacacg

SEQ ID NO: 67653 - DNA, 291 bp, Zea mays
  Clone ID: LIB3076-002-Q1-K1-G4
cggacgcgtggggctgagtagctgctctcggactgtaccgctgtaaggctaacaatctgagcgtctccttgagctcttagggacaagcagaaaataaccgtttgatgagctttcctctcatttaagtagcgtggtgaaagctatttgtttgaggttctttaggattcgcgccgctgtgtcactcttagtgagaccaggcattctcgtggtgtgaatcttgtatcatatcttagtcacaccttgccttggattcgtggcaacgaatgtaatgtttgatacgttagacccttc

SEQ ID NO: 67654 - DNA, 453 bp, Zea mays
  Clone ID: LIB3076-002-Q1-K1-G6
ggttgactctctagccatgcatcccactgcaaaccatgggttggatcttcagcatgagggcattgcagaatcagagaacctgacatattcgcttctgcatgattcatccaatggcgcagcaggtggcagtgttcaggcagatggtcctatgcaaacaccagagaatttggaccatctgattgtgcagagcaatcctgttccaaatgaagctcacctggatgactttgcgggtgcccccgctaatcaattaccaatagaagaagaagaagaagctcatcatcctgagatgtcaaggctggagcctacaaacattctgttcgagttcgatagggtttaagcggtgacctgcctggctgcctcatcagcatatccctaacccatgaataataaatcagtgccattgaggtgcccctttctaggtctcctgcatatgagacatgtctggtgtcccct

SEQ ID NO: 67655 - DNA, 476 bp, Zea mays
  Clone ID: LIB3076-002-Q1-K1-G8
cccacgcgtccgattttgattcatgtgcaatggagaaatgtgatgaccgtactgatacgattgaaccctccaatactgtaaatggcatgcaaattgaagagacggaagatgctccagaggacttggatgacttgcagacggaagaaacggaagagtcttcagatgaagatttagatgatgaccgtgtgattaacattgctccccgcaagtccaataagccagcagttcgagagaacataaagcatgaagtgaataaggactcacagttacaaaagcgtccaaggattgaagagacttccctgccaaagaagaggcagagatctgaagcctcatctgaacctataaaaaggaatggagaacaacatgtttcagttactctagacactagaaccgcaggcaagactgtgcctggaaaatcagaagccagccaaaatgaacagaagtctctggattttgaaggaaaaagaacatatgat

SEQ ID NO: 67656 - DNA, 150 bp, Zea mays
  Clone ID: LIB3076-002-Q1-K1-H1
cccacgcgtccgttcacgcgttcgacgcacaccaatcgcccacaagcgctcgcaggagaggtcggaaccctagcttttgcggcggctgcggccgatagaagatgatctacgacgtgaactcccccctcttccgttccttcctcagccaga

SEQ ID NO: 67657 - DNA, 238 bp, Zea mays
  Clone ID: LIB3076-002-Q1-K1-H5
cggacgcgtgggcggacgcgtgggcggacgcgtgggcacaacgaaaacacaaacgcacacaagcacacgaggcaagggtgacgactgacgagagggggagagagagaggcgaggaaggagggagagagcacgggggcttgatcgaagatggatgccggagcaaaggtggtgaagaaggccgcggctgtgcgtcgcggcgggggctggcccaagaagaagccggtctctcgctccgtga

SEQ ID NO: 67658 - DNA, 152 bp, Zea mays
  Clone ID: LIB3076-002-Q1-K1-H6
ctgacgcgtgggcggacgcgtggtcggacgcgtgggcacaacgaagacacaaacgcacaggagcacacgaagcaagggtgacgactgacgagagggggagagagagaggtcatgaaggatggagagagcacgggggcttgatcgaagatgga

SEQ ID NO: 67659 - DNA, 449 bp, Zea mays
  unsure at all n locations
  Clone ID: LIB3076-002-Q1-K1-H8
gtttacaccttgacacctaaggccagagattggagagagaaagaagcagctgagtggagcaagaaagaagaggtcatggcggtgtagtctatcagctgagtgggaaagagtggagcaatggtggggggctgtgccagcggcgacggcgccgccgaagggacgctcgcgaggtggcggagggcggcggccaagcggatcggcctctcatgcgcctncttcttctcctacgccgcctctccctccccgcctgcttccaagaccatctcccactccgcactgaatgcgcctgatggagagcagcaaangatggaggaacccaccagcaccagagtggctgacaagaatctatgtgcaatatgtttggaactcctcagcacgagcatcagcagcgatgttgatagtggtgaggcgggagcaatctacacagcgcagtgcttccactcattcca

SEQ ID NO: 67660 - DNA, 324 bp, Zea mays
  Clone ID: LIB3076-003-Q1-K1-A1
tcgcggacgcgtgggccctgtcccgctaggattccccccaaaccctaccccaaaaccccagagcggagaagagcgcaagatgttcggcttcgggcaccacggccaccacggccagaacccgtcggcgcacggcggcgtgcaccagcccacctttaagatcttctgcaaggccgacgaggggtactggctcaccgtccgcgacggcaacgtggtgctggcccccggcaacccgcgcgacgagcaccagcactggtacaaggacatgcgcttcagcacccaagtcaaggactaagagggcaaccctgcgttcgccctggtcaacaa

SEQ ID NO: 67661 - DNA, 271 bp, Zea mays
  Clone ID: LIB3076-003-Q1-K1-A12
gcgtccacgcgttcgcccacgcgtgcggcctttctctcgtcgacgatctcaggcgctcgcggggagtcgagtcgagaccagcttggttccgtcataaaaagctcacttagttgttgtccccgcctctttttttcgctgttcttgtttgattacatcatcttattttgtgcttgaatctaacctgccattaagtttttatcgcttcgttatttctctggtgtgcttgtctagttcctttgttgctctaaccatggacgcaggctcccgctcg

SEQ ID NO: 67662 - DNA, 284 bp, Zea mays
  Clone ID: LIB3076-003-Q1-K1-A3
cggacgcgtgggccctgtcccgctaggattccccccaaaccctcccccaaaaccccagagcggagaagagcgcaagatgttcggcttcgggcaccacggccaccacggccagaacccgccggcgcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgctttagcacccaggtcaagg

SEQ ID NO: 67663 - DNA, 357 bp, Zea mays
  Clone ID: LIB3076-003-Q1-K1-A5
cccacgcgtccgcccacgcgtccgcccacgcgtccgcggacgcgtgggcatcgagttgggattccatgtatttggtaccatcgtgagagttccttgaaggagcgggctaacaatttacagtcttttcgggaaaatggtggtgtgcttgtatgcactgatgctgctgcccgtgggcttgatgttccaaatgtttctcatgtcattcaggcagaatttgctgcctgtgctgttgattttttgcacagggtgggccgcacagccagagctggccaatctggtatagttactagcctatacacagaggcaaatcgtgaatttcccttttgggggggtttaaagcagcccaaggggtttttt

SEQ ID NO: 67664 - DNA, 319 bp, Zea mays
  Clone ID: LIB3076-003-Q1-K1-A7
gccacgcgtccgctcgtccatcgcatcgttgcggctcccagcgcaatcgatcgatccgggcctaggtgtgcttgagctatgcagttcatcagcgtgcttcccctagagggaaaagcgtgtatgagcccagtgaggaaaggcagtggacgttatgggagtgagaggatgaggatcaactggtgcaatatcaagcgcaacaaggcactaaggatgatgtgtttcattgcaaggggtgctgctagcagcacccagtgtgtgctcacatcagatgctggcccagacactctatgtcgtccgaacatgacttcggaggaaattt

SEQ ID NO: 67665 - DNA, 243 bp, Zea mays
  Clone ID: LIB3076-002-Q1-K1-E3
gttttcacaaatgcgtcctgttgcaatggcaccttcagtaggtcctcgcatgcccatgttgccacctagtgttcctggagttggtcagcagctgttttatggtcagccacctccagccttcatcaaccctcaggctggatttgctttccagcaacctatgatgcctggtatgaggcctggtggtccaatgccgaactttatgatgcctatggttcagcagggacagcaaccgcaacgtcctgc

SEQ ID NO: 67666 - DNA, 316 bp, Zea mays
  Clone ID: LIB3076-003-Q1-K1-A8
cccacgcgtccgctcgtccatcgcatcgctgcggctcccagcgcaatcgatccatccgtgcctaggtgtgcttcagctatgcagttcagcagcgtgcttcccctagagggaaaagcgtgtatgagcccagtgaggaaaggcagtggacgttatgggagtgagaggatgaggatcaactggtgcagcatcaggcgcaacaaggcactaaggatgatgtgtttcattgcaaggggtgctgtgagcagcacccagtgtgtgctcacatcagatgctggaccagacactcttgtcgtccgaacatgctttcggaaggggg

SEQ ID NO: 67667 - DNA, 111 bp, Zea mays
  Clone ID: LIB3076-003-Q1-K1-B1
gacccgccctgtaacggctcattaagctccgctggttgtggcttggggtttttttttttaccccgcttccaaacctttttttggtaaaccccccctctgtgggtgtttttt

SEQ ID NO: 67668 - DNA, 309 bp, Zea mays
  Clone ID: LIB3076-003-Q1-K1-B10
cgaggcaggccacgcgttactccacgcgtgcggcctgcctgttgtcgacgatctcaggctctcccggggagtccggtctagaccagctggcctccgtcataaaaagctcacttagttgttgtccccgcctctttttttcgctgttcttgtttgattacatcatcttattttgtgcttgaatctaacctgccattaagtttttatcgcttcgttatttctctgtttgtgctagtcttgttcttttgttgctctaaccatggacgcatgcttccgctcgatctcctcggcgaagaaccgcgccgtcttcgt

SEQ ID NO: 67669 - DNA, 328 bp, Zea mays
  Clone ID: LIB3076-002-Q1-K1-A1
cccacgcgtccgccacttcctcctcctcgcgagctcagctcgcgcaccggcgcgggcggacaaggagcaggcggaggaggagctgtgccaagccacaatgggtatctcgcgtgactcgatgcacaagcgccgggccaccggtggaaagcagaaggcctggaggaagaagcgaaagtatgagcttggtcgccagccagccaacaccaagttggcaagcaataagacagtgaggagggtccgggttcgtggagggaatgtgaaatggagggctcttcgccttgatactggtaactactcatggggaagtgaagctgttacccgcaagacc

SEQ ID NO: 67670 - DNA, 255 bp, Zea mays
  Clone ID: LIB3076-002-Q1-K1-A2
cggacgcgtgggcttcctgcaaggctgcattgatctcgtcttgttgtttctggcccaacacttggtttattgctcaaccttaaccccggacttgttcttctacaggacagcgggtacagcgctagttattgcttcaccttccttatctttgctgcagcaactggaggccgaggcttttacaaggagctggggaagaatgggcagaagctgctatcgaatctgaagctttgcttggcacaccagcactggagagat

SEQ ID NO: 67671 - DNA, 124 bp, Zea mays
  Clone ID: LIB3076-002-Q1-K1-A3
tcgacaaattccgtgcttccccgtctgaaaacccttcccaacttcggcggccgccgccgcgcttgcgaacgggtggcttcttcggcgaggcttcccccttggtaccaggttggcctttcttttc

SEQ ID NO: 67672 - DNA, 394 bp, Zea mays
  unsure at all n locations
  Clone ID: LIB3076-002-Q1-K1-A4
atcttacgtccccaaatcgaccgagcgaattcaccacagcttctcaccaccgctaccttcgatggcacccaaggcggacaagaagccggcggcgaagaagcctgcagaggaggagcccgcgacagagaaggcggagaaggctccggcggggaagaagcccaaggccgagaagcgcctcccggcgagcaagtccgccggtaaagagggcggcgagggcaagaaggggaaaaagaaagcgaagaagtccgtggagacctacaagatctacaatctcaaagggctgaaacangtgcaccccgacattggcatttcgtgcaaaggcatgtccattatgaacttctttattaacgacattttcgagaaactcgcgggcgaatccggcaagctggcgcgc

SEQ ID NO: 67673 - DNA, 469 bp, Zea mays
  Clone ID: LIB3076-002-Q1-K1-A6
agcgggcaaaataaaagaaaaatctgatgataaatatgacagagatcctagggaaaaattagatcggggtgaaaggcgtcgtggggaagatgccattgagagatcaacagatagattgtcggacaggagagaacgttccattgaaaggatgcaagagagaggtacagataaagcccttgaaaaaggtagagaggatagaaataaggatgagaggaataaagttaaatatgctgaaccttcggtggaccggacacattcttctgatgaacgattccgaaggcaaaggttggcaacggccccaactatttccggaaggtttggaccccaatcaattggcgccaaccgacgtgaagaagatgctgaccgaaagggtgggagcttcaagcatggtcaaaggtcatcttctaagcacgatgagaaagaaaggaagcagtcagaggagaatatttcgtcatttcaggatgatggg

SEQ ID NO: 67674 - DNA, 364 bp, Zea mays
  Clone ID: LIB3076-002-Q1-K1-A7
ggcgctactccgagcgctccggcgagcccttccggcgctctcctcgccggcggcggttgggccccgtcgcgccccgcgcccactacctcctccgcccgctcctcgtcggttcctggacccgatcgggctccgctccttctccgccggcgccgccaccgcgtcgcaggcgccggccatgggggccaccgtagtcggcgggctcatgggcgcccggttcccgaagcgccggccgggcttcgccaaccgagagatgagggctagcttgcgccccagaggtccctactactgggtgaagtgcaagcctgacgagcccataccagttaggcagccgaaccaagggagcattcgagggaggaaggagaag

SEQ ID NO: 67675 - DNA, 390 bp, Zea mays
  Clone ID: LIB3076-002-Q1-K1-A8
cccacgcgtccgcccacgcgtccggcctggagggctgatattcatgacatgttatctaatagaaacactgtcctgtagtgtaatcatgttatattttctgttctgaacaaattcaaagaaatctcatggagacaaactttgatagtacaagttggaggtctcgaattttaaggtaatattgcgctagtattgtcatttgcagtattgatctttgttggtgcaacctaacattagattgatgtgaatgagctgctgtagacgtttgatttaatctgcatgtgctatttttgtggagtttgatatgtatgtgcttacatttcgtgacttagcaataccggttgtatgctgagaatgttgaaaagctattacgttttctgtgaacagttgtgt

SEQ ID NO: 67676 - DNA, 331 bp, Zea mays
  Clone ID: LIB3076-002-Q1-K1-B3
cccacgcgtccgcacaccccccgagctcagcttacctccactccagctccaatcacaggggtgaccagagcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcgggccgacgaccccggggggcctgatcgcggcggcggtggcgcacgcgttcgcgctgttcgtggctgggtctgtgggcgcgaaca

SEQ ID NO: 67677 - DNA, 253 bp, Zea mays
  Clone ID: LIB3076-002-Q1-K1-B5
gttcagtggtctgggaagaaccagcagcaaaattccaatgcagcacttaggcaggtgaaagcttggactgagcttttgaatgctttttgcacgagtggcagactcgaactggaacttatacacaaagttcagacacagtgctatgaagatgctaagctgatgaagctgtttccggaaatcataagaacactgtatgaccaagatgtcctagctgaagatactatagtcctttggttccgtaaaggttcaaacc

SEQ ID NO: 67678 - DNA, 308 bp, Zea mays
  Clone ID: LIB3076-002-Q1-K1-B6
attcacaatggccagatcggaatgggacaatcagtgaaaagcagcattggtcatgctgagatgctttttaggtgccgagcttgtcagaggacctcagagctgctgggttgggttaaggatgtcttccaacaatgcgctcctggttgggatagggatgctttgttacgcgagcttgagttcagatgtaagatattccgtttaagtgaggatgcaaaagggagagtgttgttcaggaaatgtctagatctaattaaaaggctaagaacactccagctgattccatcaatcctaggatgattctacaagca

SEQ ID NO: 67679 - DNA, 338 bp, Zea mays
  Clone ID: LIB3076-002-Q1-K1-C1
caccaccgctccacacacaagaagagagccgagagctagctacctagcgcgcgatggcgatgtccgcttccaagatgatggcggtcgccgccgctgccctgctagccctggtcctggccgcgtcgaccgcggaggcgaggaacatcaagacgacgacgacgacgacggagaagaaggacgatgcggtggtgcagccgcagacctttccggccttcgaccgcctcggcggcggcgcgtccccggcgttcggtggccttcccgggacctcgtcgggcggcagcagcattccagcgttcagcatgccgggcagcggcagcaggcttcccggcgggtcggtc

SEQ ID NO: 67680 - DNA, 255 bp, Zea mays
  Clone ID: LIB3076-002-Q1-K1-C2
aacacacccaaatacagatttgttgtgcgatttaccaacaaggacatcactgcccaaatgatatctgctagtatagcgggtgatatggttcttgcttctgcctactcgcatgagttgccacgatatggtcttgaagttggtctgaccaactatgcagctgcctactgcactggccttctgttggagagccgtgtgctcaagatacgtggtttggatcaagagtacgagggcaatgttgaagccactggtgaggac

SEQ ID NO: 67681 - DNA, 359 bp, Zea mays
  Clone ID: LIB3076-002-Q1-K1-C3
gtccagctccattcaaacagtttcttgagattgtcacaaatatgaaatttgatgaagagcgcaaattatgccaagcttatctctatttttgatggtttgattgaagcacctgcgtcgagaccagtcagaattgatggggccctcaaggttggacagaaacgtggaagattgcatgcaaatctagaagatgaacaacctaaaaagaaggttagattagggagcccagcggctcaatggatttcagtttataatgctaggcgacccatgaagcagaggtaccattacaatgtggctgactcaaggctaagtcaacatatagaaaagggtaatgatgacaggctttacgttaggtgtgtggg

SEQ ID NO: 67682 - DNA, 244 bp, Zea mays
  Clone ID: LIB3076-002-Q1-K1-C4
cccacgcgtccggcgccccgtagtgcagtgcagtgcagcagtgtgctacctcctcagtggtgtcactccatcacaaacgctagtcttcctctaaagctcggagcgagtctcagaagcgatggcgtccaagaggctgctgctggcggcgctgtgcgtggtggcggcggcgctgctcgccgtgcggtcagaggcccacggcctggatgacttcgcaagcagcgacgcgacgccggagatgcagacc

SEQ ID NO: 67683 - DNA, 292 bp, Zea mays
  Clone ID: LIB3076-002-Q1-K1-C6
gcgcgcactgcgctcggaaccttcagaagtgcgaacattgcggagatatggttgccagggggcttatggatgaacactacgatgaaaaccatgctccgatgaattgctcactttgcaaacacacagtagagcgcgagctatgggatcttcatacaggcatacaatgcccacaaaggatgcttgcgtgccaatactgtcagtgtgaactgcctgcagttgatctttttgaacatcaggatctgagtggagatcggactgaatattgtcaaagttgcaggaagtatatcagact

SEQ ID NO: 67684 - DNA, 427 bp, Zea mays
  Clone ID: LIB3076-002-Q1-K1-C7
aacagatataaagaacctgatgctgatatgataatggtggaaggaatatctcaatgggggaatgatctacaggttgatcctcaggatattgtcatgcttgtcatatcatggcacatgaaagccgccacaatgtgtgaatttactcgtcaggaattcattggtggactgcagtcaattggggtagattcaatcgagaagtttcgtggaaaattaccatcattacgagctgagctaaaagatgacagtaaattccgtgatatatacaactttgcattcacttgggcaaaggaaaagggtcaaaagtctctctcactggagactgctattggaatgtggcagttgctatttgctgaaaggaactggcctcttctggatcattggtgtcagtttttacagggcatggacagtaaaaccatatctagagaca

SEQ ID NO: 67685 - DNA, 331 bp, Zea mays
  unsure at all n locations
  Clone ID: LIB3076-002-Q1-K1-D5
ggaagacaggcaaagagggggaaaagctcaggtatggtagggtccctgaagatgtaagaccctcagctggccaagcactttacagatttccagtagagacagctcctggcgaaattcgcatgatgctttccagtcatgtttactcatttaaaagtgtttcaatggctgatcttctatctgcaccttcccaagtgaatggtgatgtggcattaggtggccaaganaaactcttggccaccaacactggcactgaagtcaccaaggatgcggatgctggacttgaatatggaaaagtatcttccactgaactgggacaagcagtccatgatat

SEQ ID NO: 67686 - DNA, 452 bp, Zea mays
  Clone ID: LIB3076-001-Q1-K1-H8
cccacgcgtccggattttgaaaagaaggcacactctgataacctcgaacaaagtaaagcaatggagaaaaatatgattgctgtggctagtgagattgagaggcttcgaggagagcttgcaaatgctgaaaaaggggccactgctgtcaacccagcagcagctgttggtaactctgggtatgctgcgccttatggcaattctgcgtcaacatatactggaatgtatggcaatcctgatgcaacgtataccgcgcaggcttatcctgacgcttatagcactaatcagggtcacatgcacaccgtcgccaatccgcattacatgagtcaacctgttccctatggacaatacgagagccagcacaccaatgttcaaagatgactggctgcaagagatagctttgactcgcctgccatctcattgtaacaagatagtcgcagaatccacccatgtac

SEQ ID NO: 67687 - DNA, 148 bp, Zea mays
  Clone ID: LIB3076-002-Q1-K1-D8
cccacgcatacgcggacgcgtgggtattttagctacacgttgttatcatatccacatggggtgccccacggtcgagtatataaagcctaggtggcaccccttcagaactatcgaccctattacttaaccacccacatcaactctctgc

SEQ ID NO: 67688 - DNA, 287 bp, Zea mays
  Clone ID: LIB3076-002-Q1-K1-E1
cggacgcgtgggctgctgttccgcctctcatccccctacttcttccaagatgcaatcatgctgccccaagctcctcgggccctcggccgccatgattgcctcaccgcctctcaagagtcgcctccacctactttcaagaagaagaggccggagaagctatagtccgtgaagaaatcaagcggaggggctgcggtgtatgaggggccggcggaggagagagagggccgggggaagtgacagaaagctagagagagatgcatgatggagcatgatgatggctgggtgat

SEQ ID NO: 67689 - DNA, 153 bp, Zea mays
  Clone ID: LIB3076-002-Q1-K1-E2
agcggacgcgtgggctgctgatccgcctgtcatccccctacttgttccaagatgcaatcatgcggggcccaaactcctcgggccctcggccgacatgattgcctcacacgctatcaagagtcgcctccacctacttccaagaggaagaggccg

SEQ ID NO: 67690 - DNA, 390 bp, Zea mays
  Clone ID: LIB3076-001-Q1-K1-F5
taaccctcgttcctgtcgcgcagccacgacctccacttacacatcttccccggcggcggcgcggtcagttgaaccatggcggactccaaggccacctcggctgtcaccctccgcacccgcaagttcatgaccaaccgtctcctggcccgtaagcaattcgtgcttgaggtgatccaccccggccgcgccaacgtctccaaggcggatttgaaggagaggcttgccaaggcgtacgaggtgaaggaccccaacaccatctttgtcttcaagttccgaacccactttggatgaggaaagtccactggttacggcctcaactactaacaacctcgaagctgccaataagttcgagctcgaaatacctgcttatcaggaatggactagctacta

SEQ ID NO: 67691 - DNA, 381 bp, Zea mays
  Clone ID: LIB3076-001-Q1-K1-F6
gaaaaactttccacttgctcaaaaaaaaaaaaaaaaaaataaaaaggacaaaaaaactggggagaaacaagcaaaaaaacacatgcatgctcacaataatagggggtcgtgtagcgttacttaacgttgtttctctgaccgtccttgtacggggtcctaactggaaataccctgccggttcctttctaagtggcgttgttgaacatcgtggtgtctccaaatgccatggtcttgcagaggttagcccctttggaccttatcatcatttgcacagtgtgcatggcgattgggacgccccctgggacggccctttgaacgtgtagggggtcctgcctttgaacagggttttcgcttcggttggcaaagctgttgcgcccggtg

SEQ ID NO: 67692 - DNA, 265 bp, Zea mays
  Clone ID: LIB3076-001-Q1-K1-F7
acgacactacacctgtcacatgcttccccgacgaccagggcggtcagctgaaccatggcagactcctaaggcaccgtaggtagtcacccgttcgcaccctcaagttcatgaccaaccagctgctggcccgaagcaatacgcgcttgaggagatccaccccggccgcaccaacgtctacaaggcggagttgaaggacaggcttgccaaggcctacgaggtgaaggaccacaacaccatctttgtctacaagttccgcacccacttc

SEQ ID NO: 67693 - DNA, 274 bp, Zea mays
  Clone ID: LIB3076-001-Q1-K1-F8
tcggcaccactagccttgtgcaagggacgaggccacaccctgatatgctctgctgtacccggagtgtgtgtcccggcgcctgaaacaggctttgcggccccggtgctgatcccttgccgctctgtatacaaactggtctgctactacacggagccggtcccagcaccgcgaaggcgatggttgctgtattccagatgccctcgaccggtgcctataaacccacatcatctacagctgtgccaatgtactcaacgaccacaatgactcctaggag

SEQ ID NO: 67694 - DNA, 301 bp, Zea mays
  Clone ID: LIB3076-001-Q1-K1-G1
tggcttctcctccccctccgggtcgggttcgggttcgcgaggttctccggggttcggttgcgcgggtgagcggatcgagatggcggcgtctgatgttgagtaccgctgcttcgtcggcggcctcgcctgggccacggacgaccactccctgcacaacgccttcagcacctacggcgaggtcctcgagtccaagatcattctcgatcgggagacgcacaggtcccgcggcttcggcttcgtcaccttcttcacggaggaagcgatgccgaacgccatcgagggcatgaaccgcaaggagctg

SEQ ID NO: 67695 - DNA, 425 bp, Zea mays
  Clone ID: LIB3076-001-Q1-K1-G3
caaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaag

SEQ ID NO: 67696 - DNA, 313 bp, Zea mays
  Clone ID: LIB3076-001-Q1-K1-G4
cttccccggacccttggccccccaaggaccagccgccccagaaccaattgtcgcctccgtccgtccggttcctcaattcccgaatccggtttaaacccggccccttaaggatgaactcccgggcagttccaaccagggtcgtcgtttgttccgtcgcgtttaccgaggggttcatttccgaagcgccgatccttcttcccgagggcccttggaaacaggtggaaggcggcgtccctgccgcgaaggggttcaaggcggcgggtatctaccgtgggttgcgtgccaaaggcgagaagcctgacttggcactggt

SEQ ID NO: 67697 - DNA, 455 bp, Zea mays
  Clone ID: LIB3076-001-Q1-K1-G5
caggggtgcgtgtgcacgggcgtgtgggtgatcgcgcacgagtgcggccaccacgccttgtccgaccacgcgctcctggacgacgccgtcggcctggcgctgcactcggcgctgctggtgccctacttctcgtggaagtacagccaccggcgccaccactccaacacggggtccctggagcgcgacgaggtgttcgtgccgaggaccaaggaggcgctgccgtggtacgccccgtacgtgcacggcagccccgcgggccggctggcgcacgtcgccgtgcagctcaccctgggctggccgctgtacctggccaccaacgcgtcggggcgcccgtacccgcgcttcgcctgccacttcgacccctacggtccgatctacggcgaccgggagcgcgcccagatcttcgtctcggacgccggcgtcgcggccgtggcgttcgggctgtacaagctggc

SEQ ID NO: 67698 - DNA, 449 bp, Zea mays
  Clone ID: LIB3076-001-Q1-K1-G6
ctgataatggggctaactctaaggctgcaggtatacttattatggagaaatatccaaaggtttattggaccccttgtgttgcacattgtttggatcttactccttcctttctttcttatttgttgccgtttagttcaaaaatgaacaagcaggcgacaaatatttgagaacggaggtagtatgttacaagacattgcagacataaggtattttaaaagacgtgttaaccaagccaagcaagtgacagacttcttttaggcatgggaggcttctcaatgcaatgagggaaaagacgggaggaagagatctactgaggctgacagtaacaagatttgccactttatttctgactttgcagagtttgtacaagcataaggatgctttatgtcaactcttattgtgtgaggattggaccagatccaaactggtagccacagatgcagggaaga

SEQ ID NO: 67699 - DNA, 305 bp, Zea mays
  Clone ID: LIB3076-001-Q1-K1-G7
acgctaagcaggcagacgatatagccgctgcagtcatgagtaaggagcaatctgagtgggtcaaggatgccatctgcgatatagatggggatgccaaggctacgaataggaagttcaatgagactgcggaacttcaaattgtgctgaagaattatgatccacagaaggaccagcgtttgagtggctctggtcagttgccccatatccctcgtcccaagatgaaggtgcgcatgcttggtgatgcccaacatgttgaggacgccgacaacatgggacttgactacatggatgttcaggctgtcgag

SEQ ID NO: 67700 - DNA, 428 bp, Zea mays
  unsure at all n locations
  Clone ID: LIB3076-001-Q1-K1-G8
cggacgcgtgggggctgttcaacttcaagaaggacagggatggttactggaagtggtttgctggcaacctggcctctggtggtgctgctggtgcttcctctttgttttttgtgtactccctggattatgcgaggacaaggttggccaatgatgccaaggctgccaagggaggaggcgatagacaattcaatggtcttgtggatgtctaccgcaagacactcaaatctgatggtattgctgggctttaccgtggatttaacatatcttgtgttggaattattggttatcgtggcctgtatttcggactttacgattctatcaagccagttgtcctcactggcagcctncaggacaacttctttgccaagtttgctcttggttggctgatcaccaacggtgctggtcttgcatcttaccccattgatact

SEQ ID NO: 67701 - DNA, 458 bp, Zea mays
  Clone ID: LIB3076-001-Q1-K1-H3
gtttcattgtgcaactgcgaagcttagaggatcactccccacttcctggtgttaccctcggtgatattggtggaaagttcggtagtggtgcatataacagtatggataatggtgttcttcgatttgaccatgtgcgcatcccaagggatcaaatgttgatgaggctttcacaagttacaagggaggggaaatatgttcactcaaatgttccaaagcagctgttgtatgggacaatggtttacgttcgccagtcaattgttgcagatgcttctaaggctttgtcccgtgctgtttgcattgctgtacgatacagcgcagtcagaaagcagtttggctctcaagatggtggccctgagactcaggtccttaattacaagactcaacagagcagactctttccattgctggcttcagcatatgcatttagatttgtgggtgattggctcaactggctatat

SEQ ID NO: 67702 - DNA, 458 bp, Zea mays
  Clone ID: LIB3076-001-Q1-K1-H5
cccacgcgtccggcagctcctatgggccaggcaggatcaatcaatggtcttatttatgatgactagccatgttccgtcctctgctctgataaccattggttcgggcatttgtcattttttgttcactcgtttagtttgcagagcagattggttcgatggatactggaacgattacttggtgcctcaatttgactctgtcccgtaaaaaaaagattctcctagctgttaaggaaggatcggatttggcacccaccacccagcacacataatagtgggagtgaccataaacagctaggaatatccacagttgcagatagataatggtgacgaaataaatgctaattggaaactgttggtttaaaaaatgaaacacagcccatagacttaattcagaagaagttagcagatcatttgatacaaacttgaatacttagtccctagatgtcttattttaagag

SEQ ID NO: 67703 - DNA, 445 bp, Zea mays
  Clone ID: LIB3076-001-Q1-K1-H6
cccacgcgtccggcagctcctatgggccatgcaggatcaatcaatggtcttatttatgaggactagccatgttgcggcctctgctctgataaccatagcttcgggcatttgacattacatgttcactcgtttagcttgcagagcctattgcttcgatcgatactggaacgattacttggcgcctcaatttgactctgtcccgtacaaaaaagattctcctagctgttaaggaacgatcggatttggcacccaccacccagcacacataatattgggagtgaccataaacagctaggaatatccacagttgcagatagataatggcgacgaaataaatgcttattggaaactggtggtttaaaaaatgaaacacagcccatagacttaattcagacgaggttagcagatcatttgatacaaacttggatacttaatccctatatgt

SEQ ID NO: 67704 - DNA, 294 bp, Zea mays
  Clone ID: LIB3076-001-Q1-K1-H7
ctgcgtcattgcgcaactgcgaaactaagaggatcactggctacttccttgtgatactctcggggatattggtaaaaagagcggtctagtttcatataccatgatccatgatggtgctatcttatgagaccatgtgcacattccatgacatctagtttcgatgaagacttgatagattacaagggatgtgaatgatggtcagtcaaatgagccaaagaagcttctgtctggtacaatgggttactgatcggcagtcaattgttgtagatgactttaatggttagtaccgatctg

SEQ ID NO: 67705 - DNA, 283 bp, Zea mays
  Clone ID: LIB3076-001-Q1-K1-F4
tcaccctagctcctgtctcgcagtcacgaccttcacttacacatcttccccggcggccgcgcggtcagctgaaccatggcggactccaaggccacctcggcggtcaccatccgtacccgcaagttcatgaccaaccgcctcctggcccggaagcaaatcttgcttgacgtgatccacccctgccgagcttacgtctactaggcagagttgtaagaaacgcttgacaaggcgtactaggtgaatgacccctgcaccatcttagtctataagggccgcacccact

SEQ ID NO: 67706 - DNA, 437 bp, Zea mays
  Clone ID: LIB3076-001-Q1-K1-C6
ggcaaccccacgggcgctctctctccccctgcgcctcgtcgcctctccaatccctctcggcctctcgctttctctctccatctcgtttcccccgcctgcgcagccagcgcaaaccctagccaacaagcgccgttctgcgaggctctcggcagcggataacttaacctgtcgcgcaaggatcgggggagagaaaccagcggcaacttacgtggatcggggttgtttggtgctgctgcggcggcgcagggatggaccggaagcgcatcaaggacgcgctcgagaagcacctggagaggtcgtcgccgtctacttccaggggcgtcgtgtccaaggagagggagcgcctcgctgccgggaagctgccgtcatcgcttggcaaggcggaagtgtctgatggtgaagaatttgaaactgacagtgaagattctgatgtgagt

SEQ ID NO: 67707 - DNA, 452 bp, Zea mays
  Clone ID: LIB3076-001-Q1-K1-C7
agcaatcgctctttcttttcgatggatctcctatggaaaaagaagagcagccaagtaaaccgtgggaatgttttttttgttgttgtcttgtgttcgatggcaacacccaggtcgtgaaggcaatcgagaacgcgatccccgtgcggcacgcgctgcccgccgccgccgccgcggagatcgaccccgcgtgggaggaggagctgagggccatggaggcggagaaggcggagatcgaccgggcggcggcggcgcgggtgcggcgggagctgtggtgcgggctgacgtacctggtgatccagacggccgggttcatgcggctcaccttctgggagctgtcgtgggacgtgatggagcccatctgcttctacgtcacgtccatgtacttcatggccggctacgccttcttcctccgcaccaagaaggagccgtcgttcgaaggcttcttcgagagc

SEQ ID NO: 67708 - DNA, 151 bp, Zea mays
  Clone ID: LIB3076-001-Q1-K1-D1
cccacgcgtccgtctagatcgcgagcatgcctcaaaaaaaaaaaaaatctaaaaccaaagcgcgaaaataaaaataaagggaggagaacacaatagatctatatccacaacgtatgctaaccagcgatttgcatgacgctagctccagatg

SEQ ID NO: 67709 - DNA, 394 bp, Zea mays
  Clone ID: LIB3076-001-Q1-K1-D2
tgtcgctcttcgtgcgggcgtgcggcacaccaccagaagagcggccgagcggcgcagagaagagagaaccagccgagcggagcggctgcgctttcggagggaggaaggaggatggagaaggctctcaccaagctcggcagcttcacaatctcccgcaaggccaagcaggagctctccgccatcggtgacgacatctcccgtttttcgagcacggtggaggagaaggcaaaatgggtgttcgagaaactcaaagggcacaagaagtcgctccctgatctactgcgcgagcacaaccttcctccaggtctcttccctcgtaacatcatctgctacgagtacgacgaatcgacctcgaagctggtggtgcacctgtccaagccctgcgaggtgagct

SEQ ID NO: 67710 - DNA, 289 bp, Zea mays
  unsure at all n locations
  Clone ID: LIB3076-001-Q1-K1-D3
cggacgcgtgggtgtcgccgncacttcacctncacctnccacccactcctctcaccgcaccactaaacccgnctncctcgctcctcacccgctccctgtccatccacccatcgcctcgccgncgctctgctgccgtttgctccagctgcggccgaccggggccatggctggcatcgacctcaacaccgtggaggaggaggacgaggaggaggcggaggcgctgcctttgcccggacccggtggccgtggcgccgtgtgcctggagctgtggcacgcgtgcgcgggcccc

SEQ ID NO: 67711 - DNA, 375 bp, Zea mays
  Clone ID: LIB3076-001-Q1-K1-D4
cggacgcgtgggcggacgcgtgagtctagaagctactgacagccactaatctgctcaagcgctgagagatgtgtccgtgagagcttaatgaatcgcattgcatggaaacatggacatagcctccgctctagatccgctggctcctactgcggacgaccatacccacggctgcgatatacctcagcaccgtagatgaggaggacaaggaggaggcagaggcgctgcctttgcccggacccggtggccgtggcgccgtgtgcctggagctgtggcacgcgtgcgcgggccccgtcccgccgcttgcgcggaaaggcagcgccgtcgtgtacctgccgcaaggccaactcgagcacatcggcggcgacgcggcgcgag

SEQ ID NO: 67712 - DNA, 443 bp, Zea mays
  Clone ID: LIB3076-001-Q1-K1-D5
cataaatgtccggaaggcctcagtgataatacagtctggtattcgtggcagtcttgttcgaagatgtaatggcaatattgatctaataaatgtgctaagagagtttgaatcaaaacaggaggcacatggtgaccaaattttgatcaaggcctcagtcctggctgagttacagaggcggatactaaaagccgaggccacagtacgtgaaaaggatgaagagaacgagatgcttcatcagcggcttcagcaatatgaaaaccgctggttagagtacgaacagaaaatgaaagctatggaggaaatgtggcagaagcaaatgcgttcgctgcaatcgagcctttccgtagcaaagaagagccttgttttggatgaaacgcctaggatgtcggactcatcagtggatcagagctgggaaagcaatgggaaccaccatgtcagcagcg

SEQ ID NO: 67713 - DNA, 446 bp, Zea mays
  Clone ID: LIB3076-001-Q1-K1-D6
cccacgcgtccgcccacgcgtccgggttactgccctgaggttcaccgagacggcaagggccaggattgtcaatgctggtggggagtgcctcacatttgaccagcttgctctccgtgctccacttggcgagaacacagtcctcttgaggggccccaagaatgcccgtgaggcggtgaggcacttcggcaaggctcctggagtgccgcacagccacaccaagccatatgtgcgctccaagggaaggaagttcgagaaggctcgtggcaggaggaacagccgtgggttcaaggtttaagaaagttgtgggccatcagcatagtaatcacttcctaccgagtagtagcacattttgttgccttggcttggattttgaaagatatttaaggattttcgtgccttgtctactggttactggttgagcaagaagacaatgttcttttgcacct

SEQ ID NO: 67714 - DNA, 267 bp, Zea mays
  Clone ID: LIB3076-001-Q1-K1-D7
ccgacgcgtgggtgtcgccggcactccagctacacctcccacccactcctctcaccgcaggactaaacccgcctccctcgctcctcacccgctccctgtccatccacccatcgcctcgccgccgctctgctgccgcttgctccagctgcggccgaccggggccatggctggcatcgacctcaacaccgtggaggaggaggacgaggaggaggcggaggcgctgcctttgcccggacccggtggccgtggcgccgtgtgcctggagct

SEQ ID NO: 67715 - DNA, 458 bp, Zea mays
  Clone ID: LIB3076-001-Q1-K1-E1
cggacgcgtgggttaaaatgttaaatgagattggaagcatggaaaatattccagatttcattgtaggagtgaagaacaggaagaggaagatgtccggttttgggcaccgtgtgtataaaaactatgaccctcgtgctaaagtcataaggaaattggcagatgaggtgttctcaattgttggacgggatccacttattgaggtggccattgccctagaaaaggcagcgctgtcagacgaatattttatcaagaggaagctgtatccaaatgtggatttctactctgggctaatttatagggcaatgggattccctacagaattttttcctgtgctgattgctattcctcgcatgggtggctggctagcgcattggaaagagtcactcgatgatcctgacactaagattataaggccccaacaggtatacaccggcttctgggctaagcactataccccc

SEQ ID NO: 67716 - DNA, 346 bp, Zea mays
  Clone ID: LIB3076-001-Q1-K1-E2
cggacgcgtgggttaaaatgttaaatgagattggaagcatggaaaatattccagatttgagggtatgagtgaagaacaggaagaggaagatgtccggttttgggcaccgtgtgtataaaaactatgaccctcgtgctaaagtcataaggaaattggcagatgaggtgttctcaattgttggacgggatccacttattgaggtggccattgccctataaaaggcagcgctgtcagacgaatattttatcaagaggaagctgtatttaaatgtggatttctactctgggttaattgatagggcaatgggattccctacagaatttttttctgtgctgattgctatttc

SEQ ID NO: 67717 - DNA, 377 bp, Zea mays
  Clone ID: LIB3076-001-Q1-K1-E3
gttttcacaaatgcgtcctgttgcaatggcaccttcagtaggtccttgcatgcccatgtgtgggacctagtgttcctggagttggtcagcagctgttttatggtcagccaccttcagccttcatcaacccttaggctggatttgctttccagcaacctatgatgcctggtatgaggcctggtggtccaatgccgaactttatgatgcctatggttcagcagggacagcaaccgcaacgtcctgctggtaggcgtgctgggtctggtggaatgcatcatcccatgccaatgggtagtcagcaacagatattccctagaggtggtcgtggctaccgctttgctactggacgtggaatgcctgatcctggcatgcataat

SEQ ID NO: 67718 - DNA, 191 bp, Zea mays
  Clone ID: LIB3076-001-Q1-K1-E4
gcctgaagctgtgcgccccggttcggtgggcgttaaatgggagaaaagagggcgcgaaggggggttgattttgctagggtatgcggaatctgcttcacactgcctactcagtcctcaccaccacagtcgtcgcgcgcaagatggtagggaggatgccacgttagatcaccttggtcaaggagggggagcct

SEQ ID NO: 67719 - DNA, 427 bp, Zea mays
  Clone ID: LIB3076-001-Q1-K1-E7
cccacgcgtccgcgggacgctggctccggcgggagcaccggcacctttgctccaaccctgcgacgttgtggacccgccgctgcctccagttaaagctgtgatcaccgccgacgcgccggcgccagaggcggctgacaatacctcctcggcgtccagctccaacgcggggaatggcctcttgtgggctgccatcgttgccctcttgtccctgagctttctgcgctgatccttcctcgatgatggcttccattgtactcccgcatgtccccctcccccctacatcctcgaatgtgctgtaacataatgttccttaaatagatataacctgtcattaacctgcacataaatacaggtcagaaaaagtttaccctgcaccaaaaaaaaaaattaaaaataaatttttattaaatttataatttttaataat

SEQ ID NO: 67720 - DNA, 292 bp, Zea mays
  unsure at all n locations
  Clone ID: LIB3076-001-Q1-K1-E8
ntccgccacgcgtccgatgaaaacctatctgaggatcctgccaaggatctgagcttaaaggaaatgataacgccaaaatcttcgactaaggtcccaggtagaaccaaagggcaaaacacagagaatagcacacctaaaatgaagcaagaacaagaaactgaagagcctcctcgttcaaagaaaagcaaaggacttgataaaagtctagttggtgcaaggatcaaagtttggtggccagatgataagatgttctacaatggggttgtggagtcatttgaatctggttctaaaa

SEQ ID NO: 67721 - DNA, 297 bp, Zea mays
  Clone ID: LIB3076-001-Q1-K1-F2
cttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggctgtgaaaagcaatggggcgtgcaagcccgccaagggcaggaaggggaaggcccgcaaggaccccaacaagcctaagaaggctcccagcgctttcttcgggttcatg

SEQ ID NO: 67722 - DNA, 447 bp, Zea mays
  Clone ID: LIB3076-001-Q1-K1-C5
cccacgcgtccgcccacgcgtccgggttactgccctgaggttcaccgagacggcaagggccaggattgtcaatgctggtggggagtgcctcacatttgaccagcttgctctccgtgctccacttggcgagaacacagtcctcttgaggggccccaagaatgcccgtgaggcggtgaggcacttcggcaaggctcctggagtgccgcacagccacaccaagccatatgtgcgctccaagggaaggaagttcgagaaggctcgtggcaggaggaacagccgtgggttcaaggtttaagaaagttgtgggccatcagcatagtaatcacttcctaccgagtagtagcacattttgttgccttggcttggattttgaaagatatttaaggattttcgtgccttgtctactggttactggttgagcaagaagacaatgttcttttgcacctt

SEQ ID NO: 67723 - DNA, 306 bp, Zea mays
  Clone ID: LIB3076-001-Q1-K1-A1
cgtccgccacttccttctcctcgcgagctcagctcgcgcaccggtgcgtgcgggcaatgatcacacggaggaggagctgtgccaagccacaatgggtatctcgcgtgactcgatgcacaagcgccgggccaccggtggaaagcaaaatgcctggatgaagaaacgaaagtatgagcttggtcggcagccagtcaacaccaagttgtcaaacactatgacagcgacgagggtacctgttcgtggaggtaatgtgaaatggagggctcttttccttggtactggtaactactcattgggaagtgaacc

SEQ ID NO: 67724 - DNA, 315 bp, Zea mays
  unsure at all n locations
  Clone ID: LIB3076-001-Q1-K1-A2
cggactcccgggactactgcaaggctgcattgatctggccttggacccattggcccaagacttggtttattgcacaagcctaaccccggacttgttctnttacaggacatggggtacagcgctcggtattgctcactcttgttacctagctgcagcaactggaggccgtcgcttttacaaggagctgcagaagaagtggcacaaactggtataccatctggacctctgcttgagacaccagcgctggatcgatgcataccaaccaacttcaggagcttgcattatacgagctgctttaatctgccgtcctattac

SEQ ID NO: 67725 - DNA, 432 bp, Zea mays
  Clone ID: LIB3076-001-Q1-K1-A3
caggataccaacatcagctctgtcagcatcactgatgtctgggaacccatagaagaagggcttgtcccattggagatgactcggcatgtttctatgatatcaattactttgtcccccagagagctggacaagcacactcctgggtaccaagctccagcatatgttgaacatcccaggcaacagcaggtgccaccactgcagcgccaacctcgcagaccatcaggacaacaattccagctaggcgtgttggatctactcgcgccggcccactgctccttcagtcaggcgcggcgcctcttctccttcggccaggcgagttcgcgcttcttctccttcagccaggtgcgttgaatctgctcgacgccgcccactgctccttcagccaggcacggcgcctttttctccttctgccaagtgaggtcgcgcgcccct

SEQ ID NO: 67726 - DNA, 338 bp, Zea mays
  Clone ID: LIB3076-001-Q1-K1-A4
aacgattcgaacctaatctatcgaacgaatactgcacagtttctaaccatcgatacctgagatggcacataaggcaggcctgaagctggttgtataaaatccagtacaggaggagcccgagacctagacagccgcaatggctcctaccgagatgaagcctatggccgacatgcgcctcccgacgggcaagtcccactgtaggacggccgtcagagccataaggggaacaagaaagcgattgaacgtcgtggagacactcgagatctacaactgctacgtgctgcagcagcggcacctctacatctgcatctagtccaaggccatgttcattcatgaac

SEQ ID NO: 67727 - DNA, 233 bp, Zea mays
  unsure at all n locations
  Clone ID: LIB3076-001-Q1-K1-A5
ccaacancagcacagacagcaacacagaagacagggaacccacagaagaagggggaggcccacaagagaagacacggcaagcaaccaagaaaacaaaaaccacgacccccaaagagcaggacaagcacactcccgggaaccaagcaccaacataaggagaacaacccaagcaacaacaggagccaccactgcaacgccaaccccacagaccaacaggacaacaagaccaacca

SEQ ID NO: 67728 - DNA, 329 bp, Zea mays
  Clone ID: LIB3076-001-Q1-K1-A6
agcggtcgaaataaatgaaaaatctgatgataaatatgacagagatcctacggaaaagttagatcggagtgaaaggcgtcgtggcgaagatgccattgacagatcaacagatagattgtcggacaggagagaacgttccattgaaaggatgcatgagagaggtacagataaagccctcgtaaaaggttgcgaggatagaaataacgatgagaggaataaagttaaatatgcttgaaccttcggtggaccggacacattcttttgatgaccgattcctagggcaaagtttgccaccggccaccaactattcccgcaagtttcgtacccca

SEQ ID NO: 67729 - DNA, 452 bp, Zea mays
  Clone ID: LIB3076-001-Q1-K1-A8
cccacgcgtccgcccacgcgtccggcctggagggctgatattcatgacatgttatctaatggaaacactgtcctgtagtgtaatcatgttatattttctgttctgaacaaattcaaagaaatctcatggagacaaactttgatagtacaagttggaggtctcgaattttaaggtaatattgtgctagtattgtcatttgcagtattgatctttgttggtgcaacctaacattagattgatgttaatgagctgctgtagacgtttgatttaatctgcatgtgctatttttgtggagtttgatatttatgtgcttacatttcgtgacttagcaataccggttgtatgctgagatgtttgaaaagctattacgttttctgtgaacagttgtgtagtttttagttggatgacgtcgtgcatgccgtggaaagtgtgggtgtggcttttggtggaaa

SEQ ID NO: 67730 - DNA, 285 bp, Zea mays
  Clone ID: LIB3076-001-Q1-K1-B2
actgccgtaccgctgcggcataattggctggacgaacgcctcctgcgatctctgcttccctcctcttcagcttcacagaaggctccgtgcctagatcccgtggggggggtgttggtgatcaaggagtggcttattggatccatcccctcacgtgctttcctcatcaagtttcaaatccccatctgcgcgaggaactcctctctcaatatggttgcaccgaggaattcatcccttattgaagaaggtagtagatctgaagaactccatgggtagctggagcgtcct

SEQ ID NO: 67731 - DNA, 424 bp, Zea mays
  Clone ID: LIB3076-001-Q1-K1-B3
tccacgcgtccgcacaccccccgagctcagcttacctccactccagctccaatcacagtcgtgaccagagcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacatcttcggcgggcacgtgaacccggccgtgaccttcggcgcctttgtgggcggcaacatcaccctgttccgggggctcctgtactgggtggcgc

SEQ ID NO: 67732 - DNA, 426 bp, Zea mays
  Clone ID: LIB3076-001-Q1-K1-B5
gttcagtggtctgggaagaaccagcagcaaaattccaatgcagcacttaggcaggtgagagcttggactgagcttttgaatgctttttgcacgagtggcagactcgaactggaacttatacacaaagttcagacacagtgctatgaggatgctaagctgatgaagctgtttccggaaatcataagaacactgtatgaccaagatgtcctagctgaagatactatagtcctttggttccgtaaaggttcaaacccgaagggcaggcaatcttttgtgaaagctctggagccgtttgtcaaatggctcgaggaggctgaggaggaagaataagctcttgatttggagattggccgaatgtgacgaattatggttctcgaaaatattaccttttcttatttcgaaagctatgaaaggttgacgagttat

SEQ ID NO: 67733 - DNA, 451 bp, Zea mays
  Clone ID: LIB3076-001-Q1-K1-B6
ctctctccttccctcctctccagttccacagaaggctccgtgcctagatcccgtggagaatgtgttggggatcaaggagtggttgattggatccatcccctcacgtgcttccctcatcaagtttcaaatccccatctgcgcgaggaactcctctctcaagatggttgcacggaggaatccatccattattgaagaaggtagtagatctgaagaaatccaggtggagctggagcgtcctcgccgctcccagaccggtcatggtagaggccaagctcggggagatgttggtgggagtagttctcaacaacctgaaatcgtccatgccgctcgagaagaacctgtccctcagccacctctccatccatcttcatcacgggctgctgcagctgccgcctctcgccccatgagccgtggtaagagaagcaagaagagaggtgttcgtgcgctcatc

SEQ ID NO: 67734 - DNA, 445 bp, Zea mays
  Clone ID: LIB3076-001-Q1-K1-B7
accaaatctcctgtggatgatcaacaatggctcacatattgggtcctgtactcactaataacattgtttgaactcacatttgcatcaattattcagtggcttcctttctggccttcaatgaaattgatctttatttgctggcttgtcttgccatacttcaatggcgcagcctatgtgtaccagaattatgtgagacctgccttcataaagaaccagatggtcaacatttggtatgtccctcagaaaaaaggccttcttgggaaatctgatgacttcctcacagcacttgataagttcattgaagaaaatgggactgacgcgctgaagaaattggcgaacaaggctggcaagccatttaaacagtctgggaaatcatctaaggatcagaaagagacaaaatcatcaaaggattccaaagaaccgaagccatcaaaagatgcaaagc

SEQ ID NO: 67735 - DNA, 188 bp, Zea mays
  Clone ID: LIB3076-001-Q1-K1-B8
acgcgatctcccacgcgtccgcaataacaggtcagataaaggcatgaacacttgatggagcatttgtgggatctaacaggagggtctagtgtacagtaaggtctgtagatgcctgctggtccgagtatgacgactaatattgtgaagcgaccgtatgtctattgctctatctgtgtgtactgatatga

SEQ ID NO: 67736 - DNA, 392 bp, Zea mays
  Clone ID: LIB3076-001-Q1-K1-C2
cggacgcgtgggttttgagttcaaacggtcagataagtcatgggtccaaacccaacaattgtgagatggggcttagcttcaatatgtgcaagaagattgtgcagatgatgaacggcaacatttggtcagtatcagattctaaaagcgttggagaaaccatcatgctggtcctccagttccagctgcagcctctgactgcggtctccttcgcggcgtcctcagacttgagccgatcgtctgcaatccccaacttcaacgggctcaaagtcctcctggcggacagtgacgacacaaacagagcagtaacacacaggctcctcgagaagctcggttgccgggtcctttcggtcgccttcggcgttcaatgcacgagcttcttcggcggcgagccg

SEQ ID NO: 67737 - DNA, 441 bp, Zea mays
  Clone ID: LIB3076-001-Q1-K1-C3
gtccagcttcattcaaacagtcacttgagattgtcacaaatatgtaatttgatgaatagggggattatgccaagcttatctctatgttcgatggtatgattgaaacacctgcgtttagaccaggcagaattgatggtgccctcaaggttggacagaaacgtggaagattgcatgcaaatctacaagatgaacaacctataaagaacgttagattatggagcccatcggctcaatggatttcagtttataatgctaggcgacccatgaagcagaggtaccattacaatgtggctgactcaaggctaagtcaacatatagaaaagggtcatgatgactggctttaccttagttgcgtggccttctcggaaaccttttgggcctcatcatggacgctggaactggtttctgtcttcaagttacgagctctcaccaggttttttt

SEQ ID NO: 67738 - DNA, 357 bp, Zea mays
  unsure at all n locations
  Clone ID: LIB3076-001-Q1-K1-C4
cggacgcgtgggccgagagcagagcgagataaaaaaaaaggtaatccgacggaaacgacaagggcgcggcgagggcggggacagggtcgggaaggccctgggcgcgggggcgccaagcgcatggcatcgtcgagggtgatgccgtcctcctcgccgtcgcacacggcctctgatctcgcgcgcctagcgcaggccgncagcaggcccggcggcgggggcagcgggctgggctccatgaacgtggaggagctcctccgcggcatctacagcgacatgcccaccccggcgcctgccgcgtcggagcccgaacgcccgaggtcgccggccccggcgccggaggtcgccacgcggaggacg

SEQ ID NO: 67739 - DNA, 55 bp, Zea mays
  Clone ID: LIB3076-006-Q1-K1-B12
cgtacgcgtgggtcctaccagccttgcttttcccattacttgccttaccaacact

SEQ ID NO: 67740 - DNA, 361 bp, Zea mays
  Clone ID: LIB3076-006-Q1-K1-B2
ctgacgtggattatatcttgcaatatgaccctccagatgaaccaaaggattacattcacagagttggtcgtaccgcacgtggtgagaaaggcaaaggaagtgcattgctgttcttactaccagaagaactgaagtttctaatttacctgaaggcggccaaggttaccctgacggaatatgagttcaatcagaagaatgtgccaaatttgcaatcgcagcttgagaatattgttggtgagaattactttctgaaccagtctgccaaagaagcctacagatcctacgttttggcatatgactctcattctatgaaagacatttttaatgtccatcaacttgatctgcaaaaagtagccgcgtc

SEQ ID NO: 67741 - DNA, 416 bp, Zea mays
  Clone ID: LIB3076-006-Q1-K1-B3
aggcgtcggggtttcttcaaccgctcgccagggcctggccaccgcgctgggcatgcgcaagctaccgcgcgcacccgctggccgccatgaaacgtcgggccaccgcgcagggcgagccgtgcctggccacgctgcgttgccgggggtatgggcgggagctcgagtacgaccgcgttgaggctgccgaggggctgctgtgcatgggtgtcagacaaggcgaggggagtggaggaaccccaagttcccggttgcatgcagatcgcaaattatgcgcaggagagaaaataggaagtgggaagttctttcctctatttttctcaaccgcacaagatgcaccagcgcaaggaaaatttgcatgcgttcatgcgcgaagtggggcttcgcaggggcgggcgcctcgccatgctctggtgatg

SEQ ID NO: 67742 - DNA, 381 bp, Zea mays
  Clone ID: LIB3076-006-Q1-K1-B5
cggacgcgtgggcggacgcgtgggctgttctgaaggatgatgtttggagattagaaaagattggcaaggatggcgcattgcacaagaagttaaatgccagtgggatctatacagttgaagatttcctccggcttcttgttagggatcagcagagattacgtagcattctgggcagtggaatgtcaaataagatgtgggacagccttgttgagcatgcaaagacatgtgtcttaagtggaaagcattatgtatactatgctagagactcaagaaacgtgggtgcaatattcaataacatctacgagttcactggtttgattgccgatgatcagttcatttcagctgaaaatctcacagacaaccagaaggtctatgctgatg

SEQ ID NO: 67743 - DNA, 417 bp, Zea mays
  Clone ID: LIB3076-006-Q1-K1-B6
gcttttatgaagtcgatttgccaaaggatgctaaaaaagagtccttggttgagacagaagtgggaagtgataacttagagcagagagcagcggagagctttgacgagcctttgctccctgaggtgaaggaggagaaaaccaggaggagccaatttgtgcaggggcttgtcttgtccctgatgtttgatgacatcttatgaagagcacatcccaaaaggggaagggagaaggcatattttgctaccagcaaacgtttcgccggcacagctgttgtaacgattcgctgatttgccatcggaagatggtgacattgctctgggataatgggggagatgaactgtggatatggatgtttcgtagtactatgcatcatcattgcatgaataatagagtatatgtatgtatagcttggtagca

SEQ ID NO: 67744 - DNA, 337 bp, Zea mays
  Clone ID: LIB3076-006-Q1-K1-C1
aggcgtcggggtttcttcaaccgctcgccagggcttggccacttcgctgggcatgcgcaagctaccgcgcgcagccgctggccgccgtgaaacggcgggccaccgcgcagggcgagccgtgcctggccacgctgcgttgccgggggtatgggcgggagctcgagtacgaccgcgttgaggctgccgaggggctgctgtgcatgggtgtcagacaaggcgaggggagtggaggaaccccaagtttccggttgcatgcaaatcgcaaattatgcgcaagagagaaaataggaagtgggaaggtctttcctttatttttctcaaccgcacaagatgcacc

SEQ ID NO: 67745 - DNA, 340 bp, Zea mays
  Clone ID: LIB3076-006-Q1-K1-C10
cacctggaaccagtaccgtttgacatggtccgtgatttgatcaccccgacatacaaaaagaagcgtccgcaactgctcaagtactaccagggcgtgattgacaacatgtacaaaagtgctaagtgaactcactctacagtacacatcccgatgaagattcccaacgctgaatcttgaatgagcagccagaagttctgctgtgtatatgctcgtagtttgtatgcgagaattcttcctgtatcagtttttcagaaacgatttgccctgggcatatatatatagcaaaaccggcaatgtggccagcagccaagtggagacaccgtttcaaaattgattgaac

SEQ ID NO: 67746 - DNA, 367 bp, Zea mays
  Clone ID: LIB3076-006-Q1-K1-C3
cccacgcgtccgcccacgcgtccgctcttctctcgtccatccgttcctcccttcccctgcttcccggctctccctcctgcccatccctgcacgccccttttcatgcgcgaggaggggccgtggggaccaccaccagcacctccatccgcgcgcatctcgcggtggtgctcctcctcctcctccccctgctcccggggcgggcgctctcctgttcctcctcctcctgctgctggtgccagggccgggagggcggcgtggaggtggcgctcatggggctcgccggggacgggtcggcggacaccgccaacctcagtaatagtgaaaatggtcggttcagttatggagttgcaagttcttccgggaaaag

SEQ ID NO: 67747 - DNA, 354 bp, Zea mays
  Clone ID: LIB3076-006-Q1-K1-C5
tgcgccgccgcagcccgcagtcgcttgcgcgcagcagcacttcgcaccgccgccccatcccatcgccgccagtgtctggtcgatccgatggctcccacgaagaagtcgaagaagagcacagagagcatcaacaacaagctgcagctggtgatgaagagcggcaagtacaccctgggctacaagaccgtcctcaagacgctgcgcaactccaagggaaagctgatcatcatcgcaaacaactgccctccacttaagaagtctgagattgagtactacgccatgctggccaaagttagcgtgcaccatttccacggaaacaatgttgatcttggcactgcctgcggcaagtactac

SEQ ID NO: 67748 - DNA, 264 bp, Zea mays
  Clone ID: LIB3076-006-Q1-K1-C6
cgtgaagcgtacaaccttggaaccggaagaggtacatttgtgcttgtagattgttaaagcatttgagaaggcttctgggaagaaaatacctctgattgttggtgaaagacgcccaggtgatgcagagattctgttttcagagactactaaagcagagagggagcttaactggaaagcaaaatacggtattgaagagatgtgccgcgaccaatggaactgggccagcaagaacccttatggctatggatcacctgactctatcaa

SEQ ID NO: 67749 - DNA, 367 bp, Zea mays
  Clone ID: LIB3076-006-Q1-K1-D10
cccacgcgtccgcggacgcgtggggacacccacgccaagagaccagaggcaacccggtctccgtctcgctcctttcaccatggatcaatcggcagctgcacctccccggcaagacgctgctgcgacgaagaagccgacgacgctcctcgacgcgtacgaggtggagtgcatccgccgggagctgcagcggctcgtcctgaagcacaaccagagcgctgccgccgggggcgacaccgccgcggcagcgcttgcgcacggccaccgccgcagcgacgacagccacctccaccaccagcagcatcgcgcgagcagcggcgcaaagaaggcgacgagcgccaagagagtcagtccgtcgccgtcgtcgctg

SEQ ID NO: 67750 - DNA, 352 bp, Zea mays
  Clone ID: LIB3076-006-Q1-K1-D11
cccacgcgtccgcggacgcgtgggccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcgggccaggtcgtcg

SEQ ID NO: 67751 - DNA, 288 bp, Zea mays
  Clone ID: LIB3076-006-Q1-K1-D5
ctcgcggaccgtgggcctgctgcgagcctcaaatgaagttcttgcaaggacgcgtacctaatgtgggggttaccgtcactcatttctgatcgctactgttctgcgcctgcctgtctggggcagtcattggttctctgacgtgcttcttactatttctgtgatcctcttctattttttttttttcattatatagtttcgtttcttatatatgtttttttatttttttttttttttttatatctttatttttttttttatttttttattctttttttctattattttttt

SEQ ID NO: 67752 - DNA, 242 bp, Zea mays
  Clone ID: LIB3076-006-Q1-K1-D7
gcctgagccatgagggagccgtcactttaagcgggcacagtaaatgtttctgaaataagacgcgtagctagcatcagtttgctccacttggtatcatttggccatgctcactctatcctttcgctagcctctatgaccggacctaaactggtgtgtgagaaacatccacgactctcctcccaactgttttcctaaagcgaaatgataacacttcttaataattgtctatacgattgaagctg

SEQ ID NO: 67753 - DNA, 353 bp, Zea mays
  Clone ID: LIB3076-006-Q1-K1-D8
acaaggttcaccgagggctctaccccgacgccgcgccctccaccacccagacggcggcgggccccgaccccaaggctgccggcctgcgccgccgccgccgcgcgctcctccgcctccgcggcaagcgcctccgcgacctctcccgctgggaggccctcgcctccgaacttctcgcgccgcttcccgctcccccgccaccggctccgacatcccaatcccctcccgtcgctgcctcctcctcctcctcctccttggtctctgtcctcgacgagctcctcgcacaggctgacattcaagttgagctgatgaagaaagtgtgccagtggtgcgacgaggccaactctatctgcgac

SEQ ID NO: 67754 - DNA, 61 bp, Zea mays
  Clone ID: LIB3076-006-Q1-K1-E10
gacccacgcgtgcgtggacacgtgggatcaaagggaggcattttccatttttgtcaatcac

SEQ ID NO: 67755 - DNA, 395 bp, Zea mays
  Clone ID: LIB3076-006-Q1-K1-A5
gggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctaccgcggcggtcgcggcggccgcggctatggtggcgg

SEQ ID NO: 67756 - DNA, 396 bp, Zea mays
  Clone ID: LIB3076-006-Q1-K1-E3
cttttggaaaatcaaaaattcatggatatggtgtctttgccaaggttgcacacaaggccggagatatgatgggtgaatacataggggagattgttagaccaccgatatcagacactagagagcggcgaatttacaactcactagtgggtgctgggacatatatgttcaggatagatgatgaacgtgttatagatgccactcgggttggaagtatagcccgtctgatcaatcactcatgcgagcctaattgctattcacgtgccataactattcttggagatgaacacatcatcatttttgcgaaacgggacatagatccatgggaagagctgacatatgattataggtttttttcaagtgatcaacgacttccatgtttttgtggattccccaaat

SEQ ID NO: 67757 - DNA, 227 bp, Zea mays
  Clone ID: LIB3076-006-Q1-K1-E6
gattgtagttcacagttgacagtaggttgaaatatagtgcttggtgaaatgtgtgagcgactgttcaagaagtgactttgttattatatataatcaaaacaatttatcatatagttacttataactactaattcctttctaaatatatcttttttatcatgtttttaatcttatttatttactatactattatatattataaattttttatttttactttttattta

SEQ ID NO: 67758 - DNA, 336 bp, Zea mays
  Clone ID: LIB3076-006-Q1-K1-E7
cggacgcgtggggaagaaggctgctttgcttgctttagcttctcacgcatctgatccagctgaagctgagcgacttagattcttggcttctccttctggaaaggatgagtattctcaatggataactgctagtcagaggagccttcttgaagttatggccgcattcccttcagctaagccaccactgggagtgttttttgcagcaatagctcctcgtctgcaaccacgatactactcaatttcatcatctccaaagatggcttcctccagaattcatgtaacatgtgcgtttgtttatgggccttcaccaacaagaaggatccactcaggagtttg

SEQ ID NO: 67759 - DNA, 339 bp, Zea mays
  Clone ID: LIB3076-005-Q1-K1-G11
atattataaatgtcaccttgatttggttttctgcatctcactttgctctttagaataagtttttctttcatgtgcgcttgagcgtaccattctcttattggaccatttttcttaaaaaccgcaatgcttacttctcgctcataggaggcctacattttcataccactcccaatgcattttattttctgtctcctatatgttcctcataaatatttttgatatttctaaatttcttatttggcctttttctacccttttttttcttcacttattatttctaaaccccatttctactatttatctgttatttcatccttattctttttacccccaaaactt

SEQ ID NO: 67760 - DNA, 349 bp, Zea mays
  Clone ID: LIB3076-005-Q1-K1-G12
cccacgcgtccgcccacgcgtccgcggacgcgtgggatcgcaagcgcggacgccatcaagcctctcatccacgtccttgagacgggtaacccagaggcaagagcaaactcagctgcaactctcttcagcctttcagtaaacgaagagaacaaggccaaaatcggacgatctggagcaatcaaacccctggtcgacctgctgcgagatggcagtgcacaggggaagaaggatgcagcaacggctctcttcaacctatcgatatttcacgagaacaagggcccggttgttgaggcccgggctgtaaagccccttgtggagctgatggacccagcagctgggatggttgaca

SEQ ID NO: 67761 - DNA, 434 bp, Zea mays
  Clone ID: LIB3076-005-Q1-K1-G2
atacatcgtccagttagaccaacgtcttttttttgtttgcaaaaacccgttcttcaaccgggatgaacttactgtgaccagggtcatcaatttaaataagctagagaaaggtgttgtcaagccactaccatctgctttggttcttcatggtcattatgctggttgtgtggttgattagcctatctataacgcctttatacttgtagggccttattctgttaggggctttaataattgtgaactgggcgcttctaggaatattcttgaagttgctactgaactgcgtgttcctgtaagaaacacacacctttatgcattatttgaacatcggactgaccttgcgagttccaatgatgtcaaatggaaccctacagaagttttttatgcgttgttgttcttggatctttatatgttgtagttgtcaatctttgtgt

SEQ ID NO: 67762 - DNA, 426 bp, Zea mays
  Clone ID: LIB3076-005-Q1-K1-G5
cccacgcgtccggccctagtaccggcgcaaggtcccgacgaggcgcccctcgatgcgtccgccattcatagccgggtggagcagctctcattgaaaaggctggaggtggagccggaggcggaggtggcggaggatgaggtggcactaggtttggactccacgcacaaggcggctcaggatgcgatggatgagtgggactcggccactgctgcggtttcaattgatgatttggatgcatacctggaacaactgagaaaggatgtagccatggcagagcaggggaatcagaaggtatctggtgagattagtgtcactgcagagacaacattcaatgatatgattcaattggatgttggtattgaaatgctggagtctttgatttcgaatcttggtccaaaggctttgaaccattttgatgaaagttct

SEQ ID NO: 67763 - DNA, 384 bp, Zea mays
  Clone ID: LIB3076-005-Q1-K1-G6
cccacgcgtccggccctagtacctgcgcaaggtcccgacgaggcgcccctctatgcatccgccatacatagccgggtggggcagctctcatagactaggctggatgtggagccggacgctgaggtggcttaggatgatgtggcactaagtttggactccacgcacaatgcgtttaaagatgcgatggatgagtgggactcacacactgctgccagatcgattgatgatatggatgcatacctgcaacatctgagaaaggatgtacccatggtacagcattgcaatcataatgcatctgttgagactagtgtcactgcagatacaacactgaatgacatgattcaattggatgttggaatccaaatgcttgaatatgtgattact

SEQ ID NO: 67764 - DNA, 398 bp, Zea mays
  Clone ID: LIB3076-005-Q1-K1-G7
cccacgcgtccggccctagtaccggttcaaggtcccgacgaggcgcccctcgatgcgtcggccattcatagccggggggaggagctctcattgaaaaggctggaggtggagccggaggcggaggtggcggaggatgaggtggcactaggtttggactccacgcacaaggcggctcatgatgcgatggatgagtgggactctgccactgctgcggtttcaattgatgatttggatgcatacctggaacaactgagaaaggatgtagccatggcagagcatgggaatcagaaggtatctggtgagattagtgtcactgcagagacaacattcaatgatatgattcaattggatgttggtatcgaaatgctggagtctttgaattcgaatcttggtccaaa

SEQ ID NO: 67765 - DNA, 335 bp, Zea mays
  Clone ID: LIB3076-005-Q1-K1-H1
gaattacgggccgacccacgcgtacgcggacgcgtgggcggactcgtgggcggacttttgttcagatagagaatgatggagatggggtttgggaaccagatgtgagggaaacgcatgatgctgtcttattgaggggtatgaagtttatggactggttgtggacaagagaagagaaagagatagctattgtcagtcacagtggtttcttgtttcacaccttaagcatgtacagtaaggagtgccatccaaccataagatactaagttagcaagcactttgcaaactgcgagctacggtcgatggtgttggttgtcataagcatgcttgggtcatat

SEQ ID NO: 67766 - DNA, 396 bp, Zea mays
  Clone ID: LIB3076-005-Q1-K1-H10
cccacgcgtccgcggacgcgtgggcgctattgatagattaacttcagagaatcaggcaatgcgtttggaacttcataacatggaaattgctttacagaaatttcaagatttattcagtagtattgggcatgagggaatgaatagtttttcagcaatttctgaaaatcaggacgtacaggatgtgaataatgaacaacatgaaagggttccaggtacacaatgtggtctagcaaatgagcataccttggtaactgcagttgtcaaagaagccaccacacaaaatgtagatcaccagttggaaactgatccaggcagcatgcaagtacaaagcccagtgcacttcaagtctggtgcaatgccatctccggagctagtagctgcaaattcagaaaaagc

SEQ ID NO: 67767 - DNA, 435 bp, Zea mays
  Clone ID: LIB3076-005-Q1-K1-H2
tgtttggaggaggaaatccagagttcagtgccagcacccatgctcttctgaacaaggactgcgagcttgggcgtggtggttttggcactgtctacaagaccactcttcgagatggacaacctgttgccatcaagaagctcactgtgtcaagcttggttaaatctcaagttgaatttgagagagaagtgaagatgctgggtaagctacgccatcgcaacctagttgcgctaaagggttattactggacgccgtcgcttcagcttctcatttatgagtttgtctccgggggcaacctgcacaaacaattgcacgagtcatccaccacaaactgcctgccatggaaggagagatttgacatagtcctcggtatagcgagaagccttgctcatctccacaggcatgatattatccactacaatctgaaatcaagcaaca

SEQ ID NO: 67768 - DNA, 418 bp, Zea mays
  Clone ID: LIB3076-005-Q1-K1-H3
gagcgactgaagactattgatggcacactagtcaggttttaggttcctggttgtagtctgcgggatcttgatggtggttgtggcagtcggcaattttgccaacactatgtatacactggtggtactgaagctgaggtttaaagcaaagatgaagagagcaaagggcagaaaggatcccccacatcaaaactgacaggcatgatcgttcctggaacacaaggatgcagcaggacggcaaaatcctttgacctgtgtcaacattttttggtgctgccgtgctagtagtaggagtatcttgcaagcttttgttttgcaaggtgtagtggtccagaaaacactctgtctgctaaattaccagaaacatccgcagttgtatattgcggcaaaatcccaagtgtatattgcgcaaaaaataaaa

SEQ ID NO: 67769 - DNA, 429 bp, Zea mays
  Clone ID: LIB3076-005-Q1-K1-H5
aaagccacaccagaggtcacggagtacaatgaccgcttgtcctctagctctgatcgtatcacccactcgagagctcggaggccaaatccatgaggaagcatggaagtttgcataccagactggtgtcagagtcgtggttgcatatggtggtgcaccaataactaaccagctgagggagttagagagaggtgtggaaatcctggtggcaactcctggtcgcttgatggatctgttggagagggctagagtctcacttcaaatgataaagtatttagctcttgatgaagctgatcggatgcttgatatgggtttcgagccacagatacgtaaaattgttgagggcatggacatgcctcaacgtggtgagaggcagacaatgtagtttagtgcgacatttccaaaagagatacagaggatggctgcagattt

SEQ ID NO: 67770 - DNA, 430 bp, Zea mays
  Clone ID: LIB3076-005-Q1-K1-H7
gttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggctgcggcggcggctgatacggtggtggccgtggaggctgcggctacggcggtggccggcgccgtgatggcggcg

SEQ ID NO: 67771 - DNA, 292 bp, Zea mays
  Clone ID: LIB3076-005-Q1-K1-H8
gttggcttctcactacccctccggttcggattccggctcgtgaggttctccgggggtcaggatcgagggtgaacggagcgagatgacgcagtcggatgctgagtaccgctcattcctcagcaggcctcacatgcgccacggactaccactccgtacacatcgcctacatcacctacggggaagacctcgagtccaagatcatgctcgatccggacacgcagaggtacagatgcttcggctgcgtcaccatcttcacggacgatgcaatgctgcacgccatccagggcatgaa

SEQ ID NO: 67772 - DNA, 307 bp, Zea mays
  Clone ID: LIB3076-006-Q1-K1-A4
gaggcactttccctgcctgattggcgatttaagcggtgggggagggaaggccgatggtcagtgaaagagagtaggtggacggacggtgctggcatcgccaattcaactccgcatctgcatcggcagcgcgccagctccatagtgtaggaggagatggcgctcacaagaatcggtcttgctggccttgcggtcatggggcagaaccttgccctcaacattgcagagaaagggttccccatctctgtgtacaacaggacaacctccaaggtggacgagaccgtgcagcgtgccaaggcagaaggaaacc

SEQ ID NO: 67773 - DNA, 247 bp, Zea mays
  Clone ID: LIB3076-005-Q1-K1-G1
cagacgcgtccgcccacgcgtccgcttcttctcgcactcccagacgggctcgtcctcgcgcggttgtcctgcctatcagggtgtaggggatccgactgagcatcctgcagtcggatgttgactaccggtgcttcgccgatggactcgaatgtgccacggactaccactacattgacacatgactacaccacctacgacaaggccttcgactctactaccatcctagatcacgatacgcatacgtacc

SEQ ID NO: 67774 - DNA, 404 bp, Zea mays
  Clone ID: LIB3076-005-Q1-K1-D5
attttcattcctcctctatccattcacctatcggcaattcattggccgtaattccacatcgcgcccactgccaaaaccaagccctcacccaacaaacccaccttggagaacgcccataagaagcccactgccgaaaaactcatgccgcgcaaggaggtcggcgagaagaacgggaacacgaacgccatgaagagcgtcacgacctacaagatctacatattcaacgcgctcaatcaggtgcacccggacattggtatctcgtccaatgccatgtccatcatgaactccttcatcaactacatcttcgagaagctggctgtcgatgccggcaatctcgcccgctacaacaagaagcccaccataaccttcctggagatccagacttttgtgcgcctcgtacttcc

SEQ ID NO: 67775 - DNA, 320 bp, Zea mays
  Clone ID: LIB3076-005-Q1-K1-D6
cccacgcgtccgcccacgcgtcctctgactcttgggggacctcttgatgaagcacctcaggggtccccgggtggccattgggatatctccttctacctaatgctccttcatgccaataaagactagaagtttgggctgctaaagactatgttcagtgcattctcatcttcattcgaccccttggattatcatttcatatggcatcagcgttcaattttggaggctgttggagctttcagttcaaatgaccttcacttgctagatataagctttgtttatcaattgctttgtcttggaatgtgcctctgggctatctatgt

SEQ ID NO: 67776 - DNA, 433 bp, Zea mays
  Clone ID: LIB3076-005-Q1-K1-E1
gtgggaacaagggccggaaatggcggaaaaatgtgaaggctttagaaaaggagttattactcctggaagatgacatgaaggctctagaagagatgtatcctcaaggagaacaggctgaggctacttgggcattcacagtccttgggtacatcgggaaacttctatttggtgttgttgggttaattgtttcaatagcttgggttgcacatattgtcatatacttgttgattgatcctcctctatcttctttcctgaatgaagtcttcataaagttggatggtgtttggggtctgcttgggactgctgctttcgcattcttctgcttctatcttcttatcgcagtgattgctggggagatgatgcttggattgaagctagtttttatcacaattcacccgatgaaatggtgaggcactttaatgaactccttcct

SEQ ID NO: 67777 - DNA, 315 bp, Zea mays
  Clone ID: LIB3076-005-Q1-K1-E11
gctaagatcgaggacctcagctcccagctgcagacccaggcagcagagcagttcaaggctcctgacttgagccagatgatctcgaatccagagacgtctggcccgggacaggaggacaatgatgaggaggtcgacgaaactggtgttgaggccaaggacattgagctggtgatgacccaggcatctgtttcaaggcccaaggctgtcaaggccctcaaggcttctaatggggacattgtcactgccatcatggatctgacaacctagggtgatatttctgtccgtgccacttttgttttggagtgctattgcaac

SEQ ID NO: 67778 - DNA, 435 bp, Zea mays
  Clone ID: LIB3076-005-Q1-K1-E2
gggagcgtttcctggattcactcaagtcactgcatgaaaaagatcaaagaacggtttaccgactaacactggttaaaggctggaatgcagaagagatagatgcatatgcgaaactgctagatcttggccagcccgatttcattgaaatcaagggtgtaacatactgtggctcgtcagcaacttcaaagttgactatggaaaatgtaccttggcactctgatgtaaaggaattctccgaggtgttggcatcgaaaagcggtggtgtatacgaagtagcgtgtgagcatgctcattcatgttgtgtcctacttgcaaaggtagataaattcaagatcaacggcaaatggcatacctggatagattatgaccgtttccatgaactggtgacatctggaaagcctttcaatagccgagattacatggccatgacgccct

SEQ ID NO: 67779 - DNA, 429 bp, Zea mays
  Clone ID: LIB3076-005-Q1-K1-E3
cccacgcgtccgcccacgcgtgcgctgaaacgcgggtgctagtgagctacccccaatattaggtgtatatgtcaggaaatggtctgatacatactactcacacatttatcacttggtgatacaatacgatctctgagcagcctaatgggctaggagcgactgcatgatagcagaaagctaatcttgatctctgccctataataggcattggcttatgtgacctggaatggctatacttatttgatgcacgcatgccagggtggacaccatctttactatcaattctaccaagcatctgatggtgactgtcttagtatagcttctactgtggacagtttgtgcatctagttgtctgaatctatgaagacctgactgatctatgattgaaacaatgatgctctatgtgaacttagggatattgtgtacgca

SEQ ID NO: 67780 - DNA, 185 bp, Zea mays
  Clone ID: LIB3076-005-Q1-K1-E4
cccacgcgttcgtccacgcatgcacttaatttcgtgttgcagttcgctacgcgcaatatgggctggaactgtatgtaaacggtcttgcacatactactcatacatgttctcttgctgttactattcgttctctgagcagcctttgtgccaagagcgactcatgatgcagcattctatcttgtatc

SEQ ID NO: 67781 - DNA, 310 bp, Zea mays
  Clone ID: LIB3076-005-Q1-K1-E5
tgcacgtaccgatctctaattccacccacgacgtactcccacgcctcctcccactcttactcttacatttggttacttctcagctaccaacaatattgggtgagattattaggaaatggtctaggtcatacttctcacacaatctcacttgattttacaatactttttcttaacatactactggtctaaatactactctttatacaaaaactacatccttatctttaccataaaataagcatccctttattttaccttgtattgctatacctatctaaagcacatataccattttttacaacatcttcac

SEQ ID NO: 67782 - DNA, 286 bp, Zea mays
  Clone ID: LIB3076-005-Q1-K1-E6
ttacataccacttcatagcctagctatagtggcacgtaggtacgcttcacagaccgatgcatatcccaaactgctctatcttagccatccctattttattgtaattaagggtgtaacatactagtgctcgtcagcaacttctaagatgactatggaaaatgtaccttgtcactctgatttaaaggaattctccaatgttgtttcatctaaaagcattggtgtatactaattatcgtgtgatcatgctcattcatgttgtgtcctacttgcataggtatataaattt

SEQ ID NO: 67783 - DNA, 364 bp, Zea mays
  Clone ID: LIB3076-005-Q1-K1-E7
ctgcacgtactcgacctcaattccgacccacacgtaactcccacacatcctcccactcttcctcttccttttggtttctagccagctacccccaatattgtgtatatttaaaaggaaatgtgcctatacatacttctcacacattttctcttatcaatacaatacatatctctaacatcctactgatctttatatacgactacatttaatcaaaaatctaatctttgatctctaccctaaaatatgcacccccttattttacctggtcttgctatactctttttatgcactcataccattttaaactccatattttctatcaattcttccaatcatctcatcttcacttttctcaaatacctcc

SEQ ID NO: 67784 - DNA, 63 bp, Zea mays
  Clone ID: LIB3076-005-Q1-K1-E9
tcatactttagaggctaaccactcttacaactgctttctgatactgtaaacatttaaacacaa

SEQ ID NO: 67785 - DNA, 429 bp, Zea mays
  Clone ID: LIB3076-005-Q1-K1-F1
cggacgcgtgggcggacgcgtgggtggcctctctccgtcattggacacgttggataatattcgttctcttgatcgcgtacaggaggtcttcatcagagcaatgagtgggaattgcagaatcctgccaaattagttctcagatccaagacatgttcaatcctattcagaagcttgataacattgagataattgcaagacagccatacaaaaatgacagcgttgtcagcgtagaaagatacccagtgcttctagtgtttttctctcattcctcttttcttttggggtggggggtggggagcttgaggctgacatttcaccattagtgaagtgaccaaccagtagtcatttgcaatgaggttcctcatgaaggacccatgtgtgatcttttgtggtctgacccagatgaccgatgtggatggggaatttcac

SEQ ID NO: 67786 - DNA, 171 bp, Zea mays
  Clone ID: LIB3076-005-Q1-K1-F11
cccacgcgtccgcccacgcgtccgcacgacgcacgcagagccgcagagatccgtcacactggaagttttgaaaactgaactggaagatggcatcagcagagctttcccgtgaggaaaatgtgtacatggcgaaacttggccagcaggcagagaggtaccaggaaatgggtg

SEQ ID NO: 67787 - DNA, 422 bp, Zea mays
  Clone ID: LIB3076-005-Q1-K1-F2
ctgtccggctgcccaaggttgctgttgatatcagtgctttgcgtggttcctccatgaacatatctgcttctagtaacagtttggttggtgcgaagcggggaagagggcgcccacctaaggttgtggttgctgggaaagagaagatgcaacaacctgaatctgtgcagtccgtggatgcttcattgactaagagagggcgtgggaggcccagaaaggagaaggcattggaaagtggcctcatgaaagcctcgcagatgactgagggtcaacgtgaagctctgactgcagaccaagctggggctgtccaaaatgaagtagaagatagggatttgcaatccttgggtactcctttgacagagaagagaggccgcggtcgtcctagaaagaggccgttggaaatcgaaactgcaaaagcaggggct

SEQ ID NO: 67788 - DNA, 433 bp, Zea mays
  Clone ID: LIB3076-005-Q1-K1-F3
agaatttaagcaaagcttttgtgctgaaggagaaccccaagaaaaagaaagcacgaacacaggaattgttggcatatactggtgcaggtgatcaagctaaatctgtagaggacagagttctggaaaatacacatccttcaacagagaatgttgtggcaatcagagattcaaatccagttcaagattttgaggccatgctggctaagagatctagctcaacatggactcagaaggctattggagatatgcagaattacatagcagctttgttacagaactccagtgatgggggcaactatcaaaaagcacttgaatgttttgcttctctgcggaaggcctgtattattgaacaggaaccacaagaattcaaccagttcctaacgaacatttacgagagattgaaggaaggtgatgctgccaagttctttcaact

SEQ ID NO: 67789 - DNA, 436 bp, Zea mays
  Clone ID: LIB3076-005-Q1-K1-F4
atacattttccagttagaccaaggtcttggcattggaagcaaaaacccgttcttcaaccgtcatcaacttactctgaccaagttcatcaatttaaataagcaagagaaaggtgtcggcaagccactaccagctgttttggttcttcatggtcattatgctggttgtgtgggtgatttgccgagctatgacgcctttgcacttggagggccttattctgttaggggctttagtaatggtgaactgggcgcttctaggaatattcttgaggttgctactgaactgcgtgtccctgtaagaaacacacacgtttatgcatttgtggaacatgggactgaccttgggagttccaaggatgtcaaagggaaccctacagagtttttcaggcgtgttggtcatggatcttcatatggtgttggtgtcaagcttgggttggta

SEQ ID NO: 67790 - DNA, 432 bp, Zea mays
  Clone ID: LIB3076-005-Q1-K1-F8
catacattttccagttagaccaaggtcttggttttgtttgcaaaaacccgttcttcaaccgggatcaacttactgggaccaagtgcatcaatttaaataagcaagagaaaggtgtctgcatgccactaccagctgttttggttcttcatggtcattatgctggttgtgtgggtgatttgccgagctatgacgcctttgcacttggagggccttattctgttaggggctttagtaatggtgaactgggcgcttctaggaatattcttgaggttgctactgaactgcgtgtccctgtaagaaacacacacgtttatgcatttgtggaacatgggactgaccttgggagttccaaggatgtcaaatggaaccctacagagttttcatgcgtgttggtcatggatcttcatatggagttggtgtcaaacttttgtt

SEQ ID NO: 67791 - DNA, 430 bp, Zea mays
  unsure at all n locations
  Clone ID: LIB3076-005-Q1-K1-D4
accagcgctcgtcacctccaatcaacaaattcccaatccgccgcttcccatcccgcgttcgccgcgccatttgatcgaatggccgagggcgcccaaggccgagaagaagcccgcggagaagaagccgacggaggagaaggccgagaagaagcccagggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgttcatcatgaactccttcatcaacgacatcttcgagaagctggctgccgaggccgncaagctcggccgctacaacaagaagcccaccataacctcccgggagatccagacttcggtgcgcctcgttctt

SEQ ID NO: 67792 - DNA, 216 bp, Zea mays
  Clone ID: LIB3076-005-Q1-K1-F9
cggacgcgtgggcggacgcgtgggccagatcagtcctaggagcgtcaggcgtgaaagaggtactcacgctccgcatctgggcgccgtggaagaggtcgcagtccaagctatagcaggagcaggagtcgtagccggagccggagctatagccgatcgaggtccctatctggatctcctaggggaggccgtcgtgactcgtgttgattggagatcgag

SEQ ID NO: 67793 - DNA, 377 bp, Zea mays
  Clone ID: LIB3076-005-Q1-K1-B5
ggcatgcagtgtggaaatcgtgtgattcagcgtggtataacatgcaaattgcaggtgttctttacacgcgagggcaaaggctgtggagtacgcacagtagaggatctcccaaaaggttcctttgtctgtgaatatgttggagaggtactaacaagttctgaattgcacgaaagagcaattgaaaatgcaagaaatggtaaacatatgcatcaagtactcctggatgctggttggggttcaggtgtattgagggatgaagatgcccttagccttgatggttcattttatgggaacgttgggcgatttatcaaccacagatgctatgatgcgaatttagttcagatccctgtgaaattgagacgcctgatcatcattat

SEQ ID NO: 67794 - DNA, 424 bp, Zea mays
  Clone ID: LIB3076-005-Q1-K1-B6
gaattgttctgttatataaatcttctaaacattttaacaaattatatgttttgtaggtccgaggttctatgccattcttgtgggagcagattgttgatttgacatacaaacctagttttgacattgttagacaagaggaagcgcctcgtgtacttgagaggcacttccatgatttgcaaaagaaatatggagctgtcttagccgttgatcttgtcaatacaggtggcggtgagggccgcctccgtgaaagatatgcaaaatctattgaacctattcttagtgaagatctaagatatgtgcacttcgacttccaccgaatttgtggccatattcactttgagcgtctgtctcagctgtatgatcagatcaaggactaccttcagaaacataagtactttcttataaatgattaaggagaggaaat

SEQ ID NO: 67795 - DNA, 427 bp, Zea mays
  Clone ID: LIB3076-005-Q1-K1-B7
ccaagatcaaagtggaggtggaggctttatcagcgttgagggcttccaacaagtcctcagggatactgacataaattttgcttcggataaactcgaggacctatgtaatgctgggattatagtatggagtgaattctggcaggcattgctacagttggataaaagggctggaggcatgaaggatccaactggtcttatgggcaagaagcaattcaccatcttccacttcaatggaattgccaagtctgtgctgaatgggaatgcaagtgcaggtggttcatgtcctatacagagacccaggttatgcaagctaaatgtcactgtccccccaaggtggactcaagatgagtatctggctgatgttgtaagcgcatcaaccagcagcagcaaggacgatagtattctttctctagctcccccaggtcag

SEQ ID NO: 67796 - DNA, 418 bp, Zea mays
  Clone ID: LIB3076-005-Q1-K1-B8
gcaagatcaaagtggaggtggaggctatatcagcgttcagggcttacaacaagggctcacggatactgacataagggttgcttcggataaactcgaggacctatgtaatgctgggattatagtatggagtgaattctgacaggcattgctacagttggataaaagggctggaggcatgaaggatccaactggtcttatgagcaagaagccattcaccatctggcacttcaatggaattgccaagtctgtgctgaatgggaatgcaagtgcacgtggttcatgtactatacagagacccacgctatgcaagctaaatgtaactgtcccctcaaggtggactcaagatgagtatctggctgatagttgaagcgcatcaaccagcagcaacaaagacgatagtattctatctctagctccc

SEQ ID NO: 67797 - DNA, 379 bp, Zea mays
  Clone ID: LIB3076-005-Q1-K1-C1
ccaagatcaaagtggaggtggatgctttattagcgttgagggcttccaacaagtgctcagggatactgacataaaggttggggctgataaactcgaggacctatgtaatgctgggattatagtatggagtgaattctggcaggcattgctacagttggataaaagggctggaggcatgaaggatccaactggtcttatgggcaagaagcaattcaccatcttgcacttcaatggaattgccaagtctgtgctgaatgggaatgcaagtgcaggtggttcatgtcctatacagagacccaggttatgcaagctaaatgtcactgtccccccaaagtggactcaagatgagtatcttgctgatggtgttagcgcatcaacc

SEQ ID NO: 67798 - DNA, 405 bp, Zea mays
  unsure at all n locations
  Clone ID: LIB3076-005-Q1-K1-C10
tcttatccctgcaacagttgatcagcaacttgaaaatcttcaatcagagaaatctgcccaaagtgaagaagcctcaaaagttccccaggacctcctctacaagagaattgcagaagtcaaagagaaggaaaggcaaaatgccttagaagagattatctactgttgggttacatataggttcatggaaaatgacatatatatgacacctgcattatcaccagggggtggccctgtacgtgacatatccgcgttgcctaatcaagaagacaaattgcgaaacatacactccgcagacgcctttgagatgatacaaaaccatctcaatcttatcatgggagaaaagatagcatcnaccgccgatactgntgttgagatcagcaacttgaatctttggaagctgtatgc

SEQ ID NO: 67799 - DNA, 219 bp, Zea mays
  Clone ID: LIB3076-005-Q1-K1-C11
ttctcttatccctgcaacatttgatcaacaattctaatttcttcaatcatagaaatcttcccgaattgagtaaactttaaaaggtccccgggaccttatctactatataatttcataattcaaatttaattatattcaaaattccttataatacattatctacttttcttttacatatatattcatttaaaatgacatatatattatacttatattatc

SEQ ID NO: 67800 - DNA, 373 bp, Zea mays
  Clone ID: LIB3076-005-Q1-K1-C2
cccacgcgtccgcccacgcgtccgcggacgcgtgggatcgcaagcgcggacgccatcaagcctctcatccacgtccttgagacgggtaacccagaggcaagagcaaactcagctgcaactctcttcagcctttcagtaaacgaagagaacaaggccaaaatcggacgatctggagcaatcaaacccctggtcgacctgctgcgagatggcagtgcacaggggaagaaggatgcagcaacggctctcttcaacctatcgatatttcacgagaacaaggcccgggttgttgaggccggggctgtaaagcccctggtggagctgatggacccagcagctgggatggttgacaagggcgtcgccgttttggcaatcc

SEQ ID NO: 67801 - DNA, 292 bp, Zea mays
  Clone ID: LIB3076-005-Q1-K1-C3
agatcgcgagcagtgtgttgtgttgtgttgtgtgggtgcagcacggtagcaggctagccatgtgccctgctgtgttgtgtcaccatccatctataataatcttatatctataccccaccttttgtgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagatacaaaaaacagatcaattaaaaaataacaaaataaaaaagaaaacaaaagaccgatatg

SEQ ID NO: 67802 - DNA, 258 bp, Zea mays
  Clone ID: LIB3076-005-Q1-K1-C5
tacatcccgagcaatgtattttgatttgatgtttgatttcagcacattaccatcctcaccaggtcccctacaatgtcatagtcgccatccatctataataatcttatatctataccccaccttattattaaaaaaaaaaaaatataacatacattactacaaataaataaaataaactaaatacattaaaaatccaactattacttataaacaaaaatcaattcaccattttccacttcaatgtaaattccaaatcta

SEQ ID NO: 67803 - DNA, 371 bp, Zea mays
  Clone ID: LIB3076-005-Q1-K1-C6
gcgcccacgcgtccgcccacgcgtccgcggacgcttgggttcgcaagcgcggacgccatcaagggtctcatccacgtgcttgagaggggggacccagaggcaagagcaaactcagctgcaactctcttcagcctttcagtaaacgaagagaacaaggccaaaatcggacgatctggagcaatcaaacccctggtcgacctgctgcgagatggcagtgcacaggggaagaaggatgcagcaacggctctcttcaacctatcgatatttcacgagaacaaggcccgggttgttgatgccggggctgtaaagcccctggtggagctgatggacccagcagctgggatggttgacaaggccgtcgtcgttttggc

SEQ ID NO: 67804 - DNA, 300 bp, Zea mays
  Clone ID: LIB3076-005-Q1-K1-C7
acgagatcgcgagcagtgtgttgtgttgtgttgtttgtgttcagcacggtagcatgctagccaggtgcgctgctaagtttgggcgcatgcatctataataatcttatatctataccccaccttttgtgtaaaaaaaaaaaaaaaaaaaaaaaaaaaaaaaaaataaaataaaaaaaaaataaacaaaaaaaaaatcatacttaaattataataaaaaattatataaatctattatattattatatatataataatcatatttttaataatattaatatattaatatatatcattactaat

SEQ ID NO: 67805 - DNA, 110 bp, Zea mays
  Clone ID: LIB3076-005-Q1-K1-C9
aacatgcatctactgaatatacttctacgactcactcaatccttcctcttaccgtctttttcacctcattaaatgcaaatccctcttctttattcaacacatatttacca

SEQ ID NO: 67806 - DNA, 203 bp, Zea mays
  Clone ID: LIB3076-005-Q1-K1-D1
agatctcaagcagtgtgttgtgttgtgacttttgtatgcagcactgtaccaatctatccgtgtaccctgctgtgttgtgtggccatccatctataataatcttatatctataccccaccttttgtgtaaaaaaaaaaaaaaaacaaaaaaataaaataatacaaaaaaaaaaataaataatctaaaatgataataataattaa

SEQ ID NO: 67807 - DNA, 467 bp, Zea mays
  unsure at all n locations
  Clone ID: LIB3076-005-Q1-K1-D10
cccacgcgtccgggtttttaatggagggcacaaggagtaaacctttctggttttccatggtaatatatgtgctctggctaattgaaatgccatggttttggggccatgcaacgtctgaaaatggagaaatcgctcaaatgtacttatctggatggagcgtgccaattcatgatgggggcttgacgggcaacaaactgagcaacccagatgtgcttgtcatcacactaccgttcctctatctggtgcttgtcccagtaatagtccttatatatggtctgtttgcagaaaaggctactgtatntttgcagcacagaataagagtagtatactcttggggactttttttttttttattctttatttatttgtatttatattttttttttttatttttttttttttatatattttttgttttgttttttttttttttttttttttttttatttttatttttttttttattt

SEQ ID NO: 67808 - DNA, 212 bp, Zea mays
  Clone ID: LIB3076-005-Q1-K1-D11
cccacgcgtccgggttttaaatggagggtttaagtattaaacctttctggttttccatggtgatatatgtgctctgtctaggggaagtgccatggttttggggccatgcaacatctgaaaattgataaatttctcaaatgtacttatttgtattgatcgtgccaattcatgaatgtgtcttgactgtcaacatatttttcatcttcatattt

SEQ ID NO: 67809 - DNA, 426 bp, Zea mays
  unsure at all n locations
  Clone ID: LIB3076-005-Q1-K1-D3
accagcgctcgtcacctccaatcaacaaattcccaatccgccgcttcccatcccgcgttcgccgctccatttgatcgaattgcccgatggcgcccaaggccgagaagaagcccgcggagaagaagccgacggaggagaaggccgagaagaagcccagggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctggctgccgaggccgncaagctcgcccgctacaacaagaagcccaccataacctnccgggagatccagacttcggtgcgcctcg

SEQ ID NO: 67810 - DNA, 436 bp, Zea mays
  Clone ID: LIB3076-005-Q1-K1-B4
atcttttcgcgtttagaacctctaaaatttcccccactcgccagtcgcagcagcacctgtggccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgactaggagctcgggaagctgctggcaggcgtcaccatcgcgcacggcggcgtcctccccaacatccac

SEQ ID NO: 67811 - DNA, 446 bp, Zea mays
  Clone ID: LIB3076-004-Q1-K1-H7
cccgaagagaggcggtagggcgccggtccccgccaagaagaaggcggtggtgacgaacccgctcttcgagaagaggccgaagcagtttgggatcggcggcgcccttccgcccaagaaggacctccaccgcttcgtcaagtggcccaaggtcgtgcgcatccagcgccagcgccgcatcctcaagcagcgcctcaaggtgcccccggcgctcaaccagttcacacgtaccctcgacaagaaccttgcaacaaacttgttcaagatgcttcttaagtaccgccccgaggacaaagctgccaagaaggagaggctcttgaagagggcccaggctgaaaacgaggggaaaactgttgagtcaaagaaaccaattgttgtgaagtacggccttaaccatgtgacttacctcatcgagcagagcaaggcccagctggttgtcatagctcatg

SEQ ID NO: 67812 - DNA, 427 bp, Zea mays
  Clone ID: LIB3076-004-Q1-K1-H8
aaagccacaccagaggtcacggagtacaaggaccgcttgtcctctagctctgatcttatcacccactcgagagctctcaggccaaatccatgaggaagcaaggaagtttgcataccagactggtgtcagagtcgtggttgcatatggtggtgcaccaataactaaccagctgagggagttagagagaggtgtggaaatcctggtggcaactcctggtcgcttgatggatctgttggagagggctagagtctcacttcaaatgataaagtatttagctcttgatgaagctgatcggatgcttgatatgggtttcgagccacagatacgtaaaattgttgagggcatggacatgcctcaacgtggtgagaggcagacaatgttgttagtgcgacattcccaaaggagatacagaggatggctgcagatt

SEQ ID NO: 67813 - DNA, 323 bp, Zea mays
  Clone ID: LIB3076-004-Q1-K1-H9
gccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagc

SEQ ID NO: 67814 - DNA, 320 bp, Zea mays
  Clone ID: LIB3076-005-Q1-K1-A1
aaaaaaaaacataaaaaaaaaaaaaaacaaattaaacaaaaaaaagaaaaaaaaaaaaaaaggggaaacaataaaatgaaaaaagagaaccataaaaaaacaaaaactatataaacaacaaaaaagaatatctggatagcgacaaaaacgatgtcgtaacacggcgtctttatctttttcgtttacgttcgcgacactttttgggttgccacgtcgcgtttatttgtggttgggtttgttgcatactacttgactgtctcatcatgaggaagccactagacttttacaccctgtaaaatgggaaaaccccttggttctcc

SEQ ID NO: 67815 - DNA, 275 bp, Zea mays
  Clone ID: LIB3076-005-Q1-K1-A10
ctcaccggctccattcgaccattccatactttccttatcccctcccacttcgacttcctggctggcttcctttcttcgccatggcaaccatgtccctccgctccctcgccatggccatggccgataccgcgctaccgcccgcccacaagctcctacccacagtttcccttccgctcctctcctcgtccacccgcgccgcgccgttcctactgttcgccaggcgccacctgccgatcgcgcccctcgttaccttctgcgacacctgtgaggccaag

SEQ ID NO: 67816 - DNA, 370 bp, Zea mays
  Clone ID: LIB3076-005-Q1-K1-A11
gcggtcagctgcagctagcgtggactggagatttaccattccaccagtccggtccatttgctggaccgggattggtttcttctggcctaggaacatccggtgatgtcgactcctgcgaggaagacgctgatgagggatttcaagcggttgatgcaggaccctacggccggcataagtggcgccccgcaggataacaacataatgctgtggaatgctgtcatatttcgacctgatgataccccgtgggatggaggtacgtttaagctgactctccagtttaatgaacaatatccaagcaaaccaccaactgtgcgatttcgttctaggatgttccatcctaacatttattctgatggaagcatatgcttag

SEQ ID NO: 67817 - DNA, 214 bp, Zea mays
  Clone ID: LIB3076-005-Q1-K1-A12
tctcaggccactcgcctgggacctcgaatcgatgaccatctggcgctaggaacttacaagcatacttactccttgtacgaacatgttgattacgcagttcaagcttgattacatcataccattctgcgccataatctaacctgccattgataacatatcgatgctgtataacgctgttatacttggaccggacgatagctgctctaaccaatgt

SEQ ID NO: 67818 - DNA, 415 bp, Zea mays
  unsure at all n locations
  Clone ID: LIB3076-005-Q1-K1-A4
ggaagaaaaaggggaccaaaaaactgaaattgggataggaggaacggatcagcggtggaagcttccagccctagcgcancggtggcgggttggtgcgagcaggcggtggcgctgctacagcgccccgcggtggcggagatggccgtcgacgtgctgctctgcgcggtgccgatctgggccgccgtcatgatcggcctcgtcgtcggctggtcctggcgcccgcgctggacgggactgctcttcctcggcctccggagccgccttcgcatcctctgggtgccgtcaggcctttgggcccggcggctctggttcgcctgcaccgcgctctccgtctgcttcgtcgcgaccaagctcatcttcttcgcatttcgccgttgcataggcaatctccaggacaggggcctccccgacgatt

SEQ ID NO: 67819 - DNA, 414 bp, Zea mays
  Clone ID: LIB3076-005-Q1-K1-A6
cggacgcgtgggtgtgtatctgcccgatactgatatgcatatctatacctgtgctgcatagtgttcgagtacatgtttctgtgggtttgtggctagcactcattgatgttctattgttctatggcttaatgtttacacgatggtagtagaataatgaatatgatcatagcgttgtcagttttcttttaactaacaataccatgcatttttcattctctgcagtcatctgttcttcattcccagccgaagtccactgttggaacacctgcttatattgcacctgaagttttgttgaaaaaagaatatgatggcaaggtacttgtgctatcactttttttatcttgagaaatgtgtcttgagagttgtgcatacctctgcatcagtgcacttgtgttccatatacatgtgccacat

SEQ ID NO: 67820 - DNA, 428 bp, Zea mays
  Clone ID: LIB3076-005-Q1-K1-A7
cggacgcgtggggggattctcgttttaaactcatgaccctcatgcatcttgcacgggctcgggcacgggcaccgggacggggcgggcaccggctataaataaccacacaccctcaagggctgaaccgaaccaagcagtaacattaatcacccactctactactcgaagttactaccagcagcttgcttcaacagtagaagagagcgagccgaggatggcgtcaccgaagccctcgtcggcggccctgctcctcctggcggcggcagccgtgctggcgctggcgcgcgcggacctgacgcacgacaactgcgtgaagaacaagaaggtgacggtgcagaacctgtgcagccacgacgtgacgctgacgctggagccgttggccaacagcccggcgttgttcgcgggcacctacacgttgcacccgcgca

SEQ ID NO: 67821 - DNA, 355 bp, Zea mays
  Clone ID: LIB3076-005-Q1-K1-A8
ggaagaaaaaggggaccaaaaaacggaaaaggggataggaggaacggatcagcggtggaagcttccagccctagcgcagcaatggcgggttggtgcgagcaggcggtggcgctgctacagcgccccgcggtggcggagatggccgtcgacgtgctgctctgcgcggtgccgatctgggccgccgtcatgatcggcctcgtcgtcggctggtcctggcgcccgcgctggacgggactgctcttcctcggcctccggagccgcctccgcattcctctggtgccgccaggcctcggggcccggcggctctggttcgcctgcaccgcgctctccgcctgctccgtcgcgaccaagctca

SEQ ID NO: 67822 - DNA, 391 bp, Zea mays
  Clone ID: LIB3076-005-Q1-K1-A9
gtaagctgcagctagtgtggactggagatccaccactccaccagtccggtccatctgctggacctcgattggtttcttcttacctaggaacatccggggatgtcgactcctgcgaggaagaggctgatgagggatttcaagcggttgatgcaggaccctccggccggcataagtggcgccccgcaggataacaacataatgctgtggaatgctgtcatatttggacctgatgataccccgtgggatggaggtacgtttaagctgactctccagtttaatgaagaatatccaaacaaaccaccaactgtgcgatttgtttctaggatgttccatcctaacatttatgctgatggaagcatatgcttagatatcctgcaaaatcagtggagtc

SEQ ID NO: 67823 - DNA, 280 bp, Zea mays
  Clone ID: LIB3076-005-Q1-K1-B1
attgtcgcgctgggttaagggatgccaaaaagaacaagaggagggtggattcagtaggaaaaagacaattctttttcgtggtaaccatagcggcgccgtgctatatagccggcgttttgtatatctgggtagcgacgagacgatgtcgtagccggcgtctttttctttttcgtttcgttcgcgacactgggtgggttgcccgccgcgtttatttgtggttgggtttgtgcatactactagactgtctcagcaagaggaagcaactagacttttagaccct

SEQ ID NO: 67824 - DNA, 197 bp, Zea mays
  Clone ID: LIB3076-005-Q1-K1-B10
tcgcccacgcgttcgtccacgcgttcgggctctctctctaccgacaatttcaggccctcgcggggagtcgaagtcagaaccacttggggtcccttaataaaaagctcactaagtggtggtccccgcccttttttttcccggtcctggttgaataccatatcctaatttgggccttgaactaaaccggccattaagtt

SEQ ID NO: 67825 - DNA, 426 bp, Zea mays
  Clone ID: LIB3076-005-Q1-K1-B2
tggataaaagggaaaagttttgctctgggtccccggcgaaggattttaaatgaattgcagacagggcctcggtgcactatggacttgagtttacggctctgcagaaaaccccctagggtttctggaaatcgaacccacgacccttccctaatggaacggtggccgcagaggaaggaaggggtggaggggcttaccggcggcgagactgctctggtgaggtggtcgaggatgtacgggaggtcttgaggatcacggcgatgtgcgggtcgccgtcggggatggtcggagtcggccggtccgcgtgcgcatgcggagatgctcgccggcggcgaggagtccggcctaaccagggcacgataggtcaatcgaatgggtcagagagcttcactggatgctatggaagatgtgggtgcaaggaattggaaa

SEQ ID NO: 67826 - DNA, 436 bp, Zea mays
  unsure at all n locations
  Clone ID: LIB3076-005-Q1-K1-B3
gtccgtaaggcaccgccgccgcgtctcggctggaccgacaggccggccgatccgtcttctgatcctcctcctgctcctcctcctgcggctgtgcaggtcggcttcggggacgatggcggcgagggcggctgatgagaacagaaggccgggggtggggaggcccgcgccatgcgtccgagacatggggagccggcgcgcgctcacggacatcaagaacctcgtcggggttgcctcgaacccctgcgccgtcgccaagaagcccgtgctgcagaagagcagaagggacgaaaagaagacagcgttgccaagcagccggccaatgacaaggaaattcgtcgccttcttggcgagcaaagggcaacctgaatgtcagccgaccggagctggtccagaacccggagttgatccacggnaggaaccaatcggcgatggcacc

SEQ ID NO: 67827 - DNA, 378 bp, Zea mays
  Clone ID: LIB3076-004-Q1-K1-H6
gtcctattgttatgcctccaaaatcattttagatcagaccttttgtggacagaagattctgtatcacagctggttctttggatatttcaaatcaaagtcaattcaattgctattgtctgtatgaggtctatggacagaggcccatagcacacattaaatagaggtttttatgtatctgaaggtgcaaaaatgtgtagtgtgaagcaggtcatggctgcacaagctctctatgtatctggtagcctgttcaatcactcatgtcagtccaatgtgcacgcatattctctttcacgtgcgttcgtgctgagaactactgaatttatatagtccgagagccctgttgaactgtcatatggttcacaatgttgctagatgcat

SEQ ID NO: 67828 - DNA, 309 bp, Zea mays
  Clone ID: LIB3076-004-Q1-K1-F6
atacatttttcagttagaccaaggtctaggtattggctgctaaaacccgttctataaccgtcatcaacttactctgaccaggttcatcaattcaaataagcaagataaaggacacctcaagccactaccaatctgattgattctatatggccatcatgctctttgcttgacttatatgctctagctatgactcacattgcacttgatagggccttattctagtatggtagctttaataatattgaacttagctctactaataatatatcttaggtagctacttatctgtgtgtccctgtctgtaacaca

SEQ ID NO: 67829 - DNA, 127 bp, Zea mays
  Clone ID: LIB3076-004-Q1-K1-G11
tccacgcgttctgccacgcgttctggaaaaccatccgtctgaagcccgaaggcggattcttcaacagcggctggagccctgccttaccacaccaatcttctgcaaacccccctctcgtattccttct

SEQ ID NO: 67830 - DNA, 262 bp, Zea mays
  Clone ID: LIB3076-004-Q1-K1-G12
cttcacttgtctgccctcgcgtgctcccgggcctctgcatcctgagccagggcttctgcccttagctccgatccggtccgactactaacccacgccgcataagccgcgcgacctgatcgcgcggtggtcgaggataggggaaacgcggcgccgcggttgcctgccaccgaaccgactcaggatatggaagaggagccctgatcccttcgtcccggtgcccttcggaccgatggactccgagcactggatctcgcgcctggcc

SEQ ID NO: 67831 - DNA, 446 bp, Zea mays
  unsure at all n locations
  Clone ID: LIB3076-004-Q1-K1-G2
cccacgcgtccgcccacgcgtccgagaagacaaaaatgctgtattggagttgacctacaactatggggtgaaggaatatgataagggaaatgcttatgcacagattgctattagtactgatgatgtctacaaaactgcggaagcaattagagtaaatggtggacaaattactcgtgaacctggcccattacctggcatcaccaccaagataactgcatgcacagatccagatggctggaaaacagtgtttgtcgataacatagattttctgaaggagttggaagaatgagctttgctagagatctcaacttggtacatcaagctccatacggttgcacccccgtgagttccatgcatgacctgcanaatcttttgtaagccacagccttcaactgangattgtagataggtcgtnccatctacggcatcatcgcaattggatagtg

SEQ ID NO: 67832 - DNA, 244 bp, Zea mays
  Clone ID: LIB3076-004-Q1-K1-G3
aaagaacaagaaactgatccttgggccagcaagatgtcttctactgtgtgtgctgatgacatgaaaggtagctggaacactgcatcaaaggtcattccatctaaggaaaaggctgatgatccatggaatagtaaggggggtaatgatgacagcatgaaaactgacacctggggtgcttgctcgacaggttgggatcagcaactatcttggagcatacttaatttctagactgagggaccaggaa

SEQ ID NO: 67833 - DNA, 433 bp, Zea mays
  Clone ID: LIB3076-004-Q1-K1-G4
gagcaaagccctgaaatccttctccccctgcacgcacctgcagacctgctctctcgcgcgcatctcccgtgcccctcactgtttagtggcgacgactgggcgacagtcgccgccgccgcccgctaggggccgtgcccctggtctccatcttcggcgcttcgcccaccagatatgagcagctggcaattcgattttgaggccattatttgataacccgggacaagtgcactggttacctgaccattttagctttttgagatggctacacagttgccatgcttcacacagctcagtccaccgtcttgtagttggataaaagatgtcgggaactgcaaggctacgcctgatagggtagccagaagtgcccgagctttgggccactgtcactttccgtgctgtgcatgccctcgtagtgcaaacctctttcaagaag

SEQ ID NO: 67834 - DNA, 435 bp, Zea mays
  Clone ID: LIB3076-004-Q1-K1-G5
cccacgcgtccgcccacgcgtccgcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcg

SEQ ID NO: 67835 - DNA, 365 bp, Zea mays
  Clone ID: LIB3076-004-Q1-K1-G6
ttgacaaacaatttgctgacgaggtaattgctacttgctttcatctgttatccattcccgctattggtatactacatgatgtgcactggttacagtgttcatttcgtgcactgagttcaagtattgtgtgctctccagtctgtgcttatttttaaaagtatatcatctacatttgcccttttgaattgcttttaccgataagaaaatgtttgctgtttcatttcaattctagaatttcttttacattgtgtgtatgtgttccatgtgcttcatgatgtgttttaacaactaggtgtatactgaaagatcaatatataatggatcgaggtaaactacctatataggacaatgtcttgagtatacat

SEQ ID NO: 67836 - DNA, 445 bp, Zea mays
  Clone ID: LIB3076-004-Q1-K1-G7
cggacgcgtgggcggacgcgtgggcggacgcgtgggcagatagagaatgatggagatgttctttgggaaccagatgtgagagaaacaaatgaggctgtcgcattgaggggtatgaagtttatggactggttgtggacaagagaagagaaagagatagctattgtcagtcacagtggtttcttgtttcacaccttaagcatgtacagcaaggagtgccatccaaccataagagacgaagttagcaagcactttgcaaactgcgagctacggtcgatggtgttggttgacagaagcatgcttgggtcatattcgtcaagattcaactatgctggcaagaatccaaccgggctagatgtgcctaatgatattgcagataagaagcaggttgatgaagctcagaagaactgaggcaaccttgaaagcataccgtagatgacttggatta

SEQ ID NO: 67837 - DNA, 199 bp, Zea mays
  Clone ID: LIB3076-004-Q1-K1-G8
aaagcacaataatctcatcctgcttctcatttagaagtcatctactgtatgttctgagctggattatatggacttggggcacggcaatatagggcactccatctaatgtaaataggctgattatcacactattcttaattgtataagtatatcacctatagataacttactctaatttgctcttacctcataattaatt

SEQ ID NO: 67838 - DNA, 352 bp, Zea mays
  Clone ID: LIB3076-004-Q1-K1-G9
cccacgcgtactaccacgcgttctgccacgcgttctggaaaaccatccgcctgttgcctaacgggggattctccaacaccgtttgcggccctgcctcactacactaatctgctgcgaacccccctctcgtattccttctcgccatcctgccccgagcgcaccgtttataggccgccaggctccggcaccctcgcccgcccgggctcgcctggggtcggaatgccctgcttcccgccgtcgctgctcggagtcggtccacggctgcgctccttcctccgctactacgactcgctccagtccctctccctcgtactcatctacctccatattggttgtgcactgatcgtatcac

SEQ ID NO: 67839 - DNA, 441 bp, Zea mays
  Clone ID: LIB3076-004-Q1-K1-H1
gtcctattgttatgcctccaaaatcattatagatcagaccttttgtggacagaagattctgtatcacagctggttcttttgatatttcaaatcaaagtcaattcaattgctattgtctgtatgaggtcgatggacagaggcccagagcacacaataaatagaggtttttatgtagctgaaggtgcaaaaatgtgtagtgtggagcaggtcagggttgcacaagctctttatgtatctggtagcctgttcaatcactcatgtcagcccaatgtgcacgcatattttctttcacgtgcgttcgtgctgagaactactgaatttataaagtccgggagcccagttgaactgtcatatggtccacaggttggcgagatgcatatttcagagagacagaagtcacttcaagagaattactacttcagttgtcaatgttcaagttgt

SEQ ID NO: 67840 - DNA, 355 bp, Zea mays
  Clone ID: LIB3076-004-Q1-K1-H10
tggatttttagggagcagaccatgaagaatttgtgaaggcagcaaccacagacaacgaggtacagtttgtataaacgcagtgatacaagtgtggccaaggttctatttccaggtattacgtccgaggagaaatttgtgggcctcgttaaaagcgagccagagaagtttgaaaagttcgatgggaaatttgaagaaaaggaaattttgcggtttgtggagctcaacaagtttcctctaattactgtattcactgagctcaattctggtaaagtatattcaagccctattaagctacaggtcttcacctttgcagaggcttatgatgttgaagatcttggatctatggttgaagaaa

SEQ ID NO: 67841 - DNA, 375 bp, Zea mays
  Clone ID: LIB3076-004-Q1-K1-H2
tcgcggacgcgtgggcggacgcgtgggcggactcgtgggcagatagagaatgatggagatgttctttgggaaccagatgtgagagaaacaaatgaggctgtcgcattgaggggtatgaagtttatggactggttgtggacaagagaagagaaagagatagctattgtcagtcacagtggtttcttgtttcacaccttaagcatgtacagcaaggagtgccatccaaccataagagacgaagttagcaagcactttgcaaactgcgagctacggtcgatggtgttggttgacagaagcatgcttgggtcatattcgtcaagattcaactatgctggcaagaatccaaccgggctagatgtgcctaatgatattgca

SEQ ID NO: 67842 - DNA, 384 bp, Zea mays
  Clone ID: LIB3076-004-Q1-K1-H3
gtcctattgttatgccttcaaaattattatttatcagaccttttgtggacagaagattcggtatcacagctggttctttggatatttcaaatcaaagtcaattcaattgctattgtctgtatgaggtctatggacagaggcccagagcacacattaaatagaggtttttatgtagctgaaggttcaaaaatgtgtagtgtggagcatgtcatggttgcacaatctctctatgtatctggtagcctgttcaatcactcatgtcagcccaatgtgcacgcatattttctttcacgttcgttcttgctgagaactactgaatttataaaggccgagtgcccagttgaactgtcatatggtccacatgttggctagatgcatatttca

SEQ ID NO: 67843 - DNA, 315 bp, Zea mays
  Clone ID: LIB3076-004-Q1-K1-H4
actgactcgtgtacggatttgtgtgcagatagagaatgatcgacatgggcttgggtaaccagatatgggagaggcgaaatgatgctgtctcattgaggggtatgaagtttatggactgtttgtagtcaagattgcatatagtgattcacctagttcattacagctgatgcatgtataacaccttaagcatgtactgctaggatttccatccaaccatattagactaatttagcattcacttatgtaaactgctagctactgtcaatggtgttgtttgacttatacatgctttggttatatttgtcaatatataac

SEQ ID NO: 67844 - DNA, 448 bp, Zea mays
  Clone ID: LIB3076-004-Q1-K1-H5
acgcggacgcgtgggcggacgcgtgggcggactcgtgttcagatagagaatgatggacatgttcttggggaaccagatgtgagagaaggaatgaggctgtcgcattgaggggtatgaagtttatggactggttgtggacaagagaagagaaagagatagctattgtcagtcacagtggtttcttgattcacaccttaagcatgtacagcaaggagtgccatccaaccataagagacgaagttagcaagcactttgcaaactgcgagctacggtcgatggtgttggttgacagaagcatgcttgggtcatattcgtcaagattcaactatgctggcatgaatccaaccgggctagatgtgcctaatgatattgcagataagaagcaggttgatgaagctcatatgaactgatgcaaccttgaaagcataccggaaaatgaacttggatt

SEQ ID NO: 67845 - DNA, 244 bp, Zea mays
  Clone ID: LIB3076-004-Q1-K1-F5
ctgacgcgtgtgctgactcgtgggtcgattgaatatcatcggcttatggatatggagtggacaggttaattgtacaaggttgtctggcctgaagtacccaacagtcaataccaagatgtacttacagtataacaagatggatagacttgaaccttacgactccttttctgatacctttgtttataagctgatcatgttactgtgtttgatacacccatgatgggtacattgagaccatttatgt

SEQ ID NO: 67846 - DNA, 390 bp, Zea mays
  Clone ID: LIB3076-009-Q1-K1-D8
gtcttgacctagcgcagccgccaccacagcgctgtccctgccgcgatagctgcgcggcgccgctcaacggaggccgacgaggcgatgagaagcggaggccgagcagtcgcacttgcaggttcagtcctgcttgtccgcagtccacagttcgccctctatcctctgctgtgggatctgcagtaccatctgcttcggcctcagcactgccattcgcttcagcctctgcactaccgtccaagtcaagtcgctgtatcaccttagcccatggacgctcgcaatgccttgatggcttgacctctgatggagaggaagtaaggtgagaaatcacgattggatgttgactttgtgaggccgtaaaaattgagatgtatttttaatattcttgtaata

SEQ ID NO: 67847 - DNA, 366 bp, Zea mays
  Clone ID: LIB3076-009-Q1-K1-E2
ggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacc

SEQ ID NO: 67848 - DNA, 311 bp, Zea mays
  Clone ID: LIB3076-009-Q1-K1-E3
ggagaagaagctctccgcggcgaagatttcggctgcgcaccctccctacgctgagatgattgtagaggcgatcgctggcctcaaggagaggaaggggtcgagctcggtggccatcatcaagtacctcgaggggaagcatggcggcaagctccccaccaacttccgcaagcagctcactgtgcagatgaagaagctcgctgtcaccggcaagctgacgagggtgataaactacttcaagctgccagtcaccgacgcctagcccaaggccgcctagctcaatgcaccctatgacgcgctcaagcccaagccct

SEQ ID NO: 67849 - DNA, 345 bp, Zea mays
  unsure at all n locations
  Clone ID: LIB3076-009-Q1-K1-E4
agcaccttcccaaaaaaatcccccattttcttcgaggcgaagagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgncatggacgtcgtctacgcgc

SEQ ID NO: 67850 - DNA, 235 bp, Zea mays
  Clone ID: LIB3076-009-Q1-K1-E5
ctaagcacagcaacctcatctctaacggtcacttcaagaagcactggcagaactatcccaagacatctttcaaccagtcctacctcaagcagaggcgcctcatcctacttcaaaagaaggctgtcattatatttccaagaccaactgcttaatcactttactctcattgcacaatgccacaatatttaatacaatatgaagtcaatgccttgaattatactggctcttgacgatt

SEQ ID NO: 67851 - DNA, 407 bp, Zea mays
  Clone ID: LIB3076-009-Q1-K1-E8
gtctgcgtgctcaaacaggacagcattagcagatccaggaccaaactaattgagcaggaaccacgcgaatggttcgattttattttttttttaaaaaaaatcagtttgtcatgtgtgtaataatttctcaggctctacagcgacgagaccaggagcaaccaccgctagatcgggcgagatggatggacagtgaagaggccatgtttgctggtccttgatgttatctaaaacgcacgcatgctctattatagctagtcatcactatatatatacttgtgtttgtgtattgttgttcttgttctgctggtgtctacgccgattaatttgacctatgttatggagtgagtgatatatgtgccgtcactcctagtatatagtagtgagtgactagttggtatgtgtagtac

SEQ ID NO: 67852 - DNA, 216 bp, Zea mays
  Clone ID: LIB3076-009-Q1-K1-E9
aattaagagaattgaattttgctaatatagtttcattagctcctgaagtattatggatactagtacacgagatataggtcaaagaaaaaattagtatattctgtctcacagtatattctaaaaattccaaaatttaagaaaaagggaaacctggtgattaattgaatatttagagggacctaaaatttgaagcctatgggctaaggacactattgc

SEQ ID NO: 67853 - DNA, 288 bp, Zea mays
  Clone ID: LIB3076-009-Q1-K1-F1
ggaagagaacagaagactccaggggtccagacgaaacccttaggccggccctcagctgcactgtgtatctctagttttccactcaccacgagaacaaaacgagggagacgactgctccacgtacaggccgatcgaggctgaaggatcatctctgggctgtatggtattgtagacacaaataatcatctgggctgggctgggcatgcaggtaatagtggtgtgcactagttctgaggttatatctctgccttgttcatcttaattcgatctgccggtgtcttgttgatc

SEQ ID NO: 67854 - DNA, 101 bp, Zea mays
  Clone ID: LIB3076-009-Q1-K1-F11
acttctgtttcagtatggacgtaatctactcattatctactcaatgcctgaaacccaaatttccaatctacaagggatatttatcaatgacactataccac

SEQ ID NO: 67855 - DNA, 287 bp, Zea mays
  Clone ID: LIB3076-009-Q1-K1-F2
ggaagagaacagaagactccaggggttcagactaaacccttaggccggccctcaactgcactgtgtatctgtagatgtccactcaccacgagaacaaaacgagggagacgactgctccacgtacaggccgatcgaggctgaaggatcatctctgggctgtatggtattgtagacacaaataatcatctgggctgggctgggcatgcaagtaatagtggggtgcactagttctgaggatatatctcttgcttgatcatcttaattcgatctgacggtgtattgttgat

SEQ ID NO: 67856 - DNA, 417 bp, Zea mays
  Clone ID: LIB3076-009-Q1-K1-F3
tcaggagtgaacaagcaattcaagatcttacttaactgtagttcaccattaagggatccattgccagactcagtgtgtggatcttcgaaagcggacctcgaacgtaacatagacttcatatattgcgtgaattcattatccatcttctttctataattgggatctttgtttgatgtcaaccctgtgattgctctctgcagaggcttacgattcgctggatccaaatggcaatatcactataaaatgggatatcatgcagtggactcctgatggatatgtcgtaagtagaattgcccactctaacagctgtatctctttcatctccagcttggtaggccctggtttattctattaaatagcccagtttgacctgtacaatataagttaatgtaacatggtcaatggctgatttggaaa

SEQ ID NO: 67857 - DNA, 352 bp, Zea mays
  Clone ID: LIB3076-009-Q1-K1-F4
tcaggagtgaacaagcaattcaagatcttacttaactgtagttcaccattaagggatccattgccagactcagtgcgtggatcttctaaagcggacctcgaacgtaacatagacttcatatatcgcgtgaattcattatacatcttctttctataattgggatctttgtttgatgtcaaccctgtgattgctctctgcataggcttacgattcgctagatccaaatggcaatatcactataaaatgggatatcatgcagtggactcctgatggatatgtcgtaagtagaattgcccactctaacagctgtatctctatcatcttcagcttggtaggccctggttaattctat

SEQ ID NO: 67858 - DNA, 353 bp, Zea mays
  Clone ID: LIB3076-009-Q1-K1-F5
cccacgcgtgcgccgccgcttgatgattacgcgatgcaatgctcggagaaggcataggttactgccgacgaggtcgtgaaggcgctcgccaacatccgcactttcgagcgtgtttcgacagatctctgttactacatgtgcctacatggtgcatacagagcataaactaaagcatgtgatgatggcctcttagacgcttactatagaggcacaaatatgaaactaccagcatgtactatagctctaatcctagatcttttacctactatgagcactgaatgatggcataagtagctatcaaatacttagaagactttaaaattgactcaatggatctgaagataaatatcatt

SEQ ID NO: 67859 - DNA, 412 bp, Zea mays
  unsure at all n locations
  Clone ID: LIB3076-009-Q1-K1-F7
cccacgcgtccgggcgcctctgaaccttctcaccgactactgggattcaagccacgggatggagtcctcccctgtgggcgttctgcagaagacgaccgccttcggatcggtctccagcagtacagggagcagccctagggttgagaaccacggcgcctacgacggtttcggcaacctgcgggatgatctcggctcaattgtagtgcgccatccaagcatccgcctcgtgtgagctttctgagtttctgaccatggaaaactgcaacaagacggcggcccgcagccatagaagtgggcatatgggctactatgctaatcctcaaagcgtgaggggggcatttacctnctagtttgtcatttgagactgatctcctggttttgtcacttcagttcttcttttgcttccctttta

SEQ ID NO: 67860 - DNA, 424 bp, Zea mays
  Clone ID: LIB3076-009-Q1-K1-F8
cccacgcgtccggtcgcctttgaactttctcaccgactactgggattcaagccacgggatggagtcctccggtgtgggcgttctgcataagacgaccgccttcggatcggtctccagcagtacagggagcagccctagggttgagaaccactgcgcctactacggtttcggcaacctgcgggatgatctcggctcaattgtagtgcgccatccaagcatccgcctcgtgtgagctttctgagtttctgaccatggaaaactgcaacatgacggcggcccgcatccatagaagtgggcatatgggctactatgctaatcctcatagcgtgaagggggcatttacctactagtttgtcattttagactgatctccagttttagcacttcagttcttcttttgctttcctttttactttgctttttt

SEQ ID NO: 67861 - DNA, 363 bp, Zea mays
  unsure at all n locations
  Clone ID: LIB3076-009-Q1-K1-F9
ttaccgggccaatatgtggtctgcacccagattgacatncccttaatagttttgtgatttctctacggtagaaagaattgtaactttcagagacaatgaagacgccttctcgggtggaacttctgtttcagtttggtcgttatctactcatttcgtgctcaaggcctggaacccaaatttccaatctacaagggatatggagcaatgacactttaccaccatgggatgcagcaacccatccaaatataaatctacaaatgaattattgccctgcgctttctttgaatcttaccaagtgccaagaaaccaactgttgactttattggttccttttcaatcaatggagctaaaactgcaaaagtg

SEQ ID NO: 67862 - DNA, 424 bp, Zea mays
  Clone ID: LIB3076-009-Q1-K1-D7
gtcttgacctagcgcagccgccaccacagcgctgtccctgccgcgatagctccgcgtcgccgctcaacggaggccgacgaggcgatgagaagcggaggccgagcagtcgcacttgcaggttcagtcctgcttgtccgcagtccacagttcgccctctatcctctgctgtgggatctgcagtaccatctgcttcggcctcagcactgccattcgcttcagcctctgcactaccgtccaagtcaagtcgctgtatcaccttagcccatggacgctcccaatgccttgatggcttgacctctgatggagaggaagtaaggtgagaaatcacgattgtttgttgactttgtgaggccgtaaaaattgagatgtatttttaatatttttgtaatactaaccatgtcaaatatgtctacacggttggatg

SEQ ID NO: 67863 - DNA, 409 bp, Zea mays
  Clone ID: LIB3076-009-Q1-K1-G1
gccagctcaggagccgagcctggtcagggtagccaagcccatcccggtcctctcccggcgtcttctccctccgcaccgcggctccggcgatggcgggcgtcggctccgcgctgcgtcggctctacctctccgtctacaactgggtcgtcttcttcggatgggcgcaggtgctgtactacgcggtcctgacgctgcgtttgagcgggcacaaggccgtctatgccgccgtcgagaggccgctgcagttcgcgcagacagccgccatcatggagatcgttcatgggctcgtagggttggtgaggtctccggtctctgcaactcttccacagattggatccaggttgttccttacgtggggtgtcttgtggagttttcctgagacccagtcacaccttcttgttactaccct

SEQ ID NO: 67864 - DNA, 302 bp, Zea mays
  Clone ID: LIB3076-009-Q1-K1-A4
gtgtcgtcaggcgattcagtcgtcgttccggctgtgccctgtatccatggcggcagggttgggttccctcttgagaggcatcagggagaaggggctcaccaacttcattcacgacgtacgagacgaaggatacttcaaatgccttccggacgggaaccttttgcaaactaaaattcacaatattggagcaccacttgtacgagctgacacgcttggaaacaaatactatgacacactacatgacactgacgacggaaggcatacgtgggtacaatatgcagagaaatgtcgctacaatgcat

SEQ ID NO: 67865 - DNA, 365 bp, Zea mays
  Clone ID: LIB3076-009-Q1-K1-A5
ttaggctagttagtttacaatgctgacaatagcctgtctacatcgtatcgcattggcgtcctgtcaaatgtaaatttgacaaagggacgaatgaagtgtgaaaaattacaatatttaagcaaaatccagagttgcactcaggcaggacactttggaacgcaataaacgggtcggcacttctttaacttcccataggttacaatttcaatttgattttctctgaccacttgaatatatctgaataaacctgatcgccaccaatttcctcaccggttgccccagcagctattctgatgacgtcctcaattagagcaaagttccccattatatcaacatgtgcaccggtctgggtgccccctgctttc

SEQ ID NO: 67866 - DNA, 220 bp, Zea mays
  Clone ID: LIB3076-009-Q1-K1-A6
cccacgcgtccgcccacgcgtgctcggactcgtgggtccccaagctttgcattcgtccttctgtccttcctcacccggtcgtatgtctcgactcacccacccacccacagcatcagaaccgagggaattagggagcttcaggcggatccgtaacatccgcgaacggcgggaaccagggagcttcagtcgcctaaaaccggagctcccaatcgatccactg

SEQ ID NO: 67867 - DNA, 335 bp, Zea mays
  Clone ID: LIB3076-009-Q1-K1-A7
tccacgcgtccgtctacctttgctgatactcgcgggtcaacatgctatgggttcggcgttctgtcaaatgtgaatcggacaaatgtaccaattaactgagaaaaattacaatatttaagcgaagtacatagttagactcaggcaggtcactttcaaacgcaatcaacgggtacgaactagtttaacttgccataagctacaatttcaattcgatccactgtgaccacttgcatatctctgaatgaacctgatcgctaccaatttcgtcaccggttgcacgagcatctattctgaagacccgctgaatgtgtgcaaaactccccattatatcaaca

SEQ ID NO: 67868 - DNA, 374 bp, Zea mays
  Clone ID: LIB3076-009-Q1-K1-A8
ggacaatctcaaggccatcttggtggacatgttcgaggcaggtatagagacatcttacctgacgctagagtacggcatggccgagctcatcaacaacaggcacgtcatggagaagctacagacggaggtgaggacgacgatgcgctcgccggacggcaagaagctggacatgctagcggaggaggacctcggcagcatgccctacctcaaggcgaccatcaaggagacgctgcgcctgcacccgccggcgccgttcctcctcccgcactactccaccgccgactccgagatcgacggctacttcgtcccagccgggacgcgcgtcctcgtcaacgcctgggcgctcgggagggaccgcacgacgtgggagaagc

SEQ ID NO: 67869 - DNA, 280 bp, Zea mays
  Clone ID: LIB3076-009-Q1-K1-A9
cccacgcgtctgcccacgtgtgctttcactttttcgaccacgcgtccgctagcacataagtgggaccattaaacgccttgtgtcacggacatacaatagaccacactccacgtctgagtacgaattgataatgttatgtgttgatcaactacatgacattggctgacacccacactgaatagacgagattatcggtattgtttggctacgtaatcttatatttcgttagctgaatgattccttattggaatacttcctatgtttactgtatagataatca

SEQ ID NO: 67870 - DNA, 237 bp, Zea mays
  Clone ID: LIB3076-009-Q1-K1-B10
cccacgcgtccgagcatgtgttacaaactcgatcatcggcaccggtgaatgaattgcaacgtgtgcaaattgagtgcttgcctgagggatctgtaagcacagctggaactgcaacggagaacattcagcaagccccgcagagttcaaaagatatccaaagcaagtcccagggtgcttcaacaaggagctgtacaaaggttcataagcaaggagtcgcacttggcaggtcggtggacc

SEQ ID NO: 67871 - DNA, 247 bp, Zea mays
  Clone ID: LIB3076-009-Q1-K1-B11
tccacgcgtacgagcatgtgttactaactctttcatcggcaccggtgaatgaagtgcaaccgtgaccatattgagggcttgcggtgatggatctgtatgcacagctggaactgcaacggagaacattcagcaagccccgcatagttcaaaagatatccaaagcaagtcccagggtgcttcaacaaggagctgtacaaaggttcataagcaaggagtcgcacttggcatgtcgttggacctctttaaa

SEQ ID NO: 67872 - DNA, 335 bp, Zea mays
  Clone ID: LIB3076-009-Q1-K1-B5
ttatttcttttgctttacatttctgtttatagctgtacaacattctatcggattggggtcctgtgaaatggggatttgacaaatggacaaattaagtgtgaaaaattccaatatttaagcaaaatccacagttgcactcatgcaggacactttgaaacgcaataaacggttctgtacttctttaacttcccatatgttacaatttcaatttgattctctctgaccacttgaatatatctgaataaacctgatctccaccaatttccttacctgttgccccatcacctattctgactgacttctcaattagagcaaaattccccattatatcaaca

SEQ ID NO: 67873 - DNA, 123 bp, Zea mays
  Clone ID: LIB3076-009-Q1-K1-B7
cggacgcgtggggaaaatgtttgcttacagcatttattgaggatggaaacacacaacgtcaaacaaatagtgatcctattatgagtacttggatatatgaaatggcagcgacgagtcaagatg

SEQ ID NO: 67874 - DNA, 429 bp, Zea mays
  Clone ID: LIB3076-009-Q1-K1-B9
tcgtccacgcgtccgagcatgtgttacaaactcgaccatcggcaccggtgaatgaattgcaacctgtgcaaattgagtgcttgcctgagggatctgtaagcacagctggaactgcaacggagaacattcagcaagccccgcagagttcaaaagatatccaaagcaagtcccagggtgcttcaacaaggagctgtacaaaggttcataagcaaggagtcgcacttggcaggtcggtggacctctctaaattcaccgactacggcgaactccaagcagagctggacaagatgtttgacttcgagggtgaattggtatctggcagccaaaactggcagatcgtctataccgacgacgagggcgatatgatgcttgtgggagacgacccgtgggaagagttctgcaacatagtgcgcaagatctacatctaca

SEQ ID NO: 67875 - DNA, 248 bp, Zea mays
  Clone ID: LIB3076-009-Q1-K1-C1
tcacactagctctagcatcttgagctaaatgttttcttttagcatttattttctttttaaacggtcatggcacactgttattgggacagggtaattacttaaatatatcaaatggattccacaaatcaatacgaatataacaaataggtagaacattccctatagatcaacaaagcttacgtacatttcccttccatgacatagcttttctatattattacttaaacataatttactattactaacat

SEQ ID NO: 67876 - DNA, 406 bp, Zea mays
  Clone ID: LIB3076-009-Q1-K1-C9
cccacgcgtgcgcccacgcgtccgtatggttttgctgctctccgaccccgagctgcgaagggggcagcatcaagcggggcccgcctcgcgtgtgaccgatatggcgctgccgaatcaggggaccgttgattaccccagcttcaagctcgtcatcgtcggcgatggtggaactggtaaaactacatttgtgaagaggcatctgactggagagttagagaagaaatatgaaccaaccattggtgtggaagttcatccgttggatttcaccactaactgtggtaagatcaggttctactgctgggataccgcagggcaagagaatgtttggtggcctcatggatggatactatatccatggccaggttgcgatcataatgtttgatgtaacctcaaaggttacttacca

SEQ ID NO: 67877 - DNA, 148 bp, Zea mays
  Clone ID: LIB3076-009-Q1-K1-D10
caatttggagttataaatataaagttatcactttttgaaaggtaaagtaaagttctacatgggccccaaactgatttccctgagttcctcacgaaaaaaaaaaaaaaaaagggcagccgccctttttatatttacttatttattattt

SEQ ID NO: 67878 - DNA, 344 bp, Zea mays
  Clone ID: LIB3076-009-Q1-K1-D2
accacgcgtccgctcctctagctgcatccttgtactagagcatggcgaagctcgcatctattgctcgcagtatgcttagattcccaaacggaagcatgaggcttgttatggtaacggttattggagcagtccttggctttttcattgggatttcattcccttcggtcagcataacaaagcttcactttccagatagctttatttcgtacattgaagacaaagacgctggactcacgacccaagctatactcaatcatgcttggacttctgccagaaacgcaaggggaaatggtaccgaaccgacttcaaacagtaccttaaagatttatgtcccaacgaacccc

SEQ ID NO: 67879 - DNA, 361 bp, Zea mays
  unsure at all n locations
  Clone ID: LIB3076-009-Q1-K1-A3
gttccggtcaggcgagttagtcgtcgtgccgccggtgccctgtatccatggcggcggcgttgcgtgccgtcttgagaggcatcaaggagaaggggctcaccaacttcatccgcgacgtccgcgacgaaggatacttcaaatgccttctggacgggaaccttttgcaaacgaaaattcacaatattggagcaacacttgtaggagttgacaagtttggaaacaaatactatgagaaactacatgacactcagtacggaaggcataggtgggtagaatatgcagagaaaggtcgctacaatgcatnccaagtgcctnctgaatggcatggatggctgcaccacatcacagatagcactgggga

SEQ ID NO: 67880 - DNA, 415 bp, Zea mays
  Clone ID: LIB3076-009-Q1-K1-D3
gcactatgttatattgtctaaaaatgtccttgctgcttctgatgtcatcaactcaactgttagtagctctgaggatactgaaaatatagtctttcatgtactaactgatgctcaaaatttttatgccatgaagcactggtttgcaagaaactcctacagggaatcagctgtgaatgtcataaattatgaacaaattattttcgagaatttccctgagtttggaacccagcagttatatttgcctgaggaatttcgaggtttcatcagtagccttgagcggcctactgagaagagtagaatggagtatttatcagtgttcagtcactcacatttctttcttgcagaaatattcaaaggtttaaagaacgtaattgggttggatgatgatttggtcgctcaacatgatctctctttc

SEQ ID NO: 67881 - DNA, 304 bp, Zea mays
  Clone ID: LIB3076-009-Q1-K1-D4
gcactacgttatatcgtctagcaacgttcttgctgtagatgatggcatcaattgaactgatagctgctctgatgattctgttaatatactgtatcatgaactaactgatgctaacagttattatgccatgaatcactggtttgaaagagactccaacaggtaatcagatcgtaatgtcattaatcttgaccaaattatttacgacaatcatcctaaacttagaccctagactctctatccgcctgatgcataaccatgcttgatcatcagccttgaacggactactgagaagagccgaatggac

SEQ ID NO: 67882 - DNA, 428 bp, Zea mays
  Clone ID: LIB3076-009-Q1-K1-D5
acttcctcgcaaaaccctaacccctcgatctcccaagatggcgtcgcagccgccggcgccctgccgcagccgcggcatctggagctccgccgccggcacaagtggtgggcaacgccttcgtgcatcagtactacaacatcttgcaccagtcgccggagctcgtctaccgcttctaccaggaggccagctgcctcgggcgccccgccggcaccggtgccgacggcatggacacggtcaccaccatggacgcgattaacgacaagatcgtgtccatgggtatcgaccgggcggagatcaaggcggtggacgcgcaggaatcgctctgtggcggcgtcagcgtgctcgtcatgggtcatcttacggggaggaacagcgtcagccgccagttcgtgcagtccttcttcctcgcgccgcaggagaagggctac

SEQ ID NO: 67883 - DNA, 342 bp, Zea mays
  Clone ID: LIB3076-009-Q1-K1-D6
ccggtccgaatccgggtcgcccacgcgtccgacttcctcgcaaaaccctactccctttatctcccaagatggcgtctcagccggcgcggtctgccgcagccgcggcatcgggagctccgccgccggcacaagtggtgggcaacgccttcgtgcatcagtactacaacatcttgcaccagtcgccggagctcgtataccgcttctaccaggatgccagctgcctctggcgccccgccggcaccggtgccgacggcatggacacggtcaccaccatggacgcgattaacgacaagatcgtgtccatgggtatcgaccgggcggagatcaaggctgtggacgctc

SEQ ID NO: 67884 - DNA, 388 bp, Zea mays
  Clone ID: LIB3076-008-Q1-K1-G6
cccacgcgtccgcggacgcgtgggtttagagctcatggtgcagagatatttcgctattagtagatatgataaaccagcaccaaacagtgcatctatcctatgcgcttaacctactggtcgtgaagccccagacctatatcatcaaacgtggcaaaacatcacaatttatcaaattacagtttagcactttccctaaaaaacaaattgtgttgcaactgttttggattctggtgcaaaacactcaatcatttgtcacatcatcatcacatcaaatttgggtcgaaaagactcctggctgcggtggaagactggttaggtttggcttgcgacttcattccctcctcaacagcatcccttccctgtagcaagctatcactgaacattgaga

SEQ ID NO: 67885 - DNA, 398 bp, Zea mays
  unsure at all n locations
  Clone ID: LIB3076-008-Q1-K1-G7
agcagctcggttgctgggacacgcgatcgagctacagcaaagaagactgcagggtggcgcggcgggcatggaggatctgtacagcatccacccggggatctcgcgccacggggcggcggcgactagcgaggcgtccggggtcgccggtggaccgggctcacccccgcccccgcccccgccggcggcggatctgacggagctggtcaaggcgcagatcgccgggcacccacgctacccgtccctcctctccgcctacatcgactgccgcaaggtgggcgcgccgtcggaggtggccacgctgctggaggagatcggccgggagaggtgcgccgncgncttcgncggcggggaggtcgtcggcatggaccccgagctcgacgagttcatggagacgtact

SEQ ID NO: 67886 - DNA, 241 bp, Zea mays
  Clone ID: LIB3076-008-Q1-K1-G9
caggcattgaatccgtgtactggtggaagggaaaggtccaatctgatgctgaagaattactcatcatcaaaaccagggaatcacttctggatgccttgactgcacatgtcaaagccaatcatgaatatgatgttcctgaagttattgctctgcccataactggtggtaacaccaagtatttggaatggatcaagaacagcaccccggacaagtgatctcttttttttttggagctcgacat

SEQ ID NO: 67887 - DNA, 406 bp, Zea mays
  unsure at all n locations
  Clone ID: LIB3076-008-Q1-K1-H1
cggacgcgtgggctgacatcaaagagtgatgtctacagcttcggggtggtgcttcttgagatgatgtcagggcgcaggtcgatggacaagaaccgcccgaacggggagcacaacctggtggaatgggcgcgccccctcctaggcgagaggcagcggttctacaagctaatcgaccctcgcctggagggcaacttctcggtgaagggcgcgcagaaggcggcgcagctagcgcgcgtgtgcctgagccgggaccccaaggcgcggcccctgatgagccaggtggtggaggtcctgaagccgctgcagaacctcaaggacatggcgagcgcctnctacttcttccagacgatgcaagccgagcggatggcgcactcgagcagcatgaacgggaagagcagcattaacg

SEQ ID NO: 67888 - DNA, 316 bp, Zea mays
  Clone ID: LIB3076-008-Q1-K1-H10
atttattatatggatgtgtgcacaggtgcacgtagataggtacaatagaagggagattatagctagctggaggcagcgagcggctcgggtgctgggacacgcgatcgagctacagcaaagaagactgcaaggtggcgcagcaggcatggaggatctgtacagcatccacccggggatctcgcgccacggggcggcggcgactagcgaggcgtccagggtcgccggtggaccaggctcaccctcagcccctgccccgcctgcagcggatctgacggagcttgtcaaggcgcagatcgccgggcacccacgctacccg

SEQ ID NO: 67889 - DNA, 388 bp, Zea mays
  unsure at all n locations
  Clone ID: LIB3076-008-Q1-K1-H11
gaacgactgaacgagccgccactcgcccgtccgactccggttccggccagctgcctccgtccctccgtcgagctgcccgtccaccttcgtgccttcggcccagcgagcagattccgccccacccgcccgagccgagcaacagccagcagagccgcatcgccgccggggaaccctgagttgccggtccgnncgcctgagaagatttccgtcccagcagcatagccgcagctccgncggccgtcgcctcaaggcaagtcccgagcgccctgtcacaggccccaggtagagtttcgtatcctctgcaaaatccaaatctaatccgattttggtaagatttaatctaatccaatggattttcgatgacccttaactaaggttttttttcata

SEQ ID NO: 67890 - DNA, 389 bp, Zea mays
  Clone ID: LIB3076-008-Q1-K1-H12
gacacacttacggagacgcgtctggatgatgctagtcttattctgtgggatgctctaactggctctgtcccagctgttaaggatgttaaagcttacagtggagatgttcattgtgtcgattggaatccccttgatgttaactatatcttaactagttctgtcgataactctgaccgtatgtgggatcgtcgcaatcttggttcgagaggagctggttctccaattcacaaatttcagggccataaagctgctgctctttgtgttcagtggtcacctgacagaacatctgattttggaagctctgcagaagacggatttttaaatgttttggaccatgataaggttgtgaagaagaaaaattctaatgttccatctgggcttttttttta

SEQ ID NO: 67891 - DNA, 378 bp, Zea mays
  Clone ID: LIB3076-008-Q1-K1-H2
atttgggtgtgttctgctataatttacggtaagaattgaagacaatgatgtcggcatccctccagacactggcatgcttctcaattctgtctgcccttatgatccgatctgtggagggaagcataccaatgccttgaaggagatgagtgagccattgaaggtgcgtatcttgagcctgtcgtcaggtattgaggcctccaccatgcacacgagagagacccattggttcctgttgactgagtcgcccacaaacaccattctcttgtttctcagattttcaagcagcttgatggcatcaaatctgttttggaaaaaaggaaccatattaaaaaggggaatttgtcatgatgaatttggcctttctgttcatgtacttag

SEQ ID NO: 67892 - DNA, 405 bp, Zea mays
  unsure at all n locations
  Clone ID: LIB3076-008-Q1-K1-H4
cttcggcccttcctctctcccatctcggctagggttaggtcgtctcgccaagtcgccatgatgcagcagcccccgccgcagcagccgcagccgggcatggcgccgnctccgcctccgcaggctgctggcgggcagccaccgcagtggggtgggatcccgccgccgatggcgcagcagtacggcgcaccgtctncgcagcagcctccggcgatgtggggccagcctccgccgcaggcgcactacgggcaggcaccaacccctcagcagtactacgccgcgccgncggtgccggtgcaggcgccagccggccccgctgcggcggacgaggtcaggacgctctggatcgggacctgcaatactggatggacgagaactacgtcttcgggtgctttcgaacactgggga

SEQ ID NO: 67893 - DNA, 402 bp, Zea mays
  Clone ID: LIB3076-008-Q1-K1-H5
cttcggcccttcctctctcccatctcgtctagggttaggtcgtctcgccaagtcgccatgatgcagcagcccccgccgcagcagccgcagccgggcatggcgccgcctccgcctccgcaggctgctggcgggcagccaccgcagtggggtgggatcccgccgccgatggcgcagcagtacggcgcaccgcctccgcagcagccttcggcgatgtggggccagcctccgccgcaggcgcactacgggcaggcaccaacccctcagcagtactacgccgcgccgccggtgccggtgcaagcgccagcctgccccgctgcggcggacgaggtcaggacgctctggatcggggacctgcaatactggatggacgagaactacgtttttcggtgcttttcgaacact

SEQ ID NO: 67894 - DNA, 384 bp, Zea mays
  Clone ID: LIB3076-008-Q1-K1-H6
ctggcattccaaagactattgacaatgacatccctgtaattgacaagtcatttggtttcgacacagcagtcgaggaggctcaacgtgcaataaatgctgctcatgtggaagctgtaagtgctgagaatggtataggtcttgtcaagctaatgggtcggcacagtggttttattgcacattatgctactctggctagcagggacgtggattgttgcttgatcccagaatcaccattctatttggaaggcgaaggcggactttttagatacatagaaaaacgtttgaaggacaatggtcatatggttatcgttgttgctgagggtgctggacagaaacttattgctgaaaccatgcagtcaattgggaaagatgcttcaggcaacg

SEQ ID NO: 67895 - DNA, 352 bp, Zea mays
  Clone ID: LIB3076-008-Q1-K1-H7
cggacgcgtgggtgccaatgcggtcactggtatagatactgatctcaaaatgtttgagacgtttgcagagggcatgtctagcctgtttgtggactcaggtcaagaatctgcaaaaaatgaaatgaaggctgcactagtggaagcaaggcagctagtgaatcttcttatgagcaatagtccagagaatttcctaaatccagtgatccgtgagaagagctataacaagctagattatagaaaggttgcaatcatctcagagaagtttagagatacctcagagagttatttctcaacatttgggacaaggggtgccaggcagaacccaaagaagaaatctctggataccctgatc

SEQ ID NO: 67896 - DNA, 402 bp, Zea mays
  Clone ID: LIB3076-008-Q1-K1-H8
gaaaactagaaaaggctcctcccgaccgcaacgcccctcatctccctcgaccccgacatccccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccggcgaggccgtcaagctggcgcggtacaacaaggagccc

SEQ ID NO: 67897 - DNA, 222 bp, Zea mays
  unsure at all n locations
  Clone ID: LIB3076-008-Q1-K1-H9
atcgcaattcgcaattcccagccccattccccgtcgcccggtcggaagcaccaccagctaccagggatgtctggcgaggaggaggagaacgccgcggagctcaagatcggcgaaaagttcctcaaggccaagtgcctgatgaactgcgaggtggcgatcatcctggagcacaagtacgagcagatccagcagcacgcgtcgtcngagtccgacccgtcgtcg

SEQ ID NO: 67898 - DNA, 343 bp, Zea mays
  Clone ID: LIB3076-009-Q1-K1-A1
cggacgcgtggggcatgcagcagttggtactgggtcatcttttcaaattctctggaatgaaaatcagctgaaaagcaacaaggagtatggggatgggttgtacgatttcttagcgttggtcaggaccgaccaagaaaagacagactacatgttcttggacgatgttgactatcttgtagaggagaatgcagcagatgacacgtgcttatctcccgagccagatgggacccttggtaagcctacctttgaggataattttgaagagcaaaatattcagaaaggcagctcatgggaaattggcataacaacgaactcaaagttggaacagaatgctagtgctgtg

SEQ ID NO: 67899 - DNA, 377 bp, Zea mays
  Clone ID: LIB3076-009-Q1-K1-A10
cgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcg

SEQ ID NO: 67900 - DNA, 373 bp, Zea mays
  Clone ID: LIB3076-009-Q1-K1-A2
cggacgcgtggggcatgcagcagttgtgtactgggtcatcttttcaaattctctggagtgaaaatcagctgaaaagcaacaaggagtatggggatgggttgtacgatttcttagcgttggtcaggaccgaccaagaaaagacagactacatgttcttggacgatgttgactatcttgtagaggagaatgcagcagatgacacgtgcttatctcccgagccagatgggacccttggtaagcctacctttgaggataattttgaagagcaaaatattcagaaaggcagctcatgggaaattggcataacaacgaactcaagttgggaacagaatgctagtgctgtgaatgattctggtgactggggaggctggag

SEQ ID NO: 67901 - DNA, 264 bp, Zea mays
  unsure at all n locations
  Clone ID: LIB3076-008-Q1-K1-G4
cttcggcccttagtctctgccatctcgtttagggttaggttgtctcgccaagtcgccgtgatgcancagcggcatggcgtagcagcctgagtcgggcatggcgccggctccggctccgcaggctgctggcgggcagacaccgcagtggggtgggatccctgcgtcgatggcgcagcagtacggcgcaccgacttcgcagcagcctccggcgatgtggggccagcctccagcgcatgcgcacttacgagcaggcaccaacccctc

SEQ ID NO: 67902 - DNA, 344 bp, Zea mays
  Clone ID: LIB3076-008-Q1-K1-D6
atcgcaatatggacagattagctatatttgttatcagctgctgcctttggggggttctctcggatgatggcgatactgcggacttcaagtttaagagacgaagcttctacagtcatggttgccgctcatattctggcatttgtgacaacctacattctgtacctcaacttctatgagcttgacaaaggcctaaacatgatggattgtactgcgataagcattgctcagtgtctcctgtggtcactgtgggctgccatgagtgggcatcgttcgcggctcaagatcatatctgtcgacgtcagatgtgctgttgcagtacttgtggatacctacgacattccacc

SEQ ID NO: 67903 - DNA, 259 bp, Zea mays
  Clone ID: LIB3076-008-Q1-K1-D8
ccaactctggagatttaaagctgattttgaagacgctgctttaggggataagtgggtaataattgatgtcaggaacttgcggccatgacggaaggatacagcggcagtgatctcaagaatctctgtgtgactgctgctaacctccctgttagggagctcctgatgatagaaagagagagggaactgggaacagctctagcttgaggctttaaccgaatatccctgtactgatcctgcattacacgtctaatgaacttga

SEQ ID NO: 67904 - DNA, 70 bp, Zea mays
  Clone ID: LIB3076-008-Q1-K1-E1
cccacgcgttcggatagatcgtctattgctatcctgtcatttacaaactgttactcatctgaccatctat

SEQ ID NO: 67905 - DNA, 191 bp, Zea mays
  Clone ID: LIB3076-008-Q1-K1-E12
cgcttaggcggacccctgtacggacgcttgactcctgcttcacggttcaggatcaccgttgacagctggagccatggagttcatcgacggcgcttcgaccttgtcccatgatgacgacgactacagttgtcggacgccgactgacgctgtgagccaggtgaggcctacgtagacctgtccgtctgatccgt

SEQ ID NO: 67906 - DNA, 352 bp, Zea mays
  Clone ID: LIB3076-008-Q1-K1-E2
gaaaggtcattatatgcaaatctgtcatcggcaaactgtcacaaatctgagcatctaaagagaccagagaactgggcactagttgaaaaggcaaaatacatctacattgctggatttttccttacagtgtcgcctgtttctatccagctagtcgctgagcatgctgtagcaaataacaaggtgttcctgatgaacctctctgctcccttcatttgcgagttcttccgtgatgcccaagagaatgttctaccgtatgctgactacatcttcggcaacgaaactgatgcaaagatctttggcaaagtcagatgatgggagactgataatattgaggagattgctttgaagatct

SEQ ID NO: 67907 - DNA, 392 bp, Zea mays
  Clone ID: LIB3076-008-Q1-K1-E4
tgcaaacacgtccaatctggtaccgaggttacaggcgttgcagttatagccccttgatctcatctccttgtccctggtagggttggttcagttctatcacaagcttcgctctgtttttttttttatattcaccttcattgagaagattgtagagtaccataggctgagggaatagctcgcttgttgaatcccagtgttttagtccggtttagccttagccatgaatgtaaaaatgttgtaaaattgtcagcctgccttacaactccttccatcaaggcaaaacgagtgcaatttcttcacgacaggagctccacggctggaaacctcagacccgtgcctcgcttccttaactgcaaagagaagctccttgccttgggatggcgatctggcac

SEQ ID NO: 67908 - DNA, 421 bp, Zea mays
  Clone ID: LIB3076-008-Q1-K1-E5
ggcatttagccccacaaccatcaacagtggtcgtggtgctgaatttgaaggggctgtcattgcactgtttcatctgttgattacgagaaccgataaagtccgtgctcttcgtgaggctttctaccgccagaaccttccaaatgtgaccaatttgcttgccacagtcttggtcttcctcatagttatctatttccaaggcttccgtgttgtgcttccagtgagatcaaagaatgctcgtggccagcaaggctcatatccaattaagctattctacacttcaaacatgcccatcattctgcactctgcactgattaccaacctctatttcatatcccagcttctctacaggaagtacagtggaaacttccttgttaaccttcttgggatgtggaaggagtctgaatactctggccattctggt

SEQ ID NO: 67909 - DNA, 352 bp, Zea mays
  Clone ID: LIB3076-008-Q1-K1-E6
tcgatcgtgcatttagcccctcaaccatcaacagttgtcgtggcgctgaatttgaagggactgtcgttgcactgtttcatctgatgattacgagaaccgattaagtccgtgctcttcgagaggctttctatcgccagaacctttcaaatgtgaccaatttgcttgccacagtcttggtcttcctcatagttatctattgccaaggcttccgagttgtgcttccattgagatcaaagaatgctcttggccagcaaggctcatatccaattaagctattctacacttcatacatgcccatcatgtttcactctgcactgactaccaacctttatttcatatcccatcttctctt

SEQ ID NO: 67910 - DNA, 258 bp, Zea mays
  Clone ID: LIB3076-008-Q1-K1-E8
ccacgcgttcgtgcatacacgtataatctgataccgagtttacaggcgttgctgttatagccccttgagtggatctcctagagcctggtagggatggttcaagtttatcacgagcttggctctagttttttttttatattcaccttattagagaagattgtgatgtactatatgctgagggaatagctcgctagttgaatcccattgttatatatcctgttttagcacttaagccatgaattgtaaaaatggttgtaa

SEQ ID NO: 67911 - DNA, 197 bp, Zea mays
  Clone ID: LIB3076-008-Q1-K1-E9
gtcctaaatcgcgaggccgccctttttttttttttttttggtgtaactggatgataccgtacactctggaaaacttgatacatcagaaaggtaaaacaatgtatttgttgagctacaaataacagagcactcatgtgacacggacaaatataagatatacacattggattatggatggagcgcgggaagacaagaat

SEQ ID NO: 67912 - DNA, 375 bp, Zea mays
  Clone ID: LIB3076-008-Q1-K1-F1
gcttgaacgacaaaggctatccgatagttcagtccctgtcaaccttgggtctctctctggtgaagtggcgtcggggccttgctctgggcgcagacttgcagtcccagttttccatcggaagggggtcgaagatggcagttcgacttggtctgaacaacaagctgagtgggcagatcaccgttaggacaagcacctcagagcatgtccagattgcacttctgggtctcgtaccggctgcagaacttctttaccggagcttactgcccagtgaaccatgctttgcttattaacttgtcaggagtcttagcttaattattgcatgatcacatcgatgctattagcaattttgcttttcatattagtgatggttcctgc

SEQ ID NO: 67913 - DNA, 205 bp, Zea mays
  Clone ID: LIB3076-008-Q1-K1-F12
ctcaaactaccagtgccgcgcctactctgttctcctctggctaatgctaatggcttgggggggacatgagagctggcctaggagctgtgtcaatcgtggttacgcggccagcattactgcactgatatctgctctgctgtcacgtgcgcatctatactcataatggacgctgaactctgaatatgacgtccgatatcctagaaat

SEQ ID NO: 67914 - DNA, 377 bp, Zea mays
  Clone ID: LIB3076-008-Q1-K1-F3
gaaaggtcatagattgcaaatctgtcagttgcaaactgttacaaatctgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaagggtcttccgtatgctgactacatcttcggcaacgaaactgaggcaaagatctttgccaaagtcataggatgggagactgagaatattgaggagattgctttgaagatctctcaactttatttggctttaagcaa

SEQ ID NO: 67915 - DNA, 351 bp, Zea mays
  Clone ID: LIB3076-008-Q1-K1-F6
tcgcccacgcgtccgcgtacgcgtgggtttagagctcatggtgcagaggtattttactattagtagatatgataaaccagcgccaaacagtgcatctatcctatgcgcttaacctactggtcgcgaagccccagacctatatcatcaaacgtggcaaaacatcacaatttatcaaattacagtatagcactttccctaaaaaacaaattgtgttgcaactgttttggattctggtgcataacactcaatcatttgtcacatcatcatcacatcaaatttgggtcgaaaagactcctggctgcagtggaagactggttaggtttggctcgcgacttcattcccttctcaaca

SEQ ID NO: 67916 - DNA, 400 bp, Zea mays
  Clone ID: LIB3076-008-Q1-K1-F7
ggacgggagagcgacctcagcagacaagagccagacgagactcagagagcgagcaccgtgacctctctgtttctctctcttcccttctcgtcttctgcaagaagccacaacaaatgtgaccgtctctgtttctctcatccccttcatcactctgctggtctccctcttccacctctggtcttggccatggcctccagcgcctcccggttcatcaagtgcgtcacagtgggggacggcgccgtgggaaagacctgcatgctcatctgctacaccagcaacaagttccccactgattacatacccactgtcttcgataacttcagtgcaaacgtggtagtcgacggtaccactgtgaatttgggcctttgggatactgcagggcaagaagattacaacagac

SEQ ID NO: 67917 - DNA, 450 bp, Zea mays
  Clone ID: LIB3076-008-Q1-K1-G1
gcttgaaggacaaagactatccgatagcccagtccctctcaaccttgggtctctctctgatgaagtggcgtcgggaccttgctctgggcgcaaacttgcagtcccagttttccatcggaagggggtcgaagatggcagttcgacttggtctgaacaacaagctgagtgggcagatcaccgtcaggacaagcacctcagagcaggtccagattgcacttctgggtctcgtaccggttgcagcctccatttaccggagtttccggcccagtgaaccatcctttgcttattagcttgtcaggagtctcagtttaattatttcatgatcacatcgtttctcttagcaattttgcttttcatatcaaccatgtttcctgctgtttcagttcactcctttgtaattggcagatcggttcctatcataattttgggtgaaaaagggtgccagaatta

SEQ ID NO: 67918 - DNA, 236 bp, Zea mays
  Clone ID: LIB3076-008-Q1-K1-G10
ctttttcaagcattgaatccgtgtactggtttttagggttttgtacaatctgatgctgaaggattactgggcatcaataccagggaatcagttctggatgccttgactgcacatgtcaaagcctatcatgaatattatgttcctgaagttattgctctgcccataactggtggtaacaccaattatttggaatggatcaagaacatcaccctgaacaagagatctatttttttttt

SEQ ID NO: 67919 - DNA, 413 bp, Zea mays
  Clone ID: LIB3076-008-Q1-K1-D5
caatttggacagaaaagctatatttttcatcagctgctgcctttctggggtactctctcattttggcgatactgcggacttcaagtttaagagacgaagcttctagagtcatggttgccgctcctattctggcatttgtgacaacccacattctgtacctcaacttctatgagcttgacaaaggcctaaacatgaaggtttgtactgtgataagcattgctcagtgtctcctgtgggcactgtgggctgtcatgagtgggcatcgttcgcggctcaagatcatatctgtcgccgtcggaggtgcggttgcagtacttgtggaagcctacgacattccaccgcgatggggatacgcaaatggccgtgctatctgcctcgcttgggctatccccctgtcgtacctttggtggaac

SEQ ID NO: 67920 - DNA, 340 bp, Zea mays
  unsure at all n locations
  Clone ID: LIB3076-008-Q1-K1-G11
cccacgcgtccgcccacgcgtccgaagtgtagtgctaggcgatgaagcaacatctctccacatgattcagctcgtggctgaaggttagataattagagatgacattgtgttgacttctccattcaaatcatgactaatgtaccaccctnctctcatcacangatggccaagctcctagctaattgaaatagataacagaaacaagaaaggagctcagttcgttatagaggcactggagatgaggtttgtaactatcattttccaattcaactgtgctgtactaagaaaggtccgtccttgatgtttcaacccactgattttaagacatctttaacctctt

SEQ ID NO: 67921 - DNA, 367 bp, Zea mays
  Clone ID: LIB3076-008-Q1-K1-G12
gctgatcgaccgagatcggacaggcacgccaggcagctcatcaatgggacgagcaggaggaggaagcaagaagaatcctgggagctcgcgatgccgaggtggggggacgcggaggaaggagctgctgctgacgaggctgtcgcggcggcagcggcagtgaggctggccaacaagatccggaagcgccgcgcggtgtcgtcgtcggggggttcggacccggcggccgggaggcggctacggtccaggaggcccgcggtgctgctgccgcggcgccggaccagcgcgggcggggacatgtcggaatcgtcccgtggccggcattgccgcggaggcggtacccgcctcgccgacgggacatggccgtccg

SEQ ID NO: 67922 - DNA, 195 bp, Zea mays
  Clone ID: LIB3076-008-Q1-K1-G2
gcttgaatgacatctgctatactatagcgcaagaattgtcaaccttgaggctctcttttgtgaagacactggcgtgctttgcaatgctcgctgactttatgatccagtcttccatgggaaggataccaatgacttgaatgagactagtgatgcacagcaggttcagatctcgaatcagcggcaagacatggacgt

SEQ ID NO: 67923 - DNA, 358 bp, Zea mays
  Clone ID: LIB3076-008-Q1-K1-B11
cggacgcgtgggtcctaatggtgatgttgtcaactgtgaattcttagtgttgaagtttcattacataaaaataagttccctagctactggttctggtttattcaggttttattacttcattagggagctgatttttttttttgaatcgaatagccctgctattcaggagaatagggttgctaccgtgcagtgcctatcgggtactggttctttaagagtcggaggtgaatttcttgcaaggcactatcacgagcgcactatctacattccacaaccaacctggggaaatcacccaaaagtcttcaccctatctggcttgaacgttaggagctaccgctattatgatcctgcaacatgc

SEQ ID NO: 67924 - DNA, 248 bp, Zea mays
  Clone ID: LIB3076-008-Q1-K1-B12
gcgggccaacatctcgcggtggctcgccttgggcaaccggacctgcccgaccacgattcaggagctctaggacgacgccctgaccccaacgccactctacggccactcaatgccggctgggtcttcccgcctggttttgcattttggtttcttaatctgcaatcatggtttttcataatactgcaaggtgggcctgataaataattaaaaggtagttaatcttagatattgtttgaacgtatgggatg

SEQ ID NO: 67925 - DNA, 351 bp, Zea mays
  Clone ID: LIB3076-008-Q1-K1-B2
gggagcaacaacagtgcggaattgttggagagtatggaaaaggaggatgtccttgctgaaaatgttcgatttggcgggaatggagttgcgcaaggtggccttccagaagagttagagccaaacaatacgattgaagcggtttcttgagctgatgcatggttagtggcatcaaccacacaagattggggaaaaatggtgtagagatggataagttctacccccttgctggagggaatggtaagtagctcaactcacaagtttccttctgtgacacagattctcaattacaggggtttctatgatgatggatgatgggagattatctgatatcatgtcttgcacaacggcatg

SEQ ID NO: 67926 - DNA, 350 bp, Zea mays
  Clone ID: LIB3076-008-Q1-K1-B3
agcaagctctctccccattggccatatctagctcgtagtctacactgcctctaaaccttgacatttcctttgtattcccctttccaatttgcagtagtttgtaggtagaccgcaaggtggttttttcttgcagcaatggcggccaaggtttgacaaggcatgacgtcctgattaagccccctcgcggcagccacaagatttcttgcagcgtgggacaggagctgcggctgcggaggaagtgagcaaaagcatggatctttccggcacgcagggcgagctgccgatggcaacaatgcacgccggcgggtcgccgtacctggggctgcaccacgggcacccacagcagcaca

SEQ ID NO: 67927 - DNA, 66 bp, Zea mays
  Clone ID: LIB3076-008-Q1-K1-B4
acccacgcgttcgagctagctctagcctcataggccatattttgctcgtaggcttcactgcctcta

SEQ ID NO: 67928 - DNA, 346 bp, Zea mays
  Clone ID: LIB3076-008-Q1-K1-B5
gtcagactgccgtttgctacatcatcttttgcgaaaagcaacactgatcattcatactaggtcaacggaaaacagttgatgcatggaatcactgactgacagccagacctatcatggggagcacatggtggctgttgataatgatctgccaaattctgactcatcgccattggctctgactgcttagctggagcagttcaacaatggcaaagcatgttcaagaaatattgtgaacaacactgatcagattgacataatggatgatttacttgcgatggcaatgttagctgcattggctgaatcagacggcacaagctataactttgaaatggaaacagattctgac

SEQ ID NO: 67929 - DNA, 395 bp, Zea mays
  Clone ID: LIB3076-008-Q1-K1-B6
cgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccaattctttctt

SEQ ID NO: 67930 - DNA, 435 bp, Zea mays
  Clone ID: LIB3076-008-Q1-K1-B7
cgcgcaaggagttcgccgccctccgccgcgctttcgatgacgtcaaccaccagctccagaccaagttctcccaggaaccccagccgattgattgggagtactacagaaaaggaattggatcaaaagtggtggatatgtacaaagaggcttttgaaagcatcgagatcccgaagtacgtcgacacagttactccccagtacaagccaaagtttgatgctgtgattgctgaattaaaggaggctgagaaagagcatcagaaggagtcagaaaggatagagaaggaacttgctgaaatggaggaaatgaggaaaaagatcagtacaatgacagcagatgattactttgagaagtaccctgaactcaagaagaagtttgatgatgaaatccgtaacgataactggggatattgaagagattggagagaactcttatgat

SEQ ID NO: 67931 - DNA, 338 bp, Zea mays
  unsure at all n locations
  Clone ID: LIB3076-008-Q1-K1-B9
cttggcccccctcttggaagccggaacttcctggcttccttcttggaccacggttgcggccggccaaaaccgctcgccggtgtgctcccttccccccgcgccgctggcgccgccggagcgagggggactgcccaaaccctagtgggagttggagactaggaggaagggcgcgagatccggcggcggccaccccgatgggggacttcaacgtcgcgctggtgatcgtggcggcggtggtcagcgtgctggtgctgctcgtcagcgtctacctgctcgtcaactaccagcaccccgacgacgtcaaccaggcctacttccncaagctcgtcgtcgtgctc

SEQ ID NO: 67932 - DNA, 418 bp, Zea mays
  unsure at all n locations
  Clone ID: LIB3076-008-Q1-K1-C11
cccacgcgtccgcggacgcgtgggcttggataacaaattatgttttatggttcctcagtttagagatgaatctgtgttatttgatgtgctaggtataaccattgaacctcgtttgccttcaagttgaataaaaacagggttgtcggaggtattttgtagttttgtccagaaatgcaatgtgttttcttgcccaaaggctgtatgtttacggcttacctagtggtgcttgtatctagcgaaatgataatatgatatgacagccttcgaatatcttctgtgctaatgatggaattgcaaaggatctaccatttattttcttcctcagatgttgcttatgtcctacaaagcccatgaaaaaccattgagctaatcttggagattntggctcaatggacagatttgagaagtgaatgggtga

SEQ ID NO: 67933 - DNA, 351 bp, Zea mays
  Clone ID: LIB3076-008-Q1-K1-C12
cccacccccgtctcccccctccatgtgggcggcctcgagctctgcttaaatcacagctgtgttcgtttgtggggtgatccgcccccctgtcggattctttcacctccgagctctgggacaggggagatctgtggtgtcgcagcctcgcctttcttgtacgcgcgcgtgtgggcactcagcagcaccttcagaaatggacttttttacagagtatggcgaggggagcaggtacaagatagaagaggtcatagggaaaggcagttacggtgtggtttgctctgccttggacactcatactggtgaaaagggtcgccataagaggataaatgacatctttgaacatgtgtctga

SEQ ID NO: 67934 - DNA, 207 bp, Zea mays
  Clone ID: LIB3076-008-Q1-K1-C2
gtgcaccccaataggctttacattgcacttgcgtaagttttctccttttcaccagcacctaatttaccacaggtggaacaaataggtaatcttcaagatgaaagacaagatcgctacacaatgcacacaatagctcaggctcatgtgtgtgttgcattccacagtctcatgcgcatggttacttacagaagttcatgaaaagacacg

SEQ ID NO: 67935 - DNA, 396 bp, Zea mays
  Clone ID: LIB3076-008-Q1-K1-C3
cggacgcgtgggggttcaacctcgaggactacttccccccgaatatggccatggcggacgtgctcctccggctggtgtccgtcaaggcccggcggctcaaccagaggtggaacgacgtgttcgacgagctcatccaggaacacgtgcagagcaggcccttcggcgagagcgaggagagcgaggcggacttcatacacgttctgctctccatacagcaagagtacggcctcactacggacaatctcaaggccatcttggtggacatgttcgaggcaggtatagagacatcttacctgacgctagagtacggcatggccgagctcatcaacaacaggcacgtcatggagaagctacagacggaggtgaggacgacgatgcgctcgccggacggcaaga

SEQ ID NO: 67936 - DNA, 277 bp, Zea mays
  Clone ID: LIB3076-008-Q1-K1-C4
cggacgcgtgatttttaactctggagatctgagagctgatcttgatgacgctgcttgtggagcagaaagttgatgaatatgttgatttcaaggaacttgcggacatgacggacggatacagcggcagtgatctcatgaatctctgggagactgctgcttaccgccatatcaaggagctcctgaagatagaaagagagagggtactggtaacagctctgtcttgctgctctaaccgaatatccctgtactgatcctgcaatacacgtcgaatgaactt

SEQ ID NO: 67937 - DNA, 178 bp, Zea mays
  Clone ID: LIB3076-008-Q1-K1-C5
gacagattagctatatagattatcagctgctgccttgcgggggtactctggggaaatggcgatactgcagacgtcaagtataagagacgaaacttctagagtcagggttgccgatagaatactggcaagagtgacaacttagattatggacctaaacttcaaggagcttgacaaaggc

SEQ ID NO: 67938 - DNA, 407 bp, Zea mays
  Clone ID: LIB3076-008-Q1-K1-C7
cggacgcgtgggtgcaggtcgcctccatcgccggcctgttccgcccgcgggtcctcgccgactgcggcgggaagggcggcgctgccgccgcgtccggcctcgccgcgctcgccggcgaggacagcctagcggcgaggctgtcgccgccggcgctcgtacccaagagaatttacaaaagcaatggctacctgctagtgacttgcaatggtggcctcaatcaaatgcgagccgggatatgtgatatggtgactatagcgcgccatctaaatctaacgcttgtggtccctgaactggataaaaggtctttttgggctgacccaagtgattttggagatattttcgacgtggaccacttcattaattccctgagagatgagctgatgataggtaaagagcttcctttgaaa

SEQ ID NO: 67939 - DNA, 345 bp, Zea mays
  Clone ID: LIB3076-008-Q1-K1-C8
cccacgcgtccgcggacgcgtggggacaagcaggaacaggaacaagcaatgcttcaggttctgatgcgtgtagagcaagaacagaaagtcacagaggacgcccgtatctttgcagagcaagatgctgctgctcagaaatatgctgcacatatacttcaggagaagtacgagggagctatggcttcacttgctcaaatggagaacagagcagttatggcagaaactatgttagaggcaaccattcagtaccaatctagtcagcagaaagcacagcttccatcgccctctccttctccaaggaccccaactcgagatgcatcaccaggccaagggaaccaagattca

SEQ ID NO: 67940 - DNA, 373 bp, Zea mays
  Clone ID: LIB3076-008-Q1-K1-A6
gccagaatggtgcacgctccattaatgcacaccaacggtaacactgatcaataatgctagggcatcccaatagagctgctggatctaattactgactgacgggctgtcaggtcatcataagcatgtggtcggtgcagatagtgatctgccaaattctgactcgtgcccataggctttgattgctgagcttgagaagataaacaatggcacatgatatacaagaaatattgcgcactaccatgttgatattgtcataagggatgattctgttaacatcggaatgaaagctggagaggctgaatgagacgaacaaagttactactactaattggagactacattgtgacagggctatcgcatgacgcggttcgtg

SEQ ID NO: 67941 - DNA, 330 bp, Zea mays
  Clone ID: LIB3076-008-Q1-K1-D12
cccacgcgtccgcccacgcgtccgctcgaggtctcgagcaatagtaagatctgactgatctcgtgagctgcctctccagtgtgctctgtagcccgcgcagatcagtgatggccttcgcggcgatgacggtagcggcgggtcttgcgaccgggccgggcaaccgtgtgactcggttcgccaagtcgacggcggcgtcggtgacgcccgtgaggccgggcaagacgcacgcgcttgtcgccctggacaacgccatggagcggcacacggtgcacgtggtggtctacctccgcgccgcgccgggcctggacagggagcagctcaaggagtcgc

SEQ ID NO: 67942 - DNA, 401 bp, Zea mays
  Clone ID: LIB3076-008-Q1-K1-D4
cggacgcgtgggttccaactctggagagcagagagctgatcttgaggacgctgctttcaaaggagaaagttgatgaagatattgatttcaaggaacttgcggccatgacggaaggatacagcggcagtgatctcaagaatctctgtgtgactgctgcttaccgccctgttagggagctcctgaagatagaaagagagagggaactggtaacagctctgtcttgttgctctaaccgaatatccctgtactgatcctgcaatacacgtcgaatgaacttgatgggtgtctcaggagcgaagggaaaaggagtcaaaagacaaggcggcggcggcggagaattcagaagccccggagagtgagaagaaggagagctcagaaaccaaagaagcttcgaagagcac

SEQ ID NO: 67943 - DNA, 396 bp, Zea mays
  unsure at all n locations
  Clone ID: LIB3076-007-Q1-K1-G11
cccacgcgtccgcccacgcgtccgggaaaaccatccgccggaggccggagggcagattctccaccaccgcctgcaccccgccctcacgacgcgaatctgcggcgaacccccctctcgtattccttctcgccgccctgccccgagcgcaccgtttagaggccgccaggctccggcacccccgcccgcccgggctcgcctggggtcgggatgccctgctgcccgccgtcgctgctcggagtcggcccacggctgcgctccttcctccgcgactacgacgcgctccagtccctcgccctcgtactcatctacctncagattgggtgtgcactgatcggatcacttggggcattgttcaatggggttcttgggatcaacctggtgattggtctattcgct

SEQ ID NO: 67944 - DNA, 461 bp, Zea mays
  Clone ID: LIB3076-007-Q1-K1-G2
ggaagaagtcagtaaagtaaattctgtcgctccaattcggacgaggagatgccgcggatccctctgatcaggttccccaagcggagtctcaaagccccatctccatccgcgccagcggcgtcgcaacccgcagaccagcacgcgaccctcatgttccggttaggggctaaagcagaggcaccatcttctggagagattaaaaattaccgctttagatctgatgtgccttgcccaccttctcatactgccgtaggaggtccagcttcactccttcctaagcgcaaacccctgactgaagaagagattgaggctattatgctggggggatccatctgatatcacctcatatgaattggaaattctaggaacatcaataagattgtatgcctgagcttattgcctttgacctctgaaagagtgttatcgaagccatgtcgatatgtaaggggttttttttaatt

SEQ ID NO: 67945 - DNA, 273 bp, Zea mays
  unsure at all n locations
  Clone ID: LIB3076-007-Q1-K1-G3
tccgaattccagntttttcttttctttttttttttttttttttttttttttttttttttttttttttttttctttatttttttttacggctggttctttttgttttgggctacgtccttttttcaattcaccttccaatatttccaattctcaccactctaaaccccccttctcgtgcaaatccaaggggtgaacacacaacaggaccgtccaacgtaccctcacaagcacaaggcgcacatcgaccaagccaaacccacaaccaccacaccc

SEQ ID NO: 67946 - DNA, 117 bp, Zea mays
  Clone ID: LIB3076-007-Q1-K1-G5
ttctttttttctttttttatttttttttattttttttttttatatcatactttaattttttattttggtatgtttttatatgaatcagggctggtctataatccacttcaccttccc

SEQ ID NO: 67947 - DNA, 377 bp, Zea mays
  Clone ID: LIB3076-007-Q1-K1-G7
gcggaagcggaagcggaagcggaaggaagtaggcggccaccatggtgaagggacgcacggggcagcgcgtcaggctctacggccggggcaccatcctcggatacaagaggtccaagtcgaaccagtacgagaccacgtcgcttgtgcagatcgagggggtgaacaccaaggaggacgtcgcgtggtacgctggcaagcgcatggcgtacatctacaaggccaagaccaagagcagtgagacccgctacaggtgcatctggggtaaggtcacccgttcgcacggcaacttcggcgttgtccgcgccaaggtcaagtcgaacctaccggctgagtctatggggcgcaaggtcaaaatgttcatgtaccctagcagcatt

SEQ ID NO: 67948 - DNA, 427 bp, Zea mays
  Clone ID: LIB3076-007-Q1-K1-H1
gtcacgcgtccgcagcatgttaaggctcaaagaaatgaagcaagtggctactcaaatgagagcagaggtagagagggcaagaatgatgttgtctatcaatcagcaacaccggtcatggattcgaactcatccaatcacaggaatgtgccaagatctgatgtgaaaaacagcggcgtagtttcacactctagagcctggaagccgaaaaccaattcccatcctcaggacagctcagacggcaagattgctgttgacgggcaagtggattcccatggtggtaggcttgagatgaatacgtccaaagatacaattacccatctagtgaccagtagtgaaccgacgaataggagtgatgacaaagaggtctcacacagcatacatgaaaacctggcacgggaagatggtaaccagaaaggtgagactgaac

SEQ ID NO: 67949 - DNA, 96 bp, Zea mays
  Clone ID: LIB3076-007-Q1-K1-H10
gtcgaactacatgtctgctgggcagatatctgttcctattgtctttaagggtccaaatggtgcttgtgcttgaggttgtgcccaacacttacaatg

SEQ ID NO: 67950 - DNA, 316 bp, Zea mays
  Clone ID: LIB3076-007-Q1-K1-H11
gccaaggccgatgccaagctggcggtgaatagcaaggtggcggagaagcccgccaagggggggaaggggaaggccggcaaggaccccaacaagcctaagagggctcccatcgctttcttcgtgttcatggaggaatttctcaaggagttcaaggagaagaaccctaagaacaagtctgtcgctgctgtgggaaaagctgcttgcgacaggtggaaatccctgatcgagtctgacaaggctccctatgtatccaaagctaacaagctcaagctagagtacaacaagggcatcgcagcctacaacaagggctatagca

SEQ ID NO: 67951 - DNA, 364 bp, Zea mays
  Clone ID: LIB3076-007-Q1-K1-H12
gaatttttagggagcagaccatgaagaatttgtgaaggcagcaaccacagacaacgaggtacagtttgtagaaaccagtgatacaagtgttgccaaagttctatttccaggtattacgtccgaggagaaatttgtgggcctcgttaaaagcgagccagagaagtttgaaaagttcgatgggaaatttgaagaaaaggaaattttgcggtttgtggagctcaacaagtttcctctaattactgtattcactgagctcaattctggtaaagtatattcaagccctattaagctacaggtcttcacctttgcagaggcttatgattttgaagatctggaatctatggttgaagaaatagccagagca

SEQ ID NO: 67952 - DNA, 336 bp, Zea mays
  Clone ID: LIB3076-007-Q1-K1-H2
gactagctctagatcgctagcatccgctttagattatccaagcgttactactctagcaggccaggttttttcaggtcgagagtggggctttctatcaatcatcaacaccggtcatggattctaactcatccaatcacaggaatgtgccaatgatcttatttgaaaaacatctacgaatttttcacactctataaccttgaagccttaaaccaatttccatcctcatgacatctcatacttcaatattgcttttgtctttcatatttattcccatcttttgtatcttttaattaatacctccaaatattctattacctcatctatttaccattattt

SEQ ID NO: 67953 - DNA, 271 bp, Zea mays
  Clone ID: LIB3076-007-Q1-K1-H3
gccacgcgtcctatcacgcgtccgtaaggtgcatacggaactggctatagaagctgtcaggaaatcacttgttgtgtcaaagaattgtaactctcccgatcatcaattcctacctctccctaaaagagctagaactatccttgtcactagaattcatgctagcaatttgtggtaccagtgtagatgatggtcaaaccaatggatagagtacacgtgtaatatcacaactgcaattcaatatccctgacgaggaccacaatttttgatgcga

SEQ ID NO: 67954 - DNA, 255 bp, Zea mays
  Clone ID: LIB3076-007-Q1-K1-H5
gggccagaatgaggttgtctatcaatcaacaacaccggtcatggattcgaactcatacaatcacaggtatgtgccacgatctgatgtgaaaaacatcggcgtaacttcacactctagagcctggaaacctaaaaccaattcccatcctcatgacagctcagacagccagaatgctgttgacgggcaacgtggattcccatggtggtaggctttgagatgaatacttccaaagatacaattacccatctaatgacc

SEQ ID NO: 67955 - DNA, 438 bp, Zea mays
  unsure at all n locations
  Clone ID: LIB3076-007-Q1-K1-H7
gcactatgttatattgtctaaaaatgtccttgctgcttctgttgtcatcaactcaactgggagtagctctgaggatactgaaaatatagtctttcatgtactaactgatgctcaaaatttttatgccatgaagcactggtttgcaagaaactcctacagggaatcagctgtgaatgtcataaattatgaacaaattattttcgagaatttccctgagtttggaacccagcagttatatttgcctgaggaatttcgtgttttcatcagtagccttgagcggcctactgagaagagtagaatggagtatttatcagtgttcagtcactcacatttctttcttgcagaaatattcaaagatttaaagaaagtaattgtgttggatgatgatttggtcgttcaacatgatctctctntcttggggaatcttgatatgggaga

SEQ ID NO: 67956 - DNA, 322 bp, Zea mays
  Clone ID: LIB3076-008-Q1-K1-A1
gtgcgccccaataggctagacatggcacttgcgtacgttctcgcctttgcaccagctcctaatttaccacaggtggaacatataggtactcttggagatgtaagacaagatcgctacacaatgcacacaatagctcaggctcatgtgtgtgttgcatcccacagtctcatgcagcatgtttacttacagatattcatgaatagacacgtgcacttgatgcttctgggatcttcttactgcctagaggaccgagctctactttgtacagactgcgatgatgctatacacacagtgaatttctctggatcagtacatcagagat

SEQ ID NO: 67957 - DNA, 348 bp, Zea mays
  unsure at all n locations
  Clone ID: LIB3076-008-Q1-K1-A10
ttccgggcttcctaacacggaactccagccgttagccctaactcaaccagacaaccagtccaccaccgccaccaagcccgggccgaataactctgccgggcaaccgccgcccttcgccggcaaagaacgcccaccagatccaccccggcctgctatggagtccgcggtgaacccgaaggcgtacccgctggctgatgcgcagctgacgatgggtatcctcgatatcatccagcaggccgncaactacaagcagctcaagaaaggagcgaacgaagcgacgaanaccctgaatagggggatatcggagttcgttgtgatggcggcggacacggagcctctcgagatcct

SEQ ID NO: 67958 - DNA, 379 bp, Zea mays
  Clone ID: LIB3076-008-Q1-K1-A11
tttttgttttttcccgatgaaacaaagctaaattattgaactcggtgacagactgacagcagtgaacacgaacaaagcagacacgcatcttgatcctctgctgcctacagtttgaaacacatgagacgagacaggacgacgacccatgtgacactcacgcgtgcagtggctcacatcacatgcatgcgagtgataatacactggagagcaaggctactgagcgaagcaaacggctaatcaacaacaacctaacgacaatggcggttggacacacgacggcgacggcgacatgaaagaaagcacaacacaggccgcgagatggcgcgacgaccccatgttcgcatcgcatcacacgtgcgggttacagtagatgatcttc

SEQ ID NO: 67959 - DNA, 402 bp, Zea mays
  Clone ID: LIB3076-008-Q1-K1-A4
ccgtgatccgtccgcacccgcttcatgcccagcagcgttcaatccgtcccctaatgccgctgcctccaaatagttctccgtgtgctggttcttgcggattgcgctgtcaggtccacataatattggggacggtgcagagtgtcctccgttttttcctctctcgcacctaaagttttcgggagcagttagttagagtatattcgattccccctgatatagtttgtttatttcacactacgaagtctatgcactcgagagaaaaatcactggtagcgacggcatcaattcttgtgacgtttagtggctagaacaccctcactagcgctcattcatgtttacccgaccttgtccttttcccttccagcttccgtgtgctggtatcaatttgttgtaatttgggga

SEQ ID NO: 67960 - DNA, 314 bp, Zea mays
  Clone ID: LIB3076-007-Q1-K1-G10
tgaagataactatatgctgatggctgcatgtacggattcaaattggtctaaacaacatggtcccatgtgacctaggccatgccacatgtagctcatgtcctaagctgcccataaattccattatgtttctagtcgtccacctactagtcggacgactaatcgtcatcagtcaatgattaatcagatggccataaactaatcaacttattgagttttatctcccctgcgaacatccccttgtctaactggttaggtgatgtagtagcaaactctcatgttctgagttcaattcctagtggaagctaattttcata

SEQ ID NO: 67961 - DNA, 416 bp, Zea mays
  Clone ID: LIB3076-008-Q1-K1-A5
ggcagaatgccgcatgctacagcatctgatgcagaaagcaacactgatcaataattctaggtcagcacaaaacagttgctgcatggaatcactgactgacagccagtccgatcatggggagcacatggtggctgttgataatgatctgcaaaattctgactcatgggcattggctttgattgctgagcttgatcagttcaagaatggcaaagatggttcaagaaatattgtgaacaatcctgttgagattgacataatggatgatttccttgagatggaaaggttagctgcattgcctgaatcagacggcacaagctctaactttgaaatggaaacggattctgacaaggccatcgcaagaagcggctccttgaaaatcaaaagtgaagaattgcaaaacaaggtcgccaatttgc

SEQ ID NO: 67962 - DNA, 373 bp, Zea mays
  Clone ID: LIB3076-007-Q1-K1-C4
ctcagctgatgtagcaactaaacagcaccaggaagatgtcaagaaaatatcaaaacttgagagctgaatgccaaagattacgtggccttgttcgaaagaagttacctggtcctgcagcactagctcaaatgaaaatggaggtggagagcttgggtagagagtatggagaccacagagtacgacgatctcctgcaaagaattctagtttccatcggcccatgtctcctatgtctcctgttcctgattacgcaatcgagaacatacagtacatgcagagagagaatgagtttctgactgctccgttattaacaatggaagaagaaaccaagatgcttaaagaggcattgaccaagcgaaacagtgagctgcaatc

SEQ ID NO: 67963 - DNA, 324 bp, Zea mays
  Clone ID: LIB3076-007-Q1-K1-C6
ctcagctgatgtagcaactaaacagcacctttaatatgtcaagaaaatatcaaaacttggggctgaatgccaaggattacgggggcttgttcgaaagaagttaccttgtcctgcagcactagctcaaatgaaaatggaggttgagagcttgggtagagaagatggagaccacacaatacgacgatctcctgcaaagaattctaatttccatcggcccatggctcctatgtctcctgttcctgattacgcaatcgagaacatacagtacatgcatagagagaatgagtttctgactgctccgttattaacaatggaagaagaaac

SEQ ID NO: 67964 - DNA, 254 bp, Zea mays
  Clone ID: LIB3076-007-Q1-K1-C8
gtcatctaatgtagcacactaaacaacaccttggagacgtcaagaaaatatcgaaacttgaggctgacttccaaagactacggggcctttaacaaagaccgtacctgaacctgcagcactaactgaaaggatcatgttgctggacatattggttcaagagtattgacaccacaaagctctactaacacctgcaaagaattctactttacatccacccataagttctataacatctgtaactgattacgcaattg

SEQ ID NO: 67965 - DNA, 323 bp, Zea mays
  Clone ID: LIB3076-007-Q1-K1-D2
gcctttatggtttgccaaatgagacttgggaggtcactcttccagctgaggaagtacctgctgagcttccagaaccagcactggggataaactttgcccgtgatggaatggtcgaaaaagactggttgtctctagttgcagttcatagtgatgcatggctcctgtctgttgcattctattttggagctcgttttggatttgacaaagatgccaggagaaggctcttcaccatgattaacaacctgcccactgtttatgaaattgtgacgggggttgctaaaaagcaatcgaaagcccccaacggcagcagcaaaagcagcaaa

SEQ ID NO: 67966 - DNA, 395 bp, Zea mays
  Clone ID: LIB3076-007-Q1-K1-D3
cccacgcgtccgataatgagtgctcctcttgaagatgctcgattgctaacttaccgttagcaacggatcagacaggacatggagtctcagatagctgatgtgatgagaaagcaacttaaatccaaggaaagtagtggtaacacagataactctgtgaaactgcaacatgcagaatcgaaattatcagatcttcgaactacactggcagcgttaggaagagaagcaactgcagctatggaggctgtagaggctcagcaacagcaagttacgtatgaacgtctccttgcaatggttgatgctgagaggacatatcatcaaaatgctgctgatattctgaataaactccatgatgagatgctctatgcaaagcatcataatgagtcagcaaaccacta

SEQ ID NO: 67967 - DNA, 171 bp, Zea mays
  Clone ID: LIB3076-007-Q1-K1-D4
gtcagctgatgttgcaacttaacagcaccttgaatatgtcaagaaaatatcaaaacttggagcggaatgccaaagattacgtggggttgttcgaaagaagttacctggtcctgcagcactagctcaaatgaaaatggatgtggagagcttgtgtattagagtatggagacc

SEQ ID NO: 67968 - DNA, 287 bp, Zea mays
  Clone ID: LIB3076-007-Q1-K1-D5
tcgcccacgcgtccgataatgagtgcttttcttgaagatgctcgattgctaacttaccgttgtgaacggatcagacgggacatggagtctcagatagctgatgtgatgagaaagcaacttaaatccaaggaaagtagtggtaacacagataactctgtgaaactgcaacatgcagaatcgaaattatcagatcttcgaactacactggcagcgttaggaagagaagcaactgcagctattgatgctgtaaaggcttagcaacagcaagttacgtatgaacgtcttct

SEQ ID NO: 67969 - DNA, 182 bp, Zea mays
  Clone ID: LIB3076-007-Q1-K1-D6
cgagcgacccgtcctgatggtgcaccaactgttactggagcggttactgctgcagatctggaaaaacctactgagcttccagaaccaggagtggggataaactctgcccctgatggaatggtcaaaaaagactggttgtctgatagctgcagttcatagtgatgcatagctcctgtactgtg

SEQ ID NO: 67970 - DNA, 227 bp, Zea mays
  Clone ID: LIB3076-007-Q1-K1-D7
cccacgcgtccgataattagtgcttctctttaagatgctcgattgctaacttaccgttagcaacttatcaaacgggacagggagtctcaaatagctgatgtgatgagaaagcaacttaaatccaaggaaagtagtggtaacacatataactctgtgaaactgcaacatgcaaaatccaaattatcagatcttcgaactacactggcatcgttttgaaaagaatcaac

SEQ ID NO: 67971 - DNA, 320 bp, Zea mays
  Clone ID: LIB3076-007-Q1-K1-E5
gcgcagcccaaggcagagctccataccccatcctacatttgcccaataggccaaccccgggtccgttctcagcagcgcgctgggcggcttactgcctcgaatcggatgaaccccgtgccgggatacgaaaacccaccaaaccctaaccctagctgcagtgccactaccgtccgcttgcccgggctacggagaggaagccgacccaagcaacgatgccgaacgggtcagcgacgcaatttgggaacacgcagacgccgtccaaggtgctgcacctgcggaacatgccgtgggaatgcaccgaggaggagctagtctagctc

SEQ ID NO: 67972 - DNA, 298 bp, Zea mays
  Clone ID: LIB3076-007-Q1-K1-E7
tgcgctcgagaccaacgcgcgcactcacacgtacatctacatgtgggatacttcagagacacaatatgccacaagagcagtggggtcttaataacgagcactggggattcctggctcaaaatcgttagacggaccgccgctatacgaaaacgcacctaagaattactctagctgcagctccactaccgccaattcagcccggtctcctgacaggcagcagactcgtgctacgatgcctgccgatttaacggcgctgtttcgatacacgcagacgccgtccaatgtgctggacctgctg

SEQ ID NO: 67973 - DNA, 289 bp, Zea mays
  Clone ID: LIB3076-007-Q1-K1-F12
agataactataggctgatggctgcatttaaggattcaaattggtctaaacaacatggtcccaagtgacctagtccatggcacatgtaactcatgtcctaagctgcccataaattccattatgtttctagtcgtccacctgctattctgactactaatctacatcagtcaatgattaatattatggccataaactaatcaacttattgagttatatctcccctgcgaacagcccctgatctaactagttaggtgatttagtatcaaactctcatgttcttagttcaattt

SEQ ID NO: 67974 - DNA, 425 bp, Zea mays
  Clone ID: LIB3076-007-Q1-K1-F2
gaccctacaacaagggtggcagggcatcgctaaggaaaggaggaccttttttcttagggcaaagcataaggtgttgctggactctatgaaagatatggaaatcgaacctgatgtaacctgttacacagtattgattgatggacggtgcaaagcagaatatctagaggaagcacgaggattgtttgatgagatgttagcaaaaggacttatccctgatgttcacacatacacagctcttataaatggatactgtagccagggagaaatagctaaggctgaagatcttttccaagaaatgatagctaaaggaatgaagccagatgtactgagcttttcagtattacataagagaaccttgagacatgaaaaggctcattaatatttatgtgtcctaatggttatggtgatgaatgtcagtttgactg

SEQ ID NO: 67975 - DNA, 363 bp, Zea mays
  Clone ID: LIB3076-007-Q1-K1-F3
cggacgcgtgggcggactcgtgggttcgaatcgaaggccgacgcccgaacgtccaagaggtacccgcagcaaggtggcaggggccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcggcacacaactgtcatattccgcatgtgaaccgtactgagctccagctgattgatatatcacacgatggatttgtgagccttcttacttcagatggcaacacttaagatgatcttagactcccaactgat

SEQ ID NO: 67976 - DNA, 178 bp, Zea mays
  Clone ID: LIB3076-007-Q1-K1-F5
gaacgcgcgccctttctcgttgtctgactccttgtttacattggaaaagagtcttcgtttcatacgtaacgtcgctatagctggaggtcgggaaaaaaagtaattcttcctcaaagggcagtaaaccccattaaaaggtcactgcgaatccttcttttggggtgttgagttgggggac

SEQ ID NO: 67977 - DNA, 270 bp, Zea mays
  Clone ID: LIB3076-007-Q1-K1-F6
ctaatcgacccaggcgttccgaccctactacaagggttgcattgcatcgttaatttaaggaggaccttttttcttaagaggaaggttaatgtgggactgaggtcggtgaaagatatggaaatcgaaccttatgtaacctgttacacaatattgattgattgacttgtcaaagcataatatctaaaagaagcaccaatgatttttttatgaaattttaacaaaaggacttatccctgatgttcacacatacacatcttttatataatgata

SEQ ID NO: 67978 - DNA, 353 bp, Zea mays
  Clone ID: LIB3076-007-Q1-K1-C3
ccgacccgagcgacgcgtccgctcatctaacgactcaactaaaccttaattatatgatgtcaatatcatatcacgactcgggactcaatgccaaagagtaggggaccttgatcgaaagaacgttacctgtgcctgcatcactagctcaaattaaaatggacgcagatagcttggctagagagtatggataccacatagtactactatctcctgcaaacaattctagtttccatcgtcccatgtctcctatgtatactgtttctgattactcaatcgagaacatacaatacatgcatagagagaatgagttacttactgctctattattaacaatggaacaagaaaccaatatt

SEQ ID NO: 67979 - DNA, 252 bp, Zea mays
  Clone ID: LIB3076-007-Q1-K1-F7
gcccattggagttggaaagggtggcaatgaagttttcttgagggacatatggccttcaagccaagagatcgatgaggttggggagtccagcgtgcagactcacctgttcaagaaagtgtacgactccatcatggaacgtaaccctaggtggaaccagctgccggttccaaaggaggcgctgtacccatgggacgacaggtccacctacatccgcaagcctacgtacctggagggcatgtccatgacgccgtc

SEQ ID NO: 67980 - DNA, 390 bp, Zea mays
  Clone ID: LIB3076-007-Q1-K1-F8
cggaagaagtcagtaaagtaaattctgtcgctccatttcggacgaggagatgccgcggatccctgtgatcatgttccccgggcgggggctcaaagccccatctccatccgcgccagcggcgtctcaacccgcagaccagcacgcgaccctcatgttccggttaggggctaaagcagaggcaccatcttctggagagattaaaaattaccgctttagatctgatgtgccttgcccaccttcttatactgccgtatgaggtccagcttcactcctttctaagcgcaaacccctgactgatgatatagattgatgctattatgctggggggatccatcttatatcaccttatattaattggaaattcttggaacatcaataagattgtatgcc

SEQ ID NO: 67981 - DNA, 296 bp, Zea mays
  Clone ID: LIB3076-007-Q1-K1-F9
gtgttcgaacaagtctgtggcctgcgggcccttttttccgtcgtcctctggggtattttgctacctgggatgcgtgccaatcttttctccgctcctactcggcaggagctgaactgcttttgtgagggaaggctgaccagttttgtgggttttcccccttcactgttggtttcagtaaggtaggatggaaaacatattaaacaaaatcgatctgttgtatcaggatgttacatatataataataaaaaggctaataaagttccatgatttgagatgactcatcaaagaaattaatt

SEQ ID NO: 67982 - DNA, 231 bp, Zea mays
  Clone ID: LIB3076-007-Q1-K1-G1
tcggcccattggagttggaatgggtgtctactatatttttcttgagggacatatggccttcaagccaagatatctatgaggttggggagtccagcgtgcatacttacctgttcaagaaagtgtactacttcatcatggaacgtaaccctatgtggaaccatcttccggttccaaaggatgctctttacccatgggacgacatgtccacctacatccccatgcctacttacc

SEQ ID NO: 67983 - DNA, 321 bp, Zea mays
  Clone ID: LIB3076-006-Q1-K1-H9
cgcccacctcctctgctctctcctctcccccacctctgcgtccgtgcgttgtgtttgtttaggcggcaaccgcgaggcgcaatggcggccgggcgagagctggtggtgagtttcggcgagatgttgatagacttcgtgcccaccgtggcgggggtctcgctggcggaggcgccggccttcctcaaggcgcccgggggcgcgcccgccaacgtcgccatcgcggtctcgcgcctcggcggcggggccgcctttgtcggcaagctcggcgacgacgagttcggccgcatgctcgccgccatcctccgcgacaacggcgtcgac

SEQ ID NO: 67984 - DNA, 296 bp, Zea mays
  Clone ID: LIB3076-007-Q1-K1-A1
tcgcatcccccttgcaagtatagtctcggcggctctagaagacgatgggcaaggacgacgtgatcgagagcggcgctggcggcggcgagttcgctgccaaggactacacggacccttccccggcgccgctgatcgacgcggctgagctggggtcctggtcgctgtaccgcgccgtgatcgccgagttcatcgccacgctgttgttcctgtacatcacggtggccaccgtgatcgggtacaagcaccagacggacgcgtctgcgtcgggtgccgacacggcgtgcggcggcgtgggg

SEQ ID NO: 67985 - DNA, 437 bp, Zea mays
  Clone ID: LIB3076-007-Q1-K1-A2
gcactatgttatattgtctaaaaatgtccttgctgcttctgttgtcatcaactcaactgttagtagctctgaggatactgaaaatatagtctttcatgtactaactgatgctcaaaatttttatgccatgaagcactggtttgcaagaaactcctacagggaatcagctgtgaatgtcataaattatgaacaaattattttcgagaatttccctgagtttggaacccagcagttatatttgcctgaggaatttcctgttttcatcagtagccttgaacggcctactgagaagagtataatggagtatttatcagtgttcagtcactcacatttctttcttgcagaaatattcaaagatttaaagaaagtaattgtgttggatgatgatttggtcgttcaacatgaactctctttctttgggaatcttgatatgggag

SEQ ID NO: 67986 - DNA, 390 bp, Zea mays
  Clone ID: LIB3076-007-Q1-K1-A3
cccggctcccggatccggcgatggagaagatgctccactcagccccagcccacggcagggtcccggagtgcttcatcttggcggccgacaagctcccgcaggccaaggccacctcagcgacggtctccctgcccatcgtggacctctccctcggccgcgacgaggtgcggcgcgccatcctcgaggccggcaaggagatcggcttcttccaggtggtgaaccacggcgtctccctggaggcgatgcaggacatggagacggtgtgccaggagttcttccggctgccggcggaggacaaggccgggctgtactcggaggacacggggagggcgacccggatctactccagcaccatgttcgacacgggcgccgagaagtactggcgcgact

SEQ ID NO: 67987 - DNA, 279 bp, Zea mays
  Clone ID: LIB3076-007-Q1-K1-A5
tcgcccggctcccggatccggcgatggataagatgctccactcagccccagcccacggcagggtcccggagtgcttgatcttcggggccgacaagctcccgcaggccaaggccacctcagcgactgactccctgcccatcgtggacctctccctcggccgcgacgaggtgcggcgcgccatcctcgaggccggcaaggagatcggcttcttccaggtggtgaaccacggcgtctccctggaagcgattcaggacatggagactgtgtgccaagagttct

SEQ ID NO: 67988 - DNA, 328 bp, Zea mays
  Clone ID: LIB3076-007-Q1-K1-A6
gtcgaccgccgaggcgaggaacatcaagacgacgactgacaagaaggacgacgcggtggtgcagccgcagaccttcccggcgcttcgaccgcctcggcggccgcgcgtccccggcgttcggcggcctccccggcggcagcattcctggcagcagcattcccgggttcagcatgccctgcagcggcagcagccttcccgggttcagcttgcccggcagcggcagcatgcccctcttcggctgcagctccccgggctatagcggcttcggcggcatgcccgggtcccccaccggcgggttcgtccccgagcacgccaacaagccctgaac

SEQ ID NO: 67989 - DNA, 317 bp, Zea mays
  Clone ID: LIB3076-007-Q1-K1-A7
cggacgcgtgggctgacgcgtgggcggactcgtgggcgagaatagccttgtgtcttctgggccacgtcctcctggccgtggcgtccatcgcagtggcggcggcagccggtgactcgggcaagatcggcatctgccacggccgcgttggcagtaacctcccgccgtcgtctgccgccgcggcactgctcaagcggaacgggatcaccaaggcgcggctcttcctgccggacccggtcgtgctcccggtcttcgccgcggcgggcatcgacctcatggtgggcgtgcccaacgagaacctgaccttcctggccgcggcg

SEQ ID NO: 67990 - DNA, 294 bp, Zea mays
  Clone ID: LIB3076-007-Q1-K1-A9
acgaagaactgtcgatgttattgtggaagatgatcttgtagattgttgcaaatctggcgacggggtctcaattgtcggggtgggcaaggctctaccagggaaaagcatgggaagtgttaatggtgtcttcagaactgtccttatcgcatataatgtgtcgcttcttaacaaatatgcgaatgcacctgtctacactcgggaagatctgaagcggatgaaagaaatatcaatgagaaatgacacctttgacttactgggaaattctcttgctccatccatatatggtcatctatg

SEQ ID NO: 67991 - DNA, 51 bp, Zea mays
  Clone ID: LIB3076-007-Q1-K1-B1
ccgacgcttgggctgacgcgtggtttgactcgtgggcgagaatatccttgt

SEQ ID NO: 67992 - DNA, 282 bp, Zea mays
  Clone ID: LIB3076-007-Q1-K1-B10
ctgcctccttccctcgatctattctccatcttgtcctccctttgctaaaaaggacgaggcataggcagcttcgggttgacgtgcgcttcctcttcctcgctcgctctcggtcgcagtgatggctgatgtcgacgagtaccgttgcttcattggtaacctgtcctggtcaacgactgatgaaagcctcaaggatgctttcagcaaattcggcaacctcactgaggcaaaggtggttcttgacttattttcaggacgttctcctggtttctgctttgtaacttt

SEQ ID NO: 67993 - DNA, 336 bp, Zea mays
  Clone ID: LIB3076-007-Q1-K1-B3
cgccatggcctccgcccccaacccctccttccgcccggaggaggcacgctcccctcccgcgcctcgagctcccgaccccggcgctctccaagttcaaggtggcgctgtgccagctctcggtgacggcggacaagaatcgcaacatcgcgcacgcgcgcgcggccatcgagaaggcggcctccgagggcgccaagctcgtccttctcccagagatatggaatggtccgtattcaaatgacagcttcccagagtacgcggaggacattgaagctggcggagatgcggccccttcattttcaatgatgtcggaggttgctcgcagcttacaagtcactc

SEQ ID NO: 67994 - DNA, 92 bp, Zea mays
  Clone ID: LIB3076-007-Q1-K1-B4
cgactcgctccatacttcctcgcacgcctacacgaaccaaccgtttaaacagcatacaagcaaagctaataacttcaggtgcgtctcaccaa

SEQ ID NO: 67995 - DNA, 327 bp, Zea mays
  Clone ID: LIB3076-007-Q1-K1-B5
cgccatggcctccgcccccaaccactcctttcgcccggaggaggcacgctcccctcccggcctcgagctcccgaccccgccgctctccaagttcaaggtggcgctgtgccagctctcggtgacggcggacaagaatcgcaacatcgcgcacgcgcgcgcggccatcgagaaggcggcctccgagggcgccaagctcgtccttctcccacagatatggaatggtgcgtattcaaatgacagctttccagagtacgcggaggacatttaagctggcggagatgcggcccctccattttcaaagatgtcggaggttgctcgcagcttaca

SEQ ID NO: 67996 - DNA, 437 bp, Zea mays
  Clone ID: LIB3076-007-Q1-K1-B7
ctcacaattatggtaacattccaaggactctttgggaagacaatgacccaatgggtgtggtggtcctgatgcaggagcctgttgatcctggttcgttcctgagagctagatcaattggccttatgcccatgattgaccagggtgaaaaggatgacaagataataacagcatgtgctgatgatcctgaataccgtcactacaacgacattagcgagctgtctactcaccggctgcaagagatcaagcgctcctttgaagattacactagaaacgagaacaaagaagtatgcagtgatgcattctatgccgctacaacagctcaagaagccattcagtacttcatggacctgtatgcccagtatattttgcaaaacttgacgcagtagattgcaagcaacaaattatctattatgcggtttggatggaggcgtgatttt

SEQ ID NO: 67997 - DNA, 435 bp, Zea mays
  Clone ID: LIB3076-007-Q1-K1-B8
atttactctgtgcctcaccttcgagtgagtacgtggtacttgatcctgttagtggcctggtcggactagatccgagggactgacggtttattcccatttaagtgtggtctagcctctaaggcaggacctaggcacttaagttggaataattcggacggttccgccacagctggtatcggagctcgtaccaccacagaggaatcaataaactataaataccatcctttttcaaagtaaaacttgatagaaacaaatgttggatagatcttaagacgatcaggatatacctaggacgtgaagtcgtatgataatagaagggtagctaggtggctatttgagtaagccctacaagctactataagggatgggagttctttcctaatccctctaaattgaaataagtcgtttaggacgaacatgcatgcattcttactt

SEQ ID NO: 67998 - DNA, 436 bp, Zea mays
  Clone ID: LIB3076-007-Q1-K1-B9
gccaccacagccgccagcagtccatcaccggttccgttcgaatgggccgcaggggacgcaaggctagggtttggcgcgacgccgacgtcgacggcagcgaggatgagatggccgccgctcctgccgccgctgcgggcaggagcctctacgagatcttgggagttgagaagactgcttcacaacaagaaataaagaaggcatatcacaaattggctctgcgccttcatccagataagaatcctggggatgaggaagccaaagagaagtttcagcagctgcagaaggttatatccattcttggagatgcagagaaaagagctttatatgatgagaactggcattactgatgatgatgcactggtgggagaagctgcaaatgatcttcatgagtacttcagaacaatgtgcaagaaggtcactgaggctgacattgaag

SEQ ID NO: 67999 - DNA, 307 bp, Zea mays
  Clone ID: LIB3076-007-Q1-K1-C1
ctcacaattatggttacattccagtgtctctttgtgaagacaatgacccaatggaggtggtggtcctgatgcaggagccgggtgttcctggttcgttcctgagagctagagcaattggccttatgcccatgattgaccagggtgaaaaggatgacaagataatagcagtatgtgctgatgatcctgaataccgtcactacaacgacatcagcgagctgtctcctcaccgtctgcaagagatcaagcgcttctttgaagattacaagaaaaactagatcttagaagtcgcagttgatgcattcttgcc

SEQ ID NO: 68000 - DNA, 258 bp, Zea mays
  Clone ID: LIB3076-006-Q1-K1-H7
ggggagccggaggtagaaagaccagagaatatggctaccaccgagccggctgcggtgaggctggtgggctccttcgccagcccgttcgtccaccgcgccgaggtggccctgcgcctcaaaggggtgccctacgagctcattctggaggacctgggcaacaagagcgagctgtttcttgcacacaaccttttgcacaaacttgtgtccgttctttttcacggctacagggccattttctagttgctttgatattctata

SEQ ID NO: 68001 - DNA, 306 bp, Zea mays
  Clone ID: LIB3076-007-Q1-K1-C10
gattcaaatccctcttccaccaaaaattgtacccaagtgttaccatgatgactgtggagggaaagccagatgtgaggtacaatgatgttggtggctgcaaggaacagattgagaaaatgcgtgaagttgttgaacttcctatgcttcacccagaaaagtttgttaagcttggtattgatcctttaaaaggcgtgctttgctatggcttacctggcactggcaagacacttcttgcaagagctgtagcaaatcggactgatgcttgtttcattcgtgtaattggaagtgagttagttcagaagtatg

SEQ ID NO: 68002 - DNA, 315 bp, Zea mays
  Clone ID: LIB3076-007-Q1-K1-C12
acccacacttccgcccacgcgttctcggactcatggggttgtttccatgcttactgcacctaacaaactacagggattaatacattcggtttaggcttaatccatcatatagtgtggactaatgcttgttggagcagtttcttgaactgtactccattgtgtctgttcgatccacttacactctcattctgactgtgttatgttatcatgacaatttttctgtatacatatttttttaaatgatctcttacagctttccttatcaaaactcgtatgactcttaagcttattaggagggtaaactgacaatttatt

SEQ ID NO: 68003 - DNA, 252 bp, Zea mays
  Clone ID: LIB3076-007-Q1-K1-C2
aattcccgggcggacccactcattcgatttactctgttccttaccttcgtttgagttcgtggtacttgatcctgttagtggtctgggtagactagatccgagggagggactgtttattcccatttaagtgtggactagcctctaatgcatgacctatgcacttatgttggaataatttctacagttctcttacatctggtattgaatctagtaccatctctttattaatcaatatactatatataccattct

SEQ ID NO: 68004 - DNA, 429 bp, Zea mays
  unsure at all n locations
  Clone ID: LIB3076-006-Q1-K1-E9
cggacgcgtgggatcaaagggaggcaaacgccatagcggccaatcacttggcggcggcggcggcgatggggcggctgaccgaggagcaggcggcgcgcgaggcgggctcggcggggaccaacgccacgtccctcaagctcacacaccgcgctctctccgacgtgtcgtgcctgagcagcttcaagaacctggagcacctcgacctcggcttcaactgcctcgtcaccctcgagggtttgtcctcctgtgccaatttgaagtggctttcggttaaggaaaacaagcttgtgagcttaaaaggtgttgaggggctctcaaagctgcaggtactgaatgctggcaagaacgaacttacaaaaatggacgaggtcacatctttaacaagcctgggagcatngattcttaatgataacaatatttctttcatct

SEQ ID NO: 68005 - DNA, 398 bp, Zea mays
  Clone ID: LIB3076-006-Q1-K1-F11
gttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagcttgttggc

SEQ ID NO: 68006 - DNA, 384 bp, Zea mays
  Clone ID: LIB3076-006-Q1-K1-F2
gctataacacccacaggaattcctccaagctttgctctgccagtaaccactgtttttgcccatccttcaaatgtctccacaaagctgtctttgtcaaacataccacccaaccatttcccttggctgtcatctacaccacggatggctgcacgcggatcgcatgtgttctcagggatgtatgcgacaggtctatctggagggtccaaaggtttggtaataggaagaggtccaccaatgtttgcaggaacatagctgagccacctcaatatattggaaacaccttcaagatcatctgaaacggtcaagtggacaacaccattggtcgccatgatcttaggaccacccagctgcatgtgggagctgtacacttctcgcccaaggagc

SEQ ID NO: 68007 - DNA, 402 bp, Zea mays
  unsure at all n locations
  Clone ID: LIB3076-006-Q1-K1-F4
agctgcgggcgccgaatgcacgtctactaaacggccgtccattccctccgctctttaacttcaaacatgagctagcaaatgcctccccggacctcatcaacaggcttgtaccggagcacattagacggcagaacggtgtcaactttgggcatatcgggagctaggagggcaggcggctgccatggtctagtttttggtcttggtaccccatgtgcagggccggttgcaggtgaaggtgatattgctgcaccatctgggagaggaggggctcagcagtacctgagagagctgaaactatgtaaattatctgaccgcgaaggagtacggccagtgttaagccagtaaactggcgcatgttggtccagagtagttaaggtaagaatgtancangtggagactggt

SEQ ID NO: 68008 - DNA, 412 bp, Zea mays
  Clone ID: LIB3076-006-Q1-K1-F7
aaaggacgtggacctgcggtgcgagtcgtgacaggggaagccgcgcgaccgttcgtccttctgccggacagctcctccgtggcaatgccggaagttgtcctctgactttgcacggtgaaatgagagtgcatggtccgtgcatcgtagctccgaggagaatctgcttgggggaagaagcgctaagctatgattggacccgggcgtggggattgctgcttgattcgccgtcttggcggcaggtcgtcgtgtcgcgcagccccagcccagccagaacgattcgccttctgcagttgcccttccaagtggccgtgtcgtagcttccatttgtttttcccctgtatttttacaagctgtacatattcgagcggccgagttcttccatgctgcctgaattggttttgggcgatctttg

SEQ ID NO: 68009 - DNA, 310 bp, Zea mays
  Clone ID: LIB3076-006-Q1-K1-F8
cacacgcgcccacctcctctgctctcttttctccctcacctctgcgtccgtgcgttgtgtttgtttaggcggcaaccgcgaggcgcaatggcggccgggcgagagctggtggtgagtttcggcgagatgttgatagacttcgtgcccaccgtggcgggggtctcgctggcggaggcgccggccttcctcaaggcgcccgggggcgcgcccgccaacgtcgccatcgcggtctcgcgcctcggcggcggggccgtctttgtcggcaagctcggcgactactagttcggccgcatgctcgtcctcattcttc

SEQ ID NO: 68010 - DNA, 423 bp, Zea mays
  Clone ID: LIB3076-006-Q1-K1-F9
cggacgcgtgggtttttttttttttttttttttttttttttttttttttattttttttttttttttttttttttttttgggttttgggtttttatttatttattttttttatttttatttttatattttttttaattttattataatttagtggaattttttttattttttataaataaaataatgaggtttttaatattatatatttttttttatttttttattttattatatattttatttatttttattgttatataattttttttattgtttttattttttaaatttattttatttgttaaattttattttttttatttatatttatttggatttatattatttttttattttatttttggttttaattttattttattttaatgtattttattttttatattattataatattttttt

SEQ ID NO: 68011 - DNA, 409 bp, Zea mays
  Clone ID: LIB3076-006-Q1-K1-G1
gttccttgtcggtccattcctcgatggatttttgaccaaccaaaatgtctttgctttcgactacacaactcaagttctggttttcatcgtgctgtcgtgcctgatttcagtctcggtgaacttcagcacttttctcgtgatcgggaagacgtctcctgtaacctaccaagtccttggccatctgaaaacatgcttggtcctcacctttggctatgtcctgcttcacgacccgtttagctggagaaacatacttgggatcctaatcgcggtaatcgggatggttctgtactcgtacttctgcactagagagactcagcaaaaaccagcagaagcctccccgcaagccgttcaggcaaaggagggtgaatcgaacccgctgatctcggactccctgagcgctgccgaaaat

SEQ ID NO: 68012 - DNA, 230 bp, Zea mays
  Clone ID: LIB3076-006-Q1-K1-G10
aaaaaaaaaaatataagaaaaaaagaaaataaaataaaaataaaaaaaaaagaaaaaaaaaaataaaaaaaaaaaaaaaaaaaaaaaaaaataaagaaaaaaaaaaaaaaaataaaaatataaaataaaaaaaaaaaaaataatataataaaagaataaataaataaaaaaataaaaaaaaaaaaaaaaaaaactaaaaattataaaaagaaaaaaaaaataaaaaaata

SEQ ID NO: 68013 - DNA, 358 bp, Zea mays
  Clone ID: LIB3076-006-Q1-K1-G2
ctatcgcctatccctctcgcggtcttgcctcggtctctggcggcggcaccgccgttttacactcctcctccttcgacaacccgtcgcagtagcgtccgtctctggtgtccggctgtccggctctggactcccgacctcgacatcaggatctgcgcctcccgaccggtatgtgggggctctgaagaaggtgcagaaggatctgggcgcgtcggtgttcgagccgctggtgcaggcgtacgccgccgtcgggaagttccctgggatgtggcagcggctgaagatcgagaacgtggaggtcggggaggggacggcccagctgcttgactctatctgcgccgatcaataggtggttttcttt

SEQ ID NO: 68014 - DNA, 378 bp, Zea mays
  Clone ID: LIB3076-006-Q1-K1-G3
cacttgggggccttgtaaccgttctccacgcgtgccttgatatgaagtccaccatcctagggaaataccactacatcctgtacattattgtcctggcaatgcagcccaggatgcttttgactgtcgacgaggatctgaagcccctgtcagtacctgtccgcgtcgggcaagctgtcgacgtggttggtcaggcaggaaggccgaagacaatcaccggcttccagacacactccacgccggtcttgctcgcagcaggggagagagctgaactggcaactgaaaaatacattccactgaccccagtactagagggctttgtgattctgaagaagaacccagagtaccacgaagagtgaagacccagatagcatattggtg

SEQ ID NO: 68015 - DNA, 345 bp, Zea mays
  Clone ID: LIB3076-006-Q1-K1-G9
gccgccgtcatgtcgaagcgaggtaggggaggttcggctgggaacaagttccgcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatcccaaaggtgagatg

SEQ ID NO: 68016 - DNA, 390 bp, Zea mays
  Clone ID: LIB3076-006-Q1-K1-H1
cgatttcgtctcttgcagcactacggtttatgaagcgatgctcacggactggatgaggaatctggaagtcggcatcccggcgctgcttgaggatgggattaacgtgcttatatacgctggggagtatgaccttatatgcaattggctgggaaactcgagatgggtgcactcgatggaatggtctggccagaaagacttcgtatcctcctgtgactcaccgtttgtagtagacggtgcagaagctggagtcttgaagagccatggaccactgagcttcctcaaggtccacaatgcggggcacatggttccgatggaccagccgaaagctgccctggagatgctgaggagattcacgcaagggaaactgaagcaggaaccgctccctgagac

SEQ ID NO: 68017 - DNA, 288 bp, Zea mays
  Clone ID: LIB3076-006-Q1-K1-H3
gaggcactttccttgcctgattggcgatttaagcggtgggggagggaaggccgatggtcagtgaaagagagtaggtggacggacggtgctggcatcgccaattcaactccgcatctgcatcggcagcgcgccagctccatagtgtaggaggagatggcgctcacaagaatcggtcttgctggccttgcggtcatggggcagaaccttgccctcaacattgcagagaaagggttccccatctctgtgtacaacaggacaacctccaaagtggacgagaccgtgcagcgt

SEQ ID NO: 68018 - DNA, 395 bp, Zea mays
  Clone ID: LIB3076-006-Q1-K1-H4
cgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaagacgctgctgagaacaccatggtggcatacaaggctgcccaggacattgctttggctgagcttgctccaactcaccctattaggcttggactggcactcaacttctcagtgttctactatg

SEQ ID NO: 68019 - DNA, 399 bp, Zea mays
  unsure at all n locations
  Clone ID: LIB3076-006-Q1-K1-H5
acgcgttcgcgttattgtagcccgtcgtgcctcatgtctcatcatttcctccatcgagcanaaagagggggttttaggaagtgaggagggctttactctcatcaaggactaccgtggcatgattgaaactgagctcaccaagatctgtgatggcatcctcaagcttctttaatctcaccttgtgccgtcttccaccgatcctgagtccaaggtcttctatctcaagatgaagggtgactactacagataccttgctgagttcaagactggagcttagagaaaagacgctgctgagaacaccatggtgggttacaaggctgcccaatacattgatttggctgtgctttgttccaactcaccctactaggcttggactggcacttaactttctcagtgttt

SEQ ID NO: 68020 - DNA, 360 bp, Zea mays
  Clone ID: LIB3076-006-Q1-K1-E8
ggcatatgcaaaggaaattgatgaacacaagagaacaatactccttgttaacaaggctgatctgttgccgttaaatatcaggaagagatgggctgattattttaaggcacatgacattctctatgtgttctggtcggctaaggctgccactgccacattagaaggcaaaaagttaagtggatactctgaaggagaatctgcttcacttgatttggataccaagatatatgaaagggatgaactcttgatgaagctgcaagctgaggcagaatctattgtagctcagaggaggatctcacctactgtagatgatcacgaagccagttcttcagattctgtttcttcagtgactaaacatgt

SEQ ID NO: 68021 - DNA, 246 bp, Zea mays
  Clone ID: LIB3076-012-Q1-K1-H2
cgccaccggcggaagccaagcatcgtcccagcaccggatcgattccgcccgcccgcccgggcgtccatggatccggcggccgagccggcggcgtggccgccgtggacgtcgctcctgctgcgggcgctgagccggcggcggacctgggtggcgctcttcctcgccgtctacgccgggctgctctcgtcctcctggtccctgctcggctccgtcgccgcgcccgccatgctcgtcacctggaccacc

SEQ ID NO: 68022 - DNA, 405 bp, Zea mays
  Clone ID: LIB3076-012-Q1-K1-H5
cccacgcgtccgcggacgcgtgggacggaatcgatgagaatcgccgccagtttaacttcggacgacaccgacaaggtcgtctcagacgctaaggccgaggtagagaagacggggagaatggagccggtttcgccggcgctatctgacttggtcggcccgaagctgacgaagatctcgccagttgcaaccaagaggttttcgtaccttgagaatctgggtggaacaagaagcccgatagctagacactagctgctgtaagtaggggtttagtgggggtagatggatcatgccgtcgcaaagccttcggaagaaactttgtacatagcatagatgcccactgcgaacgtttgtctaacgataatgtgacatctaatcgactaatagaggcagaagttcttagagcgc

SEQ ID NO: 68023 - DNA, 375 bp, Zea mays
  unsure at all n locations
  Clone ID: LIB3076-012-Q1-K1-H7
cgccgccagacactccgtagtctgtaccccaagcaccggcgcggcggcggcggctaccatggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcangcttacaggaaaattcaggctccggctgaagatgtgcaagggaagaatgtgctcacaaacttctggggcatgaaatttta

SEQ ID NO: 68024 - DNA, 77 bp, Zea mays
  unsure at all n locations
  Clone ID: LIB3076-012-Q1-K1-H8
acgcaccagtgntcagttctaccagtagaccttcagcgtccctgcggccacgcgagctcgccgggatggtcgcccac

SEQ ID NO: 68025 - DNA, 416 bp, Zea mays
  unsure at all n locations
  Clone ID: LIB3076-013-Q1-K1-A1
accagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatgcctccacgtgatcaggttgctcgagtggctaagatgttaggtgatgaatatggtactgcttcgaacatcaagagtagagttaatcgtcaatctgtgttggctgccatcacctcagctcagcaaaggttgaagctctacaacaaagtgcctnctaacggattggttctgtacactggaact

SEQ ID NO: 68026 - DNA, 70 bp, Zea mays
  Clone ID: LIB3076-013-Q1-K1-A12
gtattatgttatttttttatattttttatttattttattttatttttttattatatttaattattttttt

SEQ ID NO: 68027 - DNA, 381 bp, Zea mays
  Clone ID: LIB3076-013-Q1-K1-A2
gcgaccagacgcgccagggtttcaggcttccacgaatcttcccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatgcctccacgtgatcaggttgctcgagtggctaagatgttaggtgatgaatatggtactgcttcgaacatcaagagtagagctaatcgtcaatctggggtggctgccatcacctcaactcagcagaggttgaagctctacaaca

SEQ ID NO: 68028 - DNA, 393 bp, Zea mays
  Clone ID: LIB3076-013-Q1-K1-A5
tctccgccaccctaccaactactcaataaccctagctaaaccccacgccgccgcggcgacctcctccgccggcaggatggacagcctcaggggagccaagttgccgggcgtgccgaaaggcgggagtgcgctcgtgaaggtggcgctgctcggcggcgcggggctctacgccgtcctcaacagcttctacaacgtcgagggcggacaccgcgccatcgttttcaaccgcctcgaggggatcaaggacaaggtgtaccccgaaggaactcacctgatgatcccgtggatcgaaaggccgatcatttacgacgttcgtgcccgacccaaccttgttgagagcaccttctgaagccggtaccttcaaatggtgagaattggtcttcgtgtccttac

SEQ ID NO: 68029 - DNA, 358 bp, Zea mays
  Clone ID: LIB3076-013-Q1-K1-B10
cttgatatttgcacccactaacaaaatttatttctgtgtctcattcctttgcgaatatcagatggtactttgctgcaggtccttgacagattttgtttcttttttccttatcgtgcagtgacaaaggttattttcagggggcaaagctgatggttataatttttttccatagttggcaagtgtattttcaatggatgatgcttgaacccaaatggatgacagcagatgtgtgatatgacgtgcgctcagcttctccaacacactgattcttgaatgcattaatcatagtgcacaagcagttattcatgataagaaatcttttgctcatattcatataatgtgctctcaaagacattga

SEQ ID NO: 68030 - DNA, 297 bp, Zea mays
  Clone ID: LIB3076-013-Q1-K1-B3
atgtcactgtcgaggaccgcgtcgagcaccatcccgtccagcgacattgccatcagcccggtggccgcctggcccgccggtccggcaccggcgattccaagccctgcatcgaccgccgcgttccactggttcgaacaagtgccgtcgccgcggacaccaccgtcatcggtccaccaccgcggcgggcacaacctcgagctgcagctcatgccgccgtcctgcagcggcgcgggcggtgacgcgccaccacgtactccggcgggtccctcacagagccacgccggcgccatgggcatg

SEQ ID NO: 68031 - DNA, 389 bp, Zea mays
  unsure at all n locations
  Clone ID: LIB3076-013-Q1-K1-B8
aaaaaaaaaagggagggaaaaaaaaaaanaaaaaaaaaaaaaaaaagagaaaaaaaaaaagaaaaaaaaaaacacaaaaaagaaaaaaaaaaaagggaaaaacaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaacaacaaaaaaaaaaaaaaaaaaagaaataataaaaaaaaaaaaaaaaaaaaaaaaaaaaaaaaaataaaaaaaaaattaaaaaagaaacaataaaaaaaagaaaaaacaaaaaaaaaagaagaaaaaaaaaaagtaaaaaaaaaaaaaagaa

SEQ ID NO: 68032 - DNA, 339 bp, Zea mays
  unsure at all n locations
  Clone ID: LIB3076-013-Q1-K1-C1
cccacgcgtccgtccacgcgtncggtcaaacaaggatgatgatttcttgggcgtggtcgacatattttcgcatggtggtgataagaaggcaccattgaaacctccagtgaggaaggcgctcgcaatgttcagcgggaaaagaaatccaaacgacaaccacttctctcgcaagaagtactaagctctgatctgtcgtcttctttttatgcacgcctgtggtaccgtagtctgtaatcccagcatgtacgtaatggttgaagcaaagtgccttttttcttgttagtggcgtatactcatcatattcatatacacagatatatataagcatgttagctatgc

SEQ ID NO: 68033 - DNA, 440 bp, Zea mays
  Clone ID: LIB3076-013-Q1-K1-C10
aagttcgtgtctgtagttgctaccatttctctactctctacgtatgtaatttattcgcgggaatatttattgaaatgttggtacggacgacagaaaaacaaagggagaatcaggggttgttggattggattgtagcctgcgccaccatattttaacttcaaatccgttgagatatgcttctttttcgggtctctttgtttccttcctccttttgctggagccactgactttgatgtctcaccaccatttcttcattgcattcccttttctctcaacttgaggcatccttgtgtacacaagatctgcctacgtgtttcaggttcttgattctgtttatatgcagtcggaagctttatgcggttaggcccagctgatttgttgttgtgttgtttcttgtacagctgatctaaaccaggcgcaactgtgaaacaatggcgaca

SEQ ID NO: 68034 - DNA, 435 bp, Zea mays
  unsure at all n locations
  Clone ID: LIB3076-013-Q1-K1-C11
gtcgctttcagccgccgccgtgtccgcctcgccaagcgcagcagccgccgcaacacatgggtctcttgatctcagccatggcggaggtggagcancaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggaccccgtgaggatg

SEQ ID NO: 68035 - DNA, 362 bp, Zea mays
  Clone ID: LIB3076-013-Q1-K1-C5
tgatgtagagagtgtttgcctgctctcttttcttgggaggtagttaaaccaagggtggggtttatctggactggtgggaagaaattgggaacctctcgtctaccaaattctgctccattcttaatttgagggcaaaagactaaccttatgctctgcggcttctgcacgtgtgtacctcatgtctgatacttctggcctctctcatggtccttaccttggaacaacaactttctgttccttggcttctctgctcatcttggtaattaaggcatctgtttatagtacagcccaagacattgggcctgaacttctcccgtcattaccagatcacaaggtcaatctcaagaatctattgggaatgc

SEQ ID NO: 68036 - DNA, 437 bp, Zea mays
  Clone ID: LIB3076-013-Q1-K1-D10
gtctgtattctgtcccatatacaagcacatgttgaagatcattggtgccggggagttctatgaacaggagaaacccctttcccttaaagatttgaagtccttggttctcattttaaaacaggcattatggcaacttctgtgggttattccatcctcttctactcagaaagtgtcacccaacccttcaggccttaaaaagttgtcagtggagaatgtcaagactagagctagggttgggttatctgaacttctcacacagttgctagactggaacagccgactaccattcactgctgcaagtgatttctattctcaagaagctacgagcgaaaattttgtgtctcatgcaatacttggtaatactcgagcatcagagatcataaaacttgctccttttttggctccatttaccattcgagtcaaaatattcactttcc

SEQ ID NO: 68037 - DNA, 411 bp, Zea mays
  Clone ID: LIB3076-012-Q1-K1-H10
acccactcgtccgctcttcgcctttccttctcccatctctctcgactaggctcgccatcggggctattcgcattctccctccgctcctcttatccaccccccgcaaaaccctatccgccgacccctccaatcccctaccatcgcccgattgcccgccccaatcgagctagggctcgccaatttctggccgagctcactcaaatttcggccactcttttctggtgaatcctttggtttatcctgaggggatattttgatttctgcagcgcactatgggtagcagaacggaagaggacacgaacgacaatatcatccgccggctcatgaagttaccgtccaactctaagtgcattaattgcaccagtatgtcgccacaatctgtgtgtaccaatttctggaccttcatttgcc

SEQ ID NO: 68038 - DNA, 423 bp, Zea mays
  Clone ID: LIB3076-013-Q1-K1-D2
tcgcggacgcgtgggtgggcaatgcaaggtcattgaagagattatgattggggaggacaggcgaatccatttctctgggggtgcgatggggcaggcttgcaccattgtcctaaggggggctagtgagcatgtgctcgatgaggctgagaggtccttgcatgatgccttgtgcgtgttgtcccagacggtaaatgatacccgtgtcttgtttggaggcggatggcctgagatggtgatggccaaagaagtggatgaacttgcaaggaagacccctgggaagaaatcccatgctatcgatgctttctcacatgctctgcaagccatcccaacaatcatagctgacaatgctggtttggatagcgctgatttgttctctcagctacgaactgagcaccacaaagagaactccactgctggaattga

SEQ ID NO: 68039 - DNA, 360 bp, Zea mays
  Clone ID: LIB3076-013-Q1-K1-D3
gcgcccacgcgttcggatggattctcaagcgccgcttcgtcctcctctagctttcgcctgctggatcttcctttgctcatgcttgtgcgcagcaaatgagaggtacgacagggttggtgcggcggcgtcagatggggagagcaggaggatgctgctgcacaccgacgggagccgcggggacccgcacgcgtggcctgggtacctctacacccgagtagttgggagatgcacaccccaattctggagcagtggagaccatccctggcccaacatcgtcccacaagaagcggcggtggcgaacgtgctcgggtctacgtccgcggagcgctacgggccgcgcctcaccctgctggaagctac

SEQ ID NO: 68040 - DNA, 304 bp, Zea mays
  Clone ID: LIB3076-012-Q1-K1-D5
acgggcagagtttctgctttatgtactctgttgagaaccctctcttccgtgatggtatgagtgggttggacaagttgttatatcggccacgctttactggtgtgggagcacaaatccttggtgcggacgataagtacatatgccagttctatgagaaatcaaacaattttaggggaagtaggcatgaactaatgctgggaaacactttcatttccaatatagagtcaaccccaccggaagggggggtgtcccctcaggatttctcttggcgtgttttggaagagttccaagtcaccccaatatg

SEQ ID NO: 68041 - DNA, 173 bp, Zea mays
  Clone ID: LIB3076-012-Q1-K1-D7
acgcccacgcgtccgcttaattcatctgatagagttccaagagcagccatcatttgtgttagggtactcactggtgtcattgtcttaatttttctggggggttatctgaaaccgaggctatttagaaacagacccttggctcttgtacctgttagcaaaggcaaaggttccat

SEQ ID NO: 68042 - DNA, 402 bp, Zea mays
  Clone ID: LIB3076-012-Q1-K1-E1
gtcaagcaaatcgccccaaagttccaggacgggattagggcgctggcagacagtccgattataggggagatacgtggcttggggatgattatgggtaccgaattcacaaacaacaagtcaccgactgatctgttccccgccgaatggggggttggtgccatcttcggcgaagagtgccagaagcgcggcatgctggtgagggtcgctggcgacgccatcatgatgtcgccgacgctgatcatgacgcccggcgaagtctactagttggtgcgcatctacggggaagccctcaaggccacggaagaaaaggtggcagccctgcagtccaagaagaactagccaaaagggcgacgacgacgacgattacgataaacgccgggcgacgaccgcccatagctgatg

SEQ ID NO: 68043 - DNA, 440 bp, Zea mays
  Clone ID: LIB3076-012-Q1-K1-E11
cccacgcgtccgcccacgcgtccgcccacgcgtccgcggacgcgtgggcgaaggcggcgagccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtggtactagtttggctgccttcctgtgttcgtattgtagcagttgtggtagctggttgctttgtcgtcctgtagtcgtgcttctttgggtctgtaagaaccgctggttcgatgggattggattggacggt

SEQ ID NO: 68044 - DNA, 302 bp, Zea mays
  Clone ID: LIB3076-012-Q1-K1-E2
agggccaccagatcccttcttcctcagccgccggcgaaactagactggccgtgcacctgcgccgtgcgctgcggcaacaactggaagaaccagatgtgcaacaagatgtgcaacgtgtgctgcaacaagtgcagctgcgtgccgccggggaccggccaggacacccgccacctctggccctgctacgacaccatgctcaatccacacaccggcaagcttaagtgcccctagggcttcgccactcaggtgatgtacaatgtactatcatcacttcaatagataaataaaaaaacttctgggtc

SEQ ID NO: 68045 - DNA, 356 bp, Zea mays
  Clone ID: LIB3076-012-Q1-K1-E4
cccacgcgtccgtttcatcagaagtcatcgctagccggctgccagttccaccatctgcaagggttatttccgagagacacatcatttcagttgtgcctgtaacccgtgtcacaatggcgcgtcgcaagcagtcatttagcttctatgtcgttggctacagcagggatgtgttcataagagactatccttcgaagttttgctggggcctctgctgctgcttcgagtggctggggaaatagttatttcctgggcacgaatgaatgccttctttcagtgtgcagtgtttcattgtacagaaggctgcgtgaaagcttagggtgtgtttggtttgacttttggctttggcttttggcccc

SEQ ID NO: 68046 - DNA, 421 bp, Zea mays
  Clone ID: LIB3076-012-Q1-K1-E5
acgctccccgcgggccgccagaggcaatttcgccctcgattcgaccccgattcgtccggccgggaccgggattccctccgccaagcgcggatctgaacgctgcgctccgtgtcgtcgctcgaatgcgccatgaagggggccaaatccaagggcgccgccaaggccgatgccaagctggcggtgaagagcaagggggcggagaagcccgccaagggcaggaaggggaaggccggcaaggaccccaacaaggctaagagggcttccagcgctttcttcgtggtcatggaggaatttcgcaaggagttcaaggaggagaaccctaagaacaagtctgttgcttccgtgggaaaagctgctggcgacaggtggaaatccctgagcgagtccgacaaaggtccctatgtagccaaagctaacaagc

SEQ ID NO: 68047 - DNA, 447 bp, Zea mays
  Clone ID: LIB3076-012-Q1-K1-E6
cgcgttgtgaatgtataccatgcatacaaacaaaacaatgaagatccccagtggtgttacgagaactttgtggattcgggagcacttaagtctgcgagacaatgtcagacaacagcttgttcgcatcatgactagattcaacctcaagatgtgcagcacggatttcaatagccgtgagtactatgtcaatatcaggaaagccatgcttgcggggtatttcatgcaggtcgctcacctggaacgaactggacattacctgactgtaaaagataaccaggtcgtgcatcttcatccctccaattgtatggaccataaaccagagtgggtgatctataatgaatatgtcttgaccaccaggaatttcattcgcacagtcaccgatatccgtggggactggctaattgatattgggccacattactatgatctgagcaatttcccgtcatg

SEQ ID NO: 68048 - DNA, 312 bp, Zea mays
  Clone ID: LIB3076-012-Q1-K1-F10
tcggaattggctcacggcgcttacgctgggctggacattgcggtgcggctgctcgaggccatggaggaagagttcccaggggtctcttacaccgatttctaccatctcgcgggagttgtggccgtataggtcaccgtcgggccttgatattccttccaccccggtagggaggacatgcctcagtccccacctgagggccgtctttcatgatgccactaatgtttctgaccacctgatgctatgtcttttggcaagcagatgggctttagctgatctggacattgtggccctcttttgttggtcacactttgg

SEQ ID NO: 68049 - DNA, 161 bp, Zea mays
  Clone ID: LIB3076-012-Q1-K1-F11
cccacgcgtccgcccactcgtccgcccactcgtaccgccaagcgtcctcccaagccttcgcgcaaaccttctccgacgccttggccaatcccattcttcccgtcccaaattcagaccatcattacccgcgccttccgcgatctgtgccttaaagccctgcc

SEQ ID NO: 68050 - DNA, 142 bp, Zea mays
  Clone ID: LIB3076-012-Q1-K1-F12
cttatactgaatggtcacaggtaaggaccgtcttatccgctcacgcccagcatgcaccctcatatgcgttaagaagacgctcgtcttacacagatgcagggcacccttaggacaccgtatcctctggatcatgcacgagtac

SEQ ID NO: 68051 - DNA, 418 bp, Zea mays
  Clone ID: LIB3076-012-Q1-K1-F4
ctcttattgatggtgttatcggacattatgcttgctacaatggagatacatggtcatctgagctcgacattctttgtaaagctgagccacaaattatcacaacattcaagagtgcggaaggctaccattggtggtgtaaccatagatgggcttcttgcagcagcagctggattcttgattgggcttgcatttgtgctgataggatttttcaccactcaatgtgatcctgatgtattctggaaccagctgctagctatacccttggcacagctgccggcctatgtagaaagttgatcgattccttcttgagcgcaaccagttaatatagtgggttctacagtgttcgcaaaaagggtaagccaacaaatttcaatatttaaaataactcgatgtgtccagggtttgcaagacaagatta

SEQ ID NO: 68052 - DNA, 201 bp, Zea mays
  Clone ID: LIB3076-012-Q1-K1-F5
gtgagctggtcctctttaggttatgccacatcctggaaaaccgttgcgtgaggagttggggggccatgtccattggggtaataagatggtgaggtgtaagggctggtgcagttcaggttcattttatttgtgatgtgcacagcaagatattggatactttgggttcttacatttatttgagcactgtatttttatcgcatt

SEQ ID NO: 68053 - DNA, 273 bp, Zea mays
  Clone ID: LIB3076-012-Q1-K1-F6
ggacgcgagcgctcttattgatggtgttatcggacattatgcttgctacaatggagatacatggtcatctgagctcgacattctttgtaaagctgagccacaaattatcacaacattcaagagtgcggaaggctaccattggtggtgtaaccatagatgggcttcttgcagcagcagctggattcttgattgggcttgcatttgtgctgataggatttttcaccactcaatgtgatcctgatgtattcttgaaccagtggctagctataccct

SEQ ID NO: 68054 - DNA, 287 bp, Zea mays
  unsure at all n locations
  Clone ID: LIB3076-012-Q1-K1-F8
cgctcttattgatgcgggtaatcggacattatgcttgctacaatggaaatacatggtcatctgggctcggcattctatgcaaaagctgagccacanattatcacaacattcaagagtgctgatggctaccattggtggagtaaccatagattggcttattgcatcaccagctggattcttgattgggcttgcatttgtgctgataatgattttcaccactcaatgtgagcctgatgtattctggaaccaacatctagctatacccttggcacaactggcgacctatg

SEQ ID NO: 68055 - DNA, 233 bp, Zea mays
  Clone ID: LIB3076-012-Q1-K1-G10
aacacgcaaccggactaacttacgtatgcccttattctaaccatgtcacatgcatcaaaagctcgtctagtgtgaacctttgttgggaaagctagactcacatgaacatattatcaagcatcagtacctaatcttgcgtgtcaaccctaattgtctataattgcaacatttctacatacgaccctttcacatgtactaacccttaatctgtctaatccttgcattacctctat

SEQ ID NO: 68056 - DNA, 396 bp, Zea mays
  Clone ID: LIB3076-012-Q1-K1-G4
gcgcttagagaactaacaaaggatgttcttcactattataagggtgatatcttagatgaactagctgggttagtagacttcagtgtgtttttgaagctcacacccaagcagaaagacattatttataagttggaagcacatgatcggttcaaaagaaatgcagtagggagtgcactgtacattcatccatgtctttcagaactttcagaggttaatgctgagcatagggctaacacctttagagatgatttaattgatagtctgggagaattctatcactgtgagaaaatggcttaaaggccattttttcaatgatattctgggacttgctaattcttcaggagagaaagtgctagctttcaagcaatatatatcttccatgattttctttgaaag

SEQ ID NO: 68057 - DNA, 358 bp, Zea mays
  Clone ID: LIB3076-012-Q1-K1-D3
gcgcggacgcgtgggcgtcaacgtgtcttccttcccgcggtctctccgccgcctcccagatccggcggccatggcaaggaacccgggctgcaccgtcttcataggtaacttggatgacaaggttcctgagagggttctgtatgaaattcttattcaggtaggtcgggttgaaaactacacataccctcgtgacaaggaaactagccgaccaaaaggctatgcttttgctgagtatgaaacataggagattgcccaatatgcgtgtaagctattttctggtcttggtcgacttcataataaaacgcttaaatttgcagactctgggcaagacaaacccttattaaatggcaatattcct

SEQ ID NO: 68058 - DNA, 222 bp, Zea mays
  Clone ID: LIB3076-012-Q1-K1-G5
ggagggacgcgtatcgcccaccccctcttatctccttcccccagccgccctccgcctccgcgccatcgacacgctggggagcgtcgctggctggtgctcgcgcggctacacgcaggtgataaacagcatatggcgctagtacagttcaactgtgccttggttcctcaactcggtgaaaagcctcggctgctatcgctatcacctgcgatcgctaaggctacc

SEQ ID NO: 68059 - DNA, 229 bp, Zea mays
  Clone ID: LIB3076-012-Q1-K1-G6
cccacgcgtccgcccacgcgtccgtggactcgtgggtgctgctcctgaggagccggagggggccagcgagtgaggcgcgtgcgcacgcagcggcggcggccagggcccaggccccatgggatcggcgtgcgcgcgtggcggtgtagtctctcgcgcgcgtacatggcattatgacacgggattttgctgttcagtacgctacgggtactggcgtgtctctgtgtgtgtg

SEQ ID NO: 68060 - DNA, 263 bp, Zea mays
  Clone ID: LIB3076-012-Q1-K1-G8
cccagatccacacccacatgtgctactccaacttcaacgacatcatccactcgatgatcggcatggacgcggacgtgagcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtg

SEQ ID NO: 68061 - DNA, 407 bp, Zea mays
  Clone ID: LIB3076-012-Q1-K1-A12
gctccaccttcgccttttgctcccctttcccgccgtcacctacatccactcccaacggatcatcttcaacttctccacgacccccactcttatccactaccaccttccagcacaactccgccaccactacgatcgatctcttcatcgactagagcctcctcctattcctaaatactcttgtgtacccctacaagcacacaatctttctataacttgaccttcctcttctgacctgctccatcaacacctccacaccatcaactatcccaacatccactctcctctacctactctccaactctaaaactcctatttttcgaaatcttctactacccacaatctgtcaccacaagatctgaatactaatccatatttttcctccatcaaatcaatcgtctcacatatcc

SEQ ID NO: 68062 - DNA, 364 bp, Zea mays
  Clone ID: LIB3076-012-Q1-K1-A7
ttcccgtcgacgacgcgtacgcggacgcatagcgcttcattgtcacaaggttcgagttcgttaccgtctagtacgactgtgggagggaggaagaggcgaggggaagatgcagatcttcgtgaagaccctgacggggaagaccatcaccctcgaggtggagagcatcgacaccgtcgacaacgtcaaggccaaaatccaggacaaggaacggattcccccagatcgacagctactgatattcgctggcatgcagctgggggatggacgcacgctggtgtgctacaacatccaaaaagaggcaactcttcatttggacctaaagcttatgggtggaaccatgattgatgtcaaaactctcactggg

SEQ ID NO: 68063 - DNA, 418 bp, Zea mays
  Clone ID: LIB3076-012-Q1-K1-A8
cggacgcgtgggaggctgtaggcaagaaggaagaaaggggtgaccataaggttgcagggggtatatttatgtgcaatgcaaagactaagaaggagtgctaccagaatcgcttgtttgggatgcctggtgggaagattggaatggtcaagaagataaggccaggggtgaagctgttcctgtatgattttgacctgaagcttttgtatggtgtgtacaaggcagcatcacatggggggctaaaccttgtccaaggagcatttagtgggaagttccctgcacaggttaagtttaagattgataaagattgccgttctctccctgaaagtagtcttaagcaagccattagggaaaattacagtgcaaagagcaaatttgacccagaactcaccataaaacaggtccaaaggttacttttgct

SEQ ID NO: 68064 - DNA, 402 bp, Zea mays
  Clone ID: LIB3076-012-Q1-K1-A9
caattcccgaatcgaccgacgcaaacagctcgctccacctccgccgtcagctctcctcttccgccctcaccgccgccgcctatcaacggcttattttcaacttctcgacggcccttacacctacccctaccacctcccatcataacgccgccaccactacgatcgaccattcctccgactagagccgtcatcgtcttctcaatacgattatgtaccggatcaagcatcgaagctttctataactggacctcttgctagctacctttgtctatcatcacttgcactccatttactatgccaacatactctcccttctgcaagtactcgacctctataactcaaattttttgaaatcgtttactagcctctagcattcaccatatgatctcaattctaatccta

SEQ ID NO: 68065 - DNA, 334 bp, Zea mays
  Clone ID: LIB3076-012-Q1-K1-B1
cggacgcgtggggcttcattgtcacaaggttcgagttcgtcaccgtctagtacgactgtgcgagggaggaagaggcgaggagaagatgcagatcttcgtgaagaccctgacggggaagaccatcaccctcgaggtggagagcagcgacaccgtcgacaacgtcaaggccaaaatccaggacaaggaagggattcccccagatcaacagcgactgatattcgctggcaagcagctggaggatggacgcacgctggctgactacaacatccaaaaggagtcaactcttcatttggtcctcaggcttaggggtggaaccatgatcaagtcaaaactc

SEQ ID NO: 68066 - DNA, 455 bp, Zea mays
  unsure at all n locations
  Clone ID: LIB3076-012-Q1-K1-B12
acgttttcaccggtggccattcagcacgaacattatcaggtgtatcttgtgcatggagccggcgtctcagtctaaaacgtgaacgagtctcaagatggtcagctgctagtctcgagggaaacaattgacgatggacctctgggcgaggtgttcaagggcaagagttgccagtcagcatccgcggacatcttaactgaccattggacttcgactcgtgacttgcgttctccaaccggaatcctacaaatgtctagcagcaacacagtgccagcagagaatcacacgagtaacagtagctatctcatggcgaggattgcgaattctcagaccgttccaacactccactgagtgttcatcaggctggtctttgttgggaccacaaaataactgaagccatgttgatgtcctgagnttgctgatactaagttttcagtcgagtcttgtaactcctgttt

SEQ ID NO: 68067 - DNA, 368 bp, Zea mays
  Clone ID: LIB3076-012-Q1-K1-B2
cctgtttctgagtatgttacgcctgaagcttttgagaagtatcgggcccttggtgtcgaggtggggtttcgctacgttgcgtctgggccaatggtccggtcttcgtacaaggcaggtgaattctacatcaaggctatgatcgaagcggagcgagccaagggaaccgctgcagactcaagtgcataaccgagatagcaccttccggccccacccaccccttgacttggttgtgctgcaaataagctcttcactgcttttgtagtcagagagacatgtcgattttttacgtcataattgttaccacacattcacttctttttttttgtcaattggacaatttcggcgcctttaaaaaaaaaaatttggcc

SEQ ID NO: 68068 - DNA, 242 bp, Zea mays
  Clone ID: LIB3076-012-Q1-K1-B5
gcgagctctgcctccttccgcttctcttcgacagaaaactagggttttgctcttggaatgtctctctccgccggcgggggcggcggacagtgcaccgacgatacgacctcctccttcctccgatctggcctttttaatccgcggatcccgtacaagatgcttcccctctcgctcctcaagaccggccaggggcacccaatgctcggggagctgaagaatggtgagacgtacaacgggcatct

SEQ ID NO: 68069 - DNA, 342 bp, Zea mays
  Clone ID: LIB3076-012-Q1-K1-B8
caaatttgtactactcttttgaagttgctggtgcacacatcataatgctaggttcatacacagattatgatgatagctcagatcagtatgcttggctaaaggctgatcttgccaaggttgatagaaagaggacaccctggctcattgtgttgttgcacgtaccatggtacaatagcaattgggctcatcagggtgaaggcgacagtatgatggcttcaatggagcctttgctggacgctgctcatgtggatatgggaatagcaggtcatgtccatgcttatgaacgtgcggagcgagtctacaattccagacctgatccttgtggcgctggccacataacta

SEQ ID NO: 68070 - DNA, 443 bp, Zea mays
  Clone ID: LIB3076-012-Q1-K1-C11
atcacccactctactactcgaagttactaccagcagcttgcttcaacagtagaggagagcgagccgaggatggcgtcaccgaagccctcgtcggcggccctgctcctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgttgcacccgcgcagccacgccgagttccccgtgtgctggtggacggggcgcctgcgcgcgcccgacgccgcccaggtggagttccacgtcggcgtcgacggcggctccttctacctggcccccaacgcgcagccgggccagcgcgtcccggtctccgtcaccccgcacggctc

SEQ ID NO: 68071 - DNA, 251 bp, Zea mays
  Clone ID: LIB3076-012-Q1-K1-C5
agggagggggaaaaatatccccaaaccctagctcccgatctcgatggcgaaccctcgcgtcttcttcgacatgacgtgcggcggcgccccggggggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcattcccgagttcatgtgcc

SEQ ID NO: 68072 - DNA, 244 bp, Zea mays
  Clone ID: LIB3076-012-Q1-K1-C6
atggcgtccaagaggctgctgctggcggcgctgtgcgtggtggcggcggcgctgctcggggtgcggtcggaggcccacggcctggaggacttctcaagcagcgacgcgacgccggagatgcagaccttcttcaagcccgaggccgcggcgctcccggaggccctggacgcgtcctgcatgcccgccggcaccatggccgggaagccggaggccacgtctatcccgaccaccaccaccggcacca

SEQ ID NO: 68073 - DNA, 388 bp, Zea mays
  Clone ID: LIB3076-012-Q1-K1-C7
agggactcgtgtacggactcttgggcggacgcttgggttctttgtgagataaatgggtggtgaagtatatcttgaaagatttctccagattctaacataatcacatgcatgcctactacaaatggaggtggtacaccgtggttgtttacaagagagaagatgattgagcatttgtgtgtacaactgtgcatttataaattcctcagactttgtgaagctttaacaaaaagaattcggtacatgcatataggtattgggaattaccaagcagcataagccacaagcacccatctagcaacgttaacgatcaagaaaaaaacagctggtagatctatttacatacaattgcgcatgctagaactattgattctctcattattaatcgggc

SEQ ID NO: 68074 - DNA, 384 bp, Zea mays
  Clone ID: LIB3076-012-Q1-K1-C9
tagacaacacatatgcactcaatattgatatcttggtgcacaaagtatgtgcacttatcagatcttctttaaaaggatcacgggcttcttatggccgcaagctttcagtgtctgtcaacaatgatctggttcattaaggagcattcatacatatttgcttattttgattatataatgcattcagtgcttgaaaattatatgacataagaatctaatggtggttgtgatgacagacatgcatttcatcataattttgttgatgaaatatcaaggtcttaaggttgacctgttgtattttgtggtaatgatgtgaatattaaccctacaactattatgttgcggtcatcattaaatttcttagctcttacaaagtattaaccttac

SEQ ID NO: 68075 - DNA, 253 bp, Zea mays
  Clone ID: LIB3076-012-Q1-K1-D1
tcgggcagagtttctgctttatgtactctgttgagaaccctctcttccgtgatggtatgagtgatttggacaagttgttatatcgcccacgctttactggtgtgggagcacaaatccttggtgcggacgataagtacatatgccagttctctgagaaatcaaacaatttttggggaagtaggcatgaactaatgctgggaaacactttcattttcaataaagagtcaaccccaccgcaaggggaggtgccccc

SEQ ID NO: 68076 - DNA, 456 bp, Zea mays
  Clone ID: LIB3076-012-Q1-K1-D12
aacgaagagattgtctttgtctcagggggaaattgttttcaacattgggaagagtgtagttgatgacaaatctgatactcttgcatgcaaacggcctggattacagaaagaaggatcaaaggttgtctatggtgttccaaaacatggaaagaagaagtttatggaagtaagcaaacattattacgcaggccagtttgacaagatttctgagggtaatgcatctaacagatttgtgaaacatctggtgacgcaattgccaagggaacgtgaaaatgattccaaagttgatcctattagaggaaggagagtgggtgagacgaggtctagattacctaaacctacgaagtctcagagcgttcgagctagcagtgctcctggaaatgattccttccccatgcatgttcagaatacttgtgtttctcaaaggagttttggttttgcgggaagttcgacaag

SEQ ID NO: 68077 - DNA, 309 bp, Zea mays
  Clone ID: LIB3076-012-Q1-K1-D2
ggcgcgtgcgggcagagtttctgctttatgtactctggtgagaaccctctcttccgtgatggtatgagtgggttggacaagttgttatatcggccacgctttactggtgagggagcacaaatccttggtgcggacgataagtacatatgccaggtctctgagaaatcaaacaatttttggggaagtaggcatgaactaatgctgggaaacactttgatttgcaataaggagtcaaccccacctgcatgggaggtgccccctgaggatagctctaggcgtgtttaggaagggttccaagtcaccccaata

SEQ ID NO: 68078 - DNA, 451 bp, Zea mays
  Clone ID: LIB3076-012-Q1-K1-A11
gtacgctgctgtacatgctgctacgagcctacgatcgatagcagtctatgcctatgctcgatgccgatgtttatctgcatgtgatcgtattcgtatgcacggtcctctcaagctgagtgctttttggtgggtccatcgtcctatatatacgctcatcagttcactgacgactatataacgattgttggggttcagaaactacatatggtggtgctcgcccgatctctttcttgtatattcttcttattattagtctacttctctctctctctctctctctctgaaagaacaaggaactagatgtctcgtcttgtgcctcctactatacctttacgtgttgttcttccttttgtcgtccatggcttttcaccggtctgctgggtgaagtgaagtaatttacacgcatgtcttacgcacgcgctacttcagttgtccgcatatctgatcataa

SEQ ID NO: 68079 - DNA, 385 bp, Zea mays
  Clone ID: LIB3076-011-Q1-K1-C9
gcgcggacgcgtggggtccactcatgagaggcacggcaccagagctgcagctgcacatggccaggtcccgggccggacctcgatcgcccaggccggcctcctccctcgccgccggcgccgccatggaccgcaagagcaagtacgccaagggcgccgcgagctcggcagccgcgttcatggacgcgctcgccgcagccgccgcggaccccgacagcaggtcgggccccgcccgcggcgggtgtcgatgcggcagggggaagctgccctccgaggtgccactcggagcggtgcaaaaccaacccggtgaccgccgggaattcgaacaaccggacgaacctggagagcgacgggcactccaaggcccccggagatgctgtacgcgctc

SEQ ID NO: 68080 - DNA, 408 bp, Zea mays
  Clone ID: LIB3076-011-Q1-K1-D4
cctttaaccgtccctgtccgcgaatttctagatgccccgatcgcttccgattttttcctggatttctccgattttttgaagtatttttccttggggacggtttcattgccattcctcgacggggttagggtttgcggggatgagggtgcacggcgaggtgtcggacgatgaggcggccgtggctgtggttggggaaacggtgccctcctcgccgcctcccgcctacgtggtgcagccgctggtggtggggtacgccctcaccaagaagaatgtcaagagcttcctgcagcccaagctgcttgcgctggccaggaagaaaggcattcattttgtatcaattgattgagacttttggggccccctctctgaacaaggtccattggacatatttttgcacaagcttactat

SEQ ID NO: 68081 - DNA, 378 bp, Zea mays
  Clone ID: LIB3076-011-Q1-K1-E1
cccacgcgtccgcccacgcgtccgaggcatatgaagaacatgtaccacgtttggaaatgactgtacctgctagtggcatctcaaaagtaatgggaaaacatggcacaaacttggacaacattagaaagatttctggagctcacattgaaattattgaaccaaaatcctctcgtcatgagcatattgcttacatatctggaacctctgaacagaggcattcggctgagaatttgatcaaagctttcataatggctacctaagattccttctgtggtctgagaacaccatttcatcaatttgatctcttttgacttctgctatccataatttccctgggtttgtgaaccattcaaaaaaacgtagtgttttcttccacct

SEQ ID NO: 68082 - DNA, 366 bp, Zea mays
  Clone ID: LIB3076-011-Q1-K1-E6
cgacatcacactaggctgtttgctaataaccacaacgatcagcgtacagttgatagaagcggaaacatactgcctggcaccgtggttgattcgaagatttgccatcctactgaatttgatttctacctgtgtagccatgctggcattcagggaacaagccgccctgctcattaccatgtcctgtgggacgagaacaagttcacagctgatgagctgcagactctgacaaacaacctatgctacacgtacgctaggtgcacccgctccgtgtcaatcgtgcccccggcatactatgctcatttgggggtctttcgagctcgcttctacatggagccagatacctttgacagtgggccttttttaatg

SEQ ID NO: 68083 - DNA, 459 bp, Zea mays
  Clone ID: LIB3076-011-Q1-K1-F10
gcttcattgctctgttcatggaccctctgtacttctatgtgcctgaaatcgattacaggcaaacctttcattgtgtcaggaaggatacacgcctagccatcatcgttactgtgttccgatcaattgtcgacctcttttatgtcatccagatgatgataaagttcaggactgcatatattaatccaagctcaaacttaggggtttttggtcgaggagatctcatcacagatcctaaggaaatcgcaaagcagtacttgagatctgactttgttgttgatttggtggcttctttgcctttaccacagatcattatttggtctgtgataccagctatcaaatattcttcgtctgagcatgggctggctgctagcatgctcggcttgggaagttggtgaagaacaaggtcttcgtggcaagagacgacttgtggtacaacaagaatattgacccctcgagcga

SEQ ID NO: 68084 - DNA, 442 bp, Zea mays
  Clone ID: LIB3076-011-Q1-K1-F11
gtttgttgctacaggtaagttacatcagttttctttcaatggttcgacgatgtacagatataacttgaaggttcctccatggtaccatagagaccctacataaaagaaagggggggggggttggttcagaaactttgaaagggttcttttatatagccccctttgaaaggggggctggagagagtactttgcagtttagcgtcaatacataaaagaaaggggagcttcttttatacagatacaacttgtagcatttccaaacagtccaggcagaggtatacaaggtatacaactgcttatttcatcacacgaccgcatatatgtcttgtagtatattaggtgtaatttagaatgtcttgtggcaaaggcaattttttaagtggcctaaggcaaagctcacatttggatgacaaatttggctttatttttttgcagtaatctt

SEQ ID NO: 68085 - DNA, 284 bp, Zea mays
  Clone ID: LIB3076-011-Q1-K1-F7
cgcctaggcgagcccgtgcgctggttggcctcccggacgcggccgcggcgggcgatgggggcgtcggcgccggtgagggcggcggtcggtacatgggatcccggctagaacccggcggtggggaggctgcgggagctcttcacaggcgacgcggtagatgggtgggagaagtcctgggagtttggtgcgaccccatgggatttgtgaaagccaacacctgtcattgaacatcttgctagatcaggatcactttctaatgggagagctttggtttctggatgtgg

SEQ ID NO: 68086 - DNA, 239 bp, Zea mays
  Clone ID: LIB3076-011-Q1-K1-G2
ctgcagtggcggcgcctacccccacgcgccttcggcttccgctcctctcccgcaccctgcgctctggtcactgtagaagctcttattcctccaggctcctacggttctcgtgcagtgccaccaccatgggagatgagacctcaacctcggttgctccccaggaacaggaattcactgtgcaagctgggagtgtcaagcaacagcttttcgggctggtccttatgtcccttcgggctact

SEQ ID NO: 68087 - DNA, 347 bp, Zea mays
  Clone ID: LIB3076-011-Q1-K1-G4
cggacgcgtggggaagattgcaaaactgcagtatgatggattccactattcatcaaccgagatcatggcgcgcttcaatcgtggctacgctgatggggaattgatccgttatggctcgtggctgtggagatgtggaactcattggttatagtgtgcttcaatcatgggtcatggcgatgctgatggaactgatttgttaccaaggtttaagtgttcgctaccgttggacggcctgactggtactttgccctgttgactgttttgagaacgtactggccaggtttacttaatacttgctgctttttgacggtactggacatattggtcgacaatttatttcttggcag

SEQ ID NO: 68088 - DNA, 336 bp, Zea mays
  Clone ID: LIB3076-011-Q1-K1-G7
cagctctcggcttctctctctcatcggcacacccgagctcgcgccctccttccacgtcgaggtccgagtcctgctttgatggcgaccgacgtgactgagactcccgcgccgttggtggatgcggccccagaggcgcccgccgacgccccggcggcgcctgctgccgacgcgaagccggccatggccaagaaggccaccgcgccgataaagcgcgccagcccgacccacccgtcgtacgccgagatggtctctgaggcgatcacgttgctcaaggagaggacggggtccagcagctacgcgattgccaagtttcgtggaggacaagctcaaggccaa

SEQ ID NO: 68089 - DNA, 343 bp, Zea mays
  Clone ID: LIB3076-011-Q1-K1-G9
tcaacgatggacagatcaaacgggtactggggtccgaggagccatgttaaacaaacctgttgatgagaaaaccatacagcgcttgactggggcagacaaaaagaagctaagaagaactgccaagggaaggtgttcacaagcttatgatgctgaccttgatgccatccttccttccaagggtgagataacagttgctaagcacccgaaccatgttcttgtatatggcatacaaggagagtatccaatgattcttaacactgacgcaagaggtcatgaactggttcctacagattatgccgctttggaagggaccccatatgttgccagcttttacgcttaaagg

SEQ ID NO: 68090 - DNA, 471 bp, Zea mays
  unsure at all n locations
  Clone ID: LIB3076-011-Q1-K1-H11
cccacgcgtccgacgtcactaccgtcccagaccagccgcgtacgcctgcccctgccctcggtcgcgatggaccagggccacctcaaggacagcctcctcgtcccgtcctcccgcgccgccgcgacgaatggcccccaccaccgccgcgccacgctcgcgccgggaactggcgccggaggcccatgtggcggagccggcggcgtgtccatcgacgtcaacggcctgaagcggcgtggcggcgggaggcgctcgtgggtgcgcgtggacgcggcgacgggcgccgcggaggccgtcgaggtcgccaagccggcgttgatgcggcggctggacctgcccgcgcgggaccttcgtctnctcgaccccctcttcgtctacccgtccgccatcctcggccgcgagcgcgccgtcgtctgcaacctcgagcacctgcggtgcatcatcaccgccgatgaagcgctcgttctgcgcgaa

SEQ ID NO: 68091 - DNA, 358 bp, Zea mays
  Clone ID: LIB3076-011-Q1-K1-H12
gttcttcagtaggcagaggtgctagcattccagatgttgagcaccacagctcaattccaagctttgatggaccctcagaaaatgaatccaacattctttttgttgattgtcttcctactgattgcacaaggagagaagtagctcatttgtttcgttgttttcctggcttcaaggacatcagagtagtgcacaaggaacccagacgtagtggtgacaaggcctatgtcctgtgctttgtggagtttgagaacgcgaaattcgcacgcactcccatgcaagctttacaagggtaccgcttcgatgaccggaagcctgacgaccggtgtctcgagatccatttcgcaaggttcccgttcgc

SEQ ID NO: 68092 - DNA, 328 bp, Zea mays
  Clone ID: LIB3076-011-Q1-K1-H8
cactatccaagattccttttacttcaatgtgctcccatttgctgaggacatcagagagtttcagtttcggtccttcagcagcctgccatcatcatctcagcccactgaagaacaacaagaagctgcagataacctactgaagatgttagacctagcaccacctggaagagaggtcctcaagcctgagtttacgccaaatcccatcttggagagatgttacagttaccttgatctcaagtcaaagcagccagatgcaaatgtcccaccggttgaaagatctctaagggggataaccgaaccctgtcctgatgtggttggccaacaaaca

SEQ ID NO: 68093 - DNA, 298 bp, Zea mays
  Clone ID: LIB3076-011-Q1-K1-H9
aaaaaagaaagaaaaaaaaggaaggaaaaaaaaaaaaaaaaaaaaaaaaaaaagaaaaaaaaaaaaaagaaaaaagaagaaaagagaaaaaaaaaaagaaaagaaaaaaagaagaaaaaaagaaagaagaaaagaaagaaggaaaaaaaaaaagaagaaaaaaaaaaaaaaaaaaaaaaaagaaaaaaaaagaaaaaaaaaaaaagaaaaaaaaaaaaaaaaaaagaaaaaaaaaaaaaaaaaaagaagaaagaaaaaagaaagaaaaaaaagaaaaaaaaaagaaagagaagagaac

SEQ ID NO: 68094 - DNA, 363 bp, Zea mays
  Clone ID: LIB3076-012-Q1-K1-A10
cccacgcgtccggccagatttactaactctttgactttgaaggccacaatggggcaactggtggttaccacggacatggatggtcaagtagaacccacttgactttgctatgtccacatttatcgtatcggctctacatttacgtctgtattatcgcttttatgattggatgatgatgctattcttgatagatgttacacgattttggaggcgcttagcctccctttgatattcattcttgttaggagatactgcaatacattgctatcatatgtgttatatactgtgattacaatgcaacagtctaggttgtatcaaacaaatacttataatgctggccaactctaaagcattgtgaagtgt

SEQ ID NO: 68095 - DNA, 439 bp, Zea mays
  Clone ID: LIB3076-011-Q1-K1-C8
cctctagccgtctcgcgcagccacagcctccatttctcctccgacggcggtgcggctagctcaaccatggcggactccaaggccacctcggcggtcaccctccgcactcgcaagttcatgaccaaccgcctgctggcccgcaaacaatttgtgcttgaggttatccaccccggccgcgccaacgtctccaaggcggagttgaaggagaggcttgccaagatgtacgaggtgaaggaccccaacaccatcttcgtcttcaagttccgcacccacttcggtggaggcaagtccactggcttcggcctcatctacgataacctcgagtctgccaagaagttcgagcccaaataaccggccttttccatcaggaatggtcttgctactaatgttgagaagtcccgcaagcaaatgaaagagcggaagaacagggccaagaaga

SEQ ID NO: 68096 - DNA, 339 bp, Zea mays
  Clone ID: LIB3076-010-Q1-K1-H4
actcgagaatggacgctttggcgctgggacttcctggtttacgatgagatccacgaacacggggacaggaggaagttgaccggccacagggagaatgagtcggacgacttcatcgacatcttactctccagatacgaggagtacggcttcaccatggataacgtcaagtccctcctcatgaacgtgttccaggcatccatcgagacctcatatctggtgctggagtccgccatggcctagctcatgaaccacaagcgcgtcatgaagaacctgcaaacgtgaagtactgtcgtacggagcgcaaaacaagctggacattatcacggaggaccacctgag

SEQ ID NO: 68097 - DNA, 330 bp, Zea mays
  Clone ID: LIB3076-010-Q1-K1-H6
ctgacgcgtgggctctgggacttcctgctttaggaggtgatccaagatcacggggataggaagaatctgaacggcaacagggagaatgaatcagacgacttcatttacatattactctacagatactaagagtactgcttcaccatagataacgttaagtgccttctcatgaacttgttctatgcaaccatcgagacctcatatctggtgctggaattcgccatggccgagcttatgaaccacaggaccgtcatgaagaaactgcaagctgaagtacaggcgtactgagcttataacaagctggacatgatcagtgaggactaccttagc

SEQ ID NO: 68098 - DNA, 231 bp, Zea mays
  Clone ID: LIB3076-010-Q1-K1-H8
acaatggacctatgggcgctgggactatgtgatctaggatgagattgattgcatcgagttacagctctggttacatgtgaggttgtaaaatcagtatggaattatggatgagtgtaccaaccttaatgtacccgttcaagattatggaggtatctttgcgtacaaataataatgaacgagttcaaagcaaacatatagaccttataatatggtgctggagtccgccatggc

SEQ ID NO: 68099 - DNA, 430 bp, Zea mays
  Clone ID: LIB3076-011-Q1-K1-A10
cggacgagtgggcggacgcgtgggttaatggcaggcatgcatatataccatttcataggggaacatctacaaggaacaaggtgaggataactgacaggatgtgggcgaggctgctgtcttcaaccaaccaaccgagtttcctgagccagaaggacatcgacgcggccagagaagccgacaaggcggccaaccgcatgaagagcagagaggacgcgaagaagcaatctacaccagtgttggcaaatggtgagaaatagtgtgcttttgacggttctttgttgtatgcagtagctgctgcaagctggctgagatcagtaggccaaaactgcgaggtcgatgagttttacttccatttgcatgcgaacagaattcacgtaataaaagcttcatagtgtgtatttgcgttagtaaacatatactggtgcgctgc

SEQ ID NO: 68100 - DNA, 369 bp, Zea mays
  Clone ID: LIB3076-011-Q1-K1-A11
acgggtccgccgtgctgcagcataggcacggggttgccgctctcgccgccgtacgctgctgctgtgctttgctccgtctgatccttcctgcggaccttgttttatcctctcgttccacgtggtcagccttggttttgcagagctcattcagtggcctctgctgaaaagtgttcaatggcgtcaggagccaccttaagctgggttaaaaccccatttgacacccgaagatttcatgacctatctaatctaagtttccgctgccgaaacccttttggatcaattcagccctggtggctgcaaactgatcaagactgatacctaatcaacgatcacgtggctgctgattattcagactcaatgccagattca

SEQ ID NO: 68101 - DNA, 468 bp, Zea mays
  Clone ID: LIB3076-011-Q1-K1-A12
acggcgcagccagagagatcggagaaggggaagaagatggtgcgggtggcgacctacttcgcggggaccttcggggcgttcctcttctggcagtccatggacagggtccacgtctggatcgcccttcaccaggacgagaagaaagaaaggatggaaagggagctggagataaagagaatgcaggcagagttactggcccaagctaaagagaatgaatcatgattgtcatttgtccaatggtttcaggcagttcctttatcgtatttcctctgctgtattttccatgcaatatcttgactgatgtatgctcatgctcagcacctccaataaagcgagacatgctatagcattgttgaatgcaagtgggtatgcagtttgcagtatgcttatgttgaattgatgtaacttagccgaactgaaagaggctgccccagcttgattggaacagaggaatttgctgctggtttt

SEQ ID NO: 68102 - DNA, 399 bp, Zea mays
  Clone ID: LIB3076-011-Q1-K1-A3
cggacgcgtgggcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgaagtaaatttgtcgtggagtccaccggcgtcttcactgacaaggacaaggctgc

SEQ ID NO: 68103 - DNA, 257 bp, Zea mays
  Clone ID: LIB3076-011-Q1-K1-A9
cacccactgtagcacaaggccttgcaaggcactctccgctgggtactcagcaactgtgctgtggacaagcgccaccagctatgatgccccctcagtcaggatttgctttccagcgacagcttggtccaggcatgacgcctgagggggcccatatgccaaagtattatgtggcggctgtacaacacggacaacagggtccacgcccatgtattacgcgtggagctggagaccaatgtcagcaacctgtgccaccattt

SEQ ID NO: 68104 - DNA, 393 bp, Zea mays
  Clone ID: LIB3076-011-Q1-K1-B12
cccacgcgtccggtttccctctttgaataacagcggaaacacatcaccatgaccagctcggggccaggcatatttctctgatgcaaactcacacaaacttggtgctatagtctacatcacgatcctaaaccatctgatcaataaccaaaactagtactgcatggaggttactccaaagactctggctgactttaatcggtggcactctcatctattacgaatgaagagtttatcttttgatagattgccctagtatccgatgagcatgtgaatgaattcaaatcaatctataagtttaagaaattcaacactatacaactcttgggtgaaccttaaagctttcaattagacttttagaggctgaatcacttaaaactgtattcttttcaaacc

SEQ ID NO: 68105 - DNA, 435 bp, Zea mays
  Clone ID: LIB3076-011-Q1-K1-B2
cggacgcgtgggggaagattgcgagcatctggccgtccttatgtggcctatcacccaggactgcttagagatactctagctttttatggttgcgctgaactgttccaggatattcatacagagcttattcagtatagaaggaatcagatgattaaacgaggaacagtaaaggagcagctagcagttgattcagtgtccaggaagatggctggtttgtgtccactcatgccagaagaggttggacttctacttcaagcagtaggttacccaccaactacaataatattcttggccggttctgagacttttggtggacaaagaatgcttattcctctacgagctattgtttccggggctaacctagtagaccgcacttcattatgtagtcagagggagctgtttgatttaattgggccagaggatcctcgaacccca

SEQ ID NO: 68106 - DNA, 57 bp, Zea mays
  Clone ID: LIB3076-011-Q1-K1-B3
tccacccgtccgccaacccgtcctactagttctagatcgcaagcggccgcccttatt

SEQ ID NO: 68107 - DNA, 403 bp, Zea mays
  Clone ID: LIB3076-011-Q1-K1-B4
aaagaacaagaaactgatccttgggccagcaagatgtcttctactgtgtgtgctgatgacaagaaaggtagctggaacactacagcaaagggcattccatctaaggaaaaggctgatgatccatggaatagtaaggggggtaatgatgacagcaagaaaactgacacctggggtgctggctcgtcaggtggggatcaggaactttcttggagcaaacctaatttctctttgggggaccaggaatctacttggaacaacccaaggttcagtgacgatgacaatgcgaataatagaggtggatttggacgtggaaatcgaggcaaagggagaggaaggaattttggggattggggggtggtgggtcatcatggaatggaggcaatagaaacgatgaatcaggtgg

SEQ ID NO: 68108 - DNA, 413 bp, Zea mays
  Clone ID: LIB3076-011-Q1-K1-B5
cccacgcgtccgctcctggagagctcctcctcccggatgccatccccgtgacgctcccagccgcctctcccgacgccatccccacgagcgccttctccgacgccgtctccgctccgccgcattctccgacgccgtctccgctccgccgtcttctccgacgtcgtcaccttcccctcgacaaggttgcttagaagcagtgtgcagtgatgcgaggcatggatgcgagagtgcaaagtggaagcaacacatgaagtcgacatggagaaggaaaatgcaatgacagtccacatgaaacttgggaaaaaagaattaaatcccaaagttcctaatgaagagacttggaaattttttacagttttatgttatattggctatctatttgtgtgaatggagatgaccttgctggatggatt

SEQ ID NO: 68109 - DNA, 439 bp, Zea mays
  Clone ID: LIB3076-011-Q1-K1-B6
ggcggcggcgcccggctctgctcggacggactccaccgaaggctcggctcccctcggacggcacctgcgacggccggccctctgcctgcaccgacggtgcccggctccctcggcatccaccagcggtgcccgactccaagaaatgtacaagtcacggctgcaggagctgtgccagaagcggcgatgggcgccgccgttgtacgagcctacccgagagggtcctgcccacgcgcccctcttccgcgccactgtcgtcgtgaatggcgagaggttcagttcccgggatgaaggggagaagtcactcaaggaggcgtacaacctcgcggtgatggccgccttcgacaacctcaatcggcggggcttccggcccgggcccttggccctgccccggctgctccagcgccggccttatccgagacccagctgtcttaccagagtc

SEQ ID NO: 68110 - DNA, 283 bp, Zea mays
  Clone ID: LIB3076-011-Q1-K1-B9
acggggaatcaaggggttgactaaactgctgacggaccatgcgcccaacgctacgaacgaggcgaagaacgagaactacttcgggcgctaaatcggccgcgaaatcagcatgagcatataccagagcctgaacgaagttcggaggacaggcatggagactctcacagatgcagctggagaagacactagtgaattgcctagaaagttgcaccggacgatcagactaccggtaacagtaatggaagcaggttatgagccagatggcgagccttatggtatgaat

SEQ ID NO: 68111 - DNA, 291 bp, Zea mays
  Clone ID: LIB3076-011-Q1-K1-C1
cggacgcgtgggtgaagtttatgctcaaattatgttgcagccagaagctgatcaaaatgaactcaccagcctggacgctgaaccacaagaacgtgaaaaatgcactgcccattccttctgcaagacactgacagcttcagatacgagcactcacggcgggttttctgttcttcggaggcatgctgaggaatgtctttctcagctggacatgtctcaaaatccaccttgccaagaactggttgccaaagatcttcatgggactgaatggcattttcggcacaattttcgagg

SEQ ID NO: 68112 - DNA, 166 bp, Zea mays
  Clone ID: LIB3076-010-Q1-K1-H3
cttgagaatggtctatgcctttatggtttaggctagcaagtcttagattggttgcataaaattacatctctggttacatgtgaggttgtaaaatcagtatggaattatggatgagtgtaccaaccttaatgtacccgttcaagattatggtggtatctttgcgtac

SEQ ID NO: 68113 - DNA, 390 bp, Zea mays
  Clone ID: LIB3076-011-Q1-K1-C11
gaccggttgcttaactatgtaaacgaagagttggcagaaagcgacgtttacatgtcttacgttcctcttgcacacatctttgatcgtgttgtggaggaattgtttattttccatggtgcctctattggattctggcaaggggatgttaagctactagttgaagatattggtgtgctgaaaccaacaattatgtgtgctgttcctcgtgttcttgatcggatattttctggactacaagctaaaatttcctctggtgggtttttaaagagtacaatgtttaatcttgcttacaaattcaagcagtttagaatgatgagaggagctaagcacaatgaagctgcttccatatgtgacaaaatagtttttagtaaggtgaaagatggtcttggt

SEQ ID NO: 68114 - DNA, 212 bp, Zea mays
  Clone ID: LIB3076-011-Q1-K1-C6
cggacgcgtgggtggtcagagcgcaacgggttcttccaacgaaaaccagatacttgtgcctgccacctggtgattccggtgcccaaacaacctgcccaacgctcaacgatgttgggacgcctttagccgctaccacttctcctctggaaatgtcaagaacaaacagtgagggtcttactttcttggagtacgtttcaccctagttcttctcc

SEQ ID NO: 68115 - DNA, 260 bp, Zea mays
  Clone ID: LIB3076-010-Q1-K1-F4
acgcacgcgttcgcctgactgcgcgctccacatgtacatttacgcctctcgcctctcgccatggcgccgggatctatgacgcgcgtatagggagaggcttacctcttgcctccacagctacaacgagccccctgcccctccgtctcaaataccacgcgccctgatggacgacgtccacgccatggatgcggatctgtggatctccaaagtcaaggagggccagaacccattcgatcacaaacttaactaccactattaat

SEQ ID NO: 68116 - DNA, 441 bp, Zea mays
  Clone ID: LIB3076-010-Q1-K1-F5
cggacgcgtgggcggacgcgtgggccagattcaaatgcaagtgtcttttatggtaggatgaagcgtctttgtgaaactgagcttggtttagtaactcaatgttgtcaacctaagaatgtttttaaaggtggccgacaatatctccaaaacctggctcttaaaattaatgttaaggttggtggccgtaatacagttctcgaagatgctttaaataggagaatacatttgttaacagatttacctacaattatctttggagctgatgttacccacccagctccaggggaagatgcatcctcgtctattgcagcgagatggtgtcagtgaggggcaagtttttttttagccaggtcttgctttatgaagtggatgcaattcgaaaggcgtgtgccagcttggaagagggctacctttcttcaattacattcattgtggtgcaaa

SEQ ID NO: 68117 - DNA, 441 bp, Zea mays
  unsure at all n locations
  Clone ID: LIB3076-010-Q1-K1-F6
ctcgcctcctgtcccctccccggctcctcgttcccctctcgccgctcgcctcgccgccgagatcgaggaggcgccaatagcgagagggtttcctcttccctccacggctccaacgagcccccggcccctccgcctcaaatcccacgcgcccggttggccgccgcccccgccatggatgtggatctgtggatctccaaggtcaaggagggccagcacctcgccgagcacgagcttcagtcgctctgcgaatacgtgaaggagatcctcatcgaagagtcgaacgttcaaccggtgaatagccctgtgacggtttgcggtgacatccatgggccaaaggnttttccatgacctgatgaagctcttcgcgacggggggccacgtcccagagacgaactatattttcatgggtgattntgtggaccgtggcttcaacagtctgga

SEQ ID NO: 68118 - DNA, 425 bp, Zea mays
  unsure at all n locations
  Clone ID: LIB3076-010-Q1-K1-F7
gccgagttcatccgctcgggggactcggatcaaaacggttatccggatggctcagagaggccgtatgagaggttgtctattatcagcaaaggcctgcaatttcaagaggctgacggtgacggatcaccatcacctgaatcatctgctcggaaggatacaaacccaatcttagtatcctccaagtcgaggagagtgaggtttgtgctcccagaaaatgcgcagatcaacagccaagtgcgcaacgagctgcaagagctgactgaggcaagagaggcaggcatgtccttcatcatggggcgctcgtatatgaaggcgaaaagtgggtctagccttgatngnaaaaaagcggattgccataaacttcatctatgagttcctgacgaggaatagccgaggtcccgnctacgcggctaacgtgccacatg

SEQ ID NO: 68119 - DNA, 329 bp, Zea mays
  Clone ID: LIB3076-010-Q1-K1-F8
gatgaagttaaagaactgagggttcgggctaatgaaatacctgatgaatactgggtttggttaattggtgatatggttactgaggaagccttacctacataccaaacaatgcttaacactcttgatggagtccgggatgaaactggtgcaagtccaaccacgtgggcggtttggacaagggcatggacagctgaagagaacagacatggtgaccttcttaacaagtacatgtaccttactggaccggttgacatgaaacaaattgagaagaccatacaatatctgattggttcccgaatggatcctggaactgagaacaacccctactt

SEQ ID NO: 68120 - DNA, 435 bp, Zea mays
  unsure at all n locations
  Clone ID: LIB3076-010-Q1-K1-G1
aaaaaattttggaatcttatgctaaatcatggacgtctggtgtcctggacaaagctttacagcgtgattccatggccttcacattggcaaagcatcacctttcaggctttgtcttccagtccagcgattctggcacaatgctgcgaaaaaaactggtcaaatcgcttatccggtgctatgcacagaagcggcatcatgaggttatgcttaagtgcttcgttcagcaaggcatcgcacaggattccaagagcagtgagcttgaccggagatttgaaatcttgaaggatgcttgtgagatgaactccaacctcgtaggtgaagtccatagacttttgnnaaaggcatgtcttggccaatgaagccagatatttaagtgtgtcattaacttggcagcgttagttgttgggaaagctcgacaaagtggcccaaaatatg

SEQ ID NO: 68121 - DNA, 252 bp, Zea mays
  Clone ID: LIB3076-010-Q1-K1-G10
aaaagacatgtctcccaaaacaactatataatcactataacataattcagttcaaaagacatacagatccccccagaaaaccagatgtcattatgagactttacctccactttacctctctacatagtcaaaacaaagaacatgaaaataagaatacttaaaaacttcttaattggactaagtatattctaacttctaaaattcactacaacactcaataactattatcttaacagaattaacaaaatccaa

SEQ ID NO: 68122 - DNA, 387 bp, Zea mays
  Clone ID: LIB3076-010-Q1-K1-G12
cactcgtcctgtctgtacttttaagaacattctcaaaagttcatgtcaaagccatgtctacctgtaattttataaatatcatcttgccactgtcaaatccaacctctcattcttaatgtactactaataaaacatataactctactcaacgacgaataatattctccactatcaatccatttgaccactaatactactatccaaaagtatttctaccttgacactctaacaactcctacattatccctacatatttccttcctcttattatctctatatccatcacactccactattacatgctacttaccaactcataagcactagctactcatgccacacatgaaaacttttacaatatatcaatcttacctcccttcaccaaca

SEQ ID NO: 68123 - DNA, 450 bp, Zea mays
  Clone ID: LIB3076-010-Q1-K1-G2
gtgcccacacgaagatgcaaaatggtggcacataatatactttaggcttgaagttcttctgcatttcaagaaggcatttccatctgaagaattgttatctgcaggagacaacaaagctgttgagtctgtttgcaggatactcagggctttttatcatgctgtcgaagtgatttgtagtcctatctgccccacagcaaatgtgtacttcaatgaactgtggaaagttagaacagttttgcaagaagaagcatcaactgatctcattgaacttgctaacatggtttgggagatgcaggaagcattcaatgagtactggcaaaattcatacttgtggcttttttcccgggaatacctgttgttcttgatcccagattcaaaattacttttatcgagttccgtttaaagcgagcttttggtaccaatgcggaaaagtatgtatctgccattcgg

SEQ ID NO: 68124 - DNA, 441 bp, Zea mays
  Clone ID: LIB3076-010-Q1-K1-G3
gttatgctttactaatcgtcctgccctttctctctaatttccccccttctcctttcgctgcttgcttgtggctgtgacaggaatactagaagccaaggaaaagtgatgttggatttataggagaaaaaaaaggagattgaatggcaacataatggtagcttccactttcttttggtcttttagtccctacctttttaggggataggtctacttaaccacaagaggagaagatgccattagccttgattaagaaaaccgcggcatatgccatattatcggcagatattagtatatatatattatatataccaataattccctatattctagatttaaatttatatatagtatctgtacttagtatttaacagtagcaggtaacgtcagcccaaagatttttactgtgacaaggtcctacaactacagccaccttcactaggt

SEQ ID NO: 68125 - DNA, 316 bp, Zea mays
  Clone ID: LIB3076-010-Q1-K1-G4
gtcatgagactaagcttcaggatgttggctcatagtttactgtaggctctgatcactacgtgcatttggagaatgcatttcggtctggagaatagttatctgctagatacaacacaactgttgagtctgtttacaggatactcaaggctacttatgatactgccgaaacgatttctagtcctatatggcccacatcagatgtgtactacaatgaactgggcatagttagcaacagctttgacgtaaatgcatgaactgaactaaacaacttgctaacatgatacagggagatgcaggatgcattcaatgatgtact

SEQ ID NO: 68126 - DNA, 358 bp, Zea mays
  Clone ID: LIB3076-010-Q1-K1-G5
gccacgcgtccgaccacgcgtccgtccacgcgtccggccacgcgtgcgcgcacgcgttcggggacgcgtgggcgcacttgttacatttggagagccataatgcatttgggctttcagacagtgaagaatcacaggaacctaccaagcgacgcaatagactgggttcagcaggccttgcaccgtattacgccaatatcatcagtcagatcgatactcttggttctcgttcaagctctgttccttcaaatacaagggatacattataccaaagtttgccaccaaccataaagtcatctgtccgttctaagctacactgctttggagtcaacgaagagcctttttaaaactgtatctcaaa

SEQ ID NO: 68127 - DNA, 440 bp, Zea mays
  Clone ID: LIB3076-010-Q1-K1-G6
cccacgcgtccgggggaagcaagcgagagcagcagcaagcctcatcgggaagtggagagatggaggcggcaggtcgcctcctcctcctcatcgtcttcttcctcctcctgctcctctcgccggagcggccgtccgaggccgcgccgcggcgaatccagccgctcgccaccgtcgcgctgagccgtctctacgacacctgcaactacggcaggctgcagctcaacaacggcctcgcgctcactccccagatggcgtggaacagctggaatttcttcgcctgcaacattaacgagacggtcatccgccagacacctgatgcgctggtgtccaccggggtaaaaccctggctgcgctgggctacaacttcgtacatctcgatgattgctggtcatacctgaaacgagtgccgcaggatcaattgctgcctgatccaaagactt

SEQ ID NO: 68128 - DNA, 437 bp, Zea mays
  unsure at all n locations
  Clone ID: LIB3076-010-Q1-K1-G8
cccacgcgtccggcctccgcctgtcgagtctcgtccacccgtcgtcctcctagctcctgtactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggagaatncnccctccgtggggtgaggctggcgctgagtatgtcgtggagtccaccggcgtcttcactgacaaggacaaggctgctgcacatctcacgggtggtgccaa

SEQ ID NO: 68129 - DNA, 306 bp, Zea mays
  Clone ID: LIB3076-010-Q1-K1-H11
atacgctcactcttccgattcctatctatgtgcaattgagaaacgtcataaccaatctgatactatgtaacattccaatactgtcgagggcaagcaaaattaactgactcaagatcctatataaaacctgcactacttgcagacggtagaatccgacataatattagacaaatatatagacgatgaccatgccaataacattcttgccctcaagagcaatgagccagcaaatccagagaacatcaagcatgaaatgaataacgactaacagatccagaatcatacaactgataaagatactttcct

SEQ ID NO: 68130 - DNA, 438 bp, Zea mays
  Clone ID: LIB3076-010-Q1-K1-H12
cggacgcgtgggataactcctagcatgatagaaaatgttactgacctggaagcggagaggtggatttttaaatcgggttttgtccagtggttaatagctctgatactaggaacatatttcaaggttggatcatcgtatatagcactcatctggcttgtttctcctgcttttgcatatggttttttggaagctactctctcccctgttcggctacctaaacagcttaaggttgtcacgttggttgtgggtttggttgcaccagttgtgtcttctgctggtttggctgttcgtatggcggatgtaattgttggaagtatagtacgtattgacaggaatcctggcggactaccagactggcttggaaatgtaatagtttcggttgccattgctgctgtcgtttgttccacgtttgtgtatctgctttcatacattcatatc

SEQ ID NO: 68131 - DNA, 429 bp, Zea mays
  Clone ID: LIB3076-010-Q1-K1-F3
cccacgcgttcggtgtcatgctacactctaataataaacgagacttgctgtcagcaatggcaagcttatcaaaagaagccaaacaagatgcagctgttaagcatgcccttgcagttcatgcttctgttttatctggcaattacgttctatttttcaaactgtacaagaaggcacccaatttgaactcatgcctcatggatctatatgtggagcggatgcgcttcgaagctatgaaatgcatgtctaggtcatatcgcccaactgtacctgtgggatatgttgcacagattttggggttcatgagaactgatacaggctgtgcaactcaatggggagggggatgatggattagaagaatgcgaaaaatggttgaaagcgcatgggatagttctttcagaaggtaacagtggggaattacaaatagacatg

SEQ ID NO: 68132 - DNA, 302 bp, Zea mays
  Clone ID: LIB3076-010-Q1-K1-D3
ccggctcgacgcactcgtccgcctatgcgtgtgcccactcgttttcacattttctgcacgaggacgaccgaccgcgcacggtcatatccaacttgcttcaggggcttaaaactgatctgatatatcacatcatctaagcttccacgagaagtaaaagtttacatgacaaatctcacctatcaagcagacaggtacaatatgatccacaaaatcacaaacattgtagccactactgtaaactccctcacattcattgtccaagaatgaatccttctatcttttgcattccccaacgccatttg

SEQ ID NO: 68133 - DNA, 440 bp, Zea mays
  Clone ID: LIB3076-010-Q1-K1-D4
cctctctccgtcgccgcctcgggccaaaccctacgcagggagttgattgatcgattgcagccatgagtaagttgcattccgagcttctcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggctgagaagatgggacttgactacatggatgttgaggccctcaagaaaatgaaaaaacccaagaacaagaagcttgttaagaagcttgccaagagtaccatgcttttttggcatcagagaccatcatcaagcaaattccccgtcttcttggtcctg

SEQ ID NO: 68134 - DNA, 444 bp, Zea mays
  Clone ID: LIB3076-010-Q1-K1-D6
aattgacggacgcatccacgtgtctgcgtatccgcctcggcaccaaacttctacgcatggagttgattgatcgattgcggccatcagtcagttgcattcggagcttggcaaggattgcatatcccatatagttcatgatgccaagtaacaataggaagttcactgagactgttgaacttcagattactctgaagaattatgatccacataaggacaagcgtttcagtggctctgataagttgcctcacattcatagtccaaagatgaaggtgagcatgcttggtgatgcccatcacgttcaggatgctgagaagatgggacttgactacatggatgttgaggccctcaagaaaatgaaaaaaccccaagaacaagaagcttgttaagaagcttgcctagaagtaccatgcttctttggcatcagagaccatcatcaagcaaatt

SEQ ID NO: 68135 - DNA, 277 bp, Zea mays
  Clone ID: LIB3076-010-Q1-K1-D7
gcgtggccttagcccgcagccgacatatctgcctctttcgctctcggcggatatcccgagatgacgctcactggtgaatccgatggtaactggcgcaaaaatgcggcagagtacgctgcggagaacatgcccaagttttaggccgaggagttcaagaaggtgaacggcggacgagagatcgaaggagctgtcaagaggagttacctcaagactgacgaggagttcctaaagagggacgagagcggcagctcgtgctgcgtaacatccgttctacaaa

SEQ ID NO: 68136 - DNA, 431 bp, Zea mays
  Clone ID: LIB3076-010-Q1-K1-D8
cctctctccgtcgccgcctcgggccaaactctacgcatggagttgattgatcgattgcaggcatgagtaagttgcattccgagcttgtcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggctgagaagatgggacttgactacatggatgttgaggccctcaagaaaattgaaaaaccccaaagaacaagaagcttgttaagaagcttgccaagaagtaccatgcttttttggcatcagagaccatcatcaagcaaattccccgtc

SEQ ID NO: 68137 - DNA, 342 bp, Zea mays
  Clone ID: LIB3076-010-Q1-K1-D9
catgaacccataaaactataatttttccttctcaccacaactacactaatctggtccttgctacatcccagggcccatggggcccaaagcagccattcagccatctcaaaacaagccttctaccaagcacaacgcagtgaacacgaccaccatgaacacttcccatgccaaaaagaccctacccacgttccattcctacatcaccgatgcccaccataaaaaacagaacacacacgccacacataacttctatacctacaacatctacatactcaatgcacttacacagacgctccatcacctgcagctattctccaatgacatatacctcataaactcctt

SEQ ID NO: 68138 - DNA, 330 bp, Zea mays
  Clone ID: LIB3076-010-Q1-K1-E10
gacccactctaacacccaggcttccaccctacacccctctcaagtgttccatcccacccacacccatactcccaagaccatttctcaaattctcactgccccaagcacttcactactattccaacaccacctccccaatcttatactaccctccacacgcctacccccccctcaaatctatccttcacaaacgacatccaacaaaatacaaccaatatctacactcacctccatcactacatggatcaaaactacctacataactgctaactccccaactcccatatccttacaataaaacttattcacaatacgcaaacacaacaatca

SEQ ID NO: 68139 - DNA, 404 bp, Zea mays
  Clone ID: LIB3076-010-Q1-K1-E11
aggcccaggcgtccgccctccacccctcgcgagctctccacttcgccgccgcccatggtggcctggccaccggcaccgtcgcagtgtgccaagcacttcgctgctgggccgtcgccgccgccccaagctggtgctgggcgccgcacgccgaccccgccctcgtctggatccggcgggaacgggtgccaagaaaataaaaccatttgggtcggtgacctccagtactggatggatgaaaactacctacataactgcttcgggcccagcggcgaggtggttacaataaaagttatccgcaataggcaaacaggacagtcagaggggtatggatttgttgagttcttttctcatgcatcaacagagaaagctcttcagaattttaactgtcatttgatgccaaacac

SEQ ID NO: 68140 - DNA, 437 bp, Zea mays
  unsure at all n locations
  Clone ID: LIB3076-010-Q1-K1-E2
gtcgccatgaaccccatcaacaccgtctttgatgccaagcgtctcattggcaggaggttgagtgactcctctgtccagagtgatattaagctgtggcccttcaaggtcattcctgggcccggtgagaagccaatgatagttgttcagcacaagggggaggagaaacagtttgcagccgaagagatctcctctatggttctcatcaagatgcgtgagatcgctgaagcttaccttggcagcacgatcaagaatgctgttgtcacggtccctgcctatttcaacgactcgcagaggcaggccacaaaggatgctggggtgattgctggcctcaatgttggcccccttgcgtatcatcaatgagccaaccgctgctgctattgcctatggtcttgacaagaangcaaccagtgtcngtgagaagaatgtcctcatttttg

SEQ ID NO: 68141 - DNA, 365 bp, Zea mays
  Clone ID: LIB3076-010-Q1-K1-E3
ttttactcgagttacatgtcactgctacttttttcccggggtgcctttgatttgcgacagccagtatcagatgcgacaggggcacaagtaggatgagcggcgactatgctatatcgagagacacgggtgccaaggtcgttgtgctgcggtggtggcaggacatgaaggaaacgaaaaagcatgagccagggctgttcaacaacgtgaccgagtcacttaggcgaggaagagtaaggtgaatgcactcgtcgacgcctttgagactgacagagcgttatctagctgcaggaaaccatcaagcctgcttgctgctccagctattaaagtattggatattgtttcttgccatgagtgcttcttgacct

SEQ ID NO: 68142 - DNA, 445 bp, Zea mays
  Clone ID: LIB3076-010-Q1-K1-E5
gtcgccatgaaccccatcaacaccgtcttttatgcctagcgtctcattggcaggaggttgagtgactcctctgtccagagtgatattaagctgtggcccttcaaggtcattcctgggcccggtgagaagccaatgatagttgttcagcacaagggggaggagaaacagtttgcagccgaagagatctcctctatggttctcatcaagatgcgtgagatcgctgaagcttaccttggcagcacgatcaacaatgctgttgtcacggtccctgcctatttcaacgactcgcacaggcaggccacaaaggatgctggggtgattgctggcctcaaatggtcttgggtctgcgtatcatcaatgagccaaccgctgctgctattgcctatggtcttgacaagaaagcaaccagtgtctgtgagaagaatgttctcatttttgaccttgg

SEQ ID NO: 68143 - DNA, 433 bp, Zea mays
  unsure at all n locations
  Clone ID: LIB3076-010-Q1-K1-E6
ttttactcgagttacatgtcactgctacccctttcccggggtgcctttgatttgcgacatccaggagcagatgcgacaggatcacaagtaggaggagcggcgacgatgctatagcgagagacacgggtgccaaggtcgttgtgctgcggtggtggcaggacaggaaggaaacgaaaaagcaggagccagggctgttcaacaacgtgaccgagtcgctgaggcgaggaagagtaaggtgaaggcactcgtcgacgcctttgagactgacagagcgtcatctcgctgcaggaaaccagcaagcctgctgctgctccagctatgaaagtaaggttnggttttccgtgccatgagtgcttcttgacctgcagtgtgcatgatcacctttcttggaatttttggtcttttttggttgttagtgaccgtaaaagtggcg

SEQ ID NO: 68144 - DNA, 427 bp, Zea mays
  unsure at all n locations
  Clone ID: LIB3076-010-Q1-K1-E8
ctgcctcacgccgccgctcaaaccgcagaagagagaagagaagcacgcccaaaaattccgaggttttcacctcttggagcgcaccaacaccacccggagaccggagcgactcgccaccggcgcggaaaaggagggcggaggctcgatggcggatgagaatcaggctggaaagaaagaggaggaggaatttagcacaggccctctgtcagtcctaatgatgagtgttaagaacaacacccaggtcctcatcaattgtcgcaacaacaagaagctgcttggccgtgttcgtgcttttgatcgccactgtaacatggtgctcgagaacgtgcgtttggnaaaaggatgtggacagagatccccaagactggcaagggcaaaaagaaggctctgcctgtgaacaaggatagattcatcagtaagatgttcc

SEQ ID NO: 68145 - DNA, 388 bp, Zea mays
  Clone ID: LIB3076-010-Q1-K1-E9
cgtccaccctgcacccctcgcgagttctccacttcgccatcgcccatggtgccctggtcatctgttcaacgtctaaggtggccaagcacttcgctgctgggtcgtcggcgccgtcccaagctggtgcttggcgccgcacgccgaccgcggacctcgtctggatcctgcatcaacgggtgcgaagaaaataaaaccatttgggtcggtgacctccactactggatggatgaaaactacctacataactgcttcgggcccagcggctacgtggttacaataaaagatatccgcaataggcatacacgacagtcagaggcgtatggatatggagagtcgtttctcatgcatctgcataaacagctcttgatattttaactggtcatgtgat

SEQ ID NO: 68146 - DNA, 277 bp, Zea mays
  Clone ID: LIB3076-010-Q1-K1-F10
ccccccccccccccccacccccccaccccacccgccccccccaacctcccccccccccaaaaaccccccccccccacccccccccccccccccacacccccacccccaccccacccccacccacccaccccccacccccccccccccccccccccaacacccccccaccaccccccaccccccccacccccacaccccaccccctccaccccacccacccacccccacccctcccaacccccccccccccccacccccccccccccccccccccccc

SEQ ID NO: 68147 - DNA, 380 bp, Zea mays
  unsure at all n locations
  Clone ID: LIB3076-010-Q1-K1-F2
cggacgcgtgggcggacgcgtgggccagatgcaaatgcaagtgtctnttatggtangataaagcgtctntgtgaaactgaacttggtttagtaactcaatgttgtcaacctaagaatgtttttaaaggtggccgacaatatctccaaaacctggctcttaaaattaatgttaaggttggtggccgtaatacagttctcgaagatgctttaaataggagaatacatttgttaacagatttacctacaattatctttggagctgatgttacccacccagctccaggggaagatgcatccccgtctattgcagcgagatggtgtcagtgaagggcaagtttttttttaagccaggtcttgctttatgaagtggatgcaattcg

SEQ ID NO: 68148 - DNA, 330 bp, Zea mays
  Clone ID: LIB3076-010-Q1-K1-D2
actaactgccaccgacgcgccctcgccgctatgatctccctgctccgacgcgccctcggggcctcggcctccgcctcgtaggctgcggccacgtaccggagactcctcgtcgtcgtgccactctctccgcccgcggcccctccaggcccatgccaggcgcccgcggcagggtcgcaggagccgccgaggcgggcgttccactgttctacgccccccctggggttcaggtccacccccgcgtcgtgggccggtccctatccgggggagggcgagggcgagggcgtggatactggggctgagaaggggctggagatcgcgaggctggggacc

SEQ ID NO: 68149 - DNA, 430 bp, Zea mays
  Clone ID: LIB3076-010-Q1-K1-B2
cttatgtccatgtacgataagatacccaatgtagtcatttgcgcagttggaggtccagagaactgggaggcagggcttgggggcattaaaagcatgaggttatctggtgaagcccccgtagatacgaagggctgtgaaaaagctggttctctccttccacccaaggaaagaagatttgcagttctgatatcaactatgatgtcaagccagacaaaagatgaagttacacatgctgctgtggaacgcctctctgaaaacggtttacttgatccggatgctatagtgaggactgatgagaccacgcttgcgaatcttatcaaacctgtcggaattttcccctatcagcgaaaggcgcagttcataaaagaagcttctaaaatttgccttgagcgctttggaagggatatttcggattctctgaatgaactgc

SEQ ID NO: 68150 - DNA, 430 bp, Zea mays
  unsure at all n locations
  Clone ID: LIB3076-010-Q1-K1-B3
ggaaagttgatcgagaagtcttggtagacatggagcagatccagtactccgagaagtactacgacgacacctatgaatacaggcacgtcgtcctcccgcccgaggtcgccaagctcctccccaggaacatccttctctccgagaagcagtggcggttggtgggtgtgcagcagagccgcgggtgggtgcactactcgatccaccggccggagccgcacatcatgctgttccgccggccgatcaactaccagcagcaggaggaggaagcggctgccgcgcatgtgctgcccaagtgaagcctctgctggcgaccaggaatgttaaaaactctncactctagccctcttttcatctctaaaaggggcgtcactgttgtgttgattaatccctctggctgttgattggaaacttgggatctagttgggtcgac

SEQ ID NO: 68151 - DNA, 462 bp, Zea mays
  unsure at all n locations
  Clone ID: LIB3076-010-Q1-K1-B4
gacggatgcatccacgcatccgcttatgtccatgtacgataagattcccattttagtcatttgcgcagttggagcgccagagaactggtaggcagggcttgggggcattaaaagcatgaggttatctggtgaagcccccgtagatacgaagggctgtgaaaaagctggttctctccttccacccaaggaaagaagatttgcagttctgatatcaactatgatgtcaagccagacaaaagatgaagttacacatgctgctgtggaacgcctctctgaaaacggtttacttgatccggatgctatagtgaggactgatgagaccacgcttgcgaatcttatcaaacctgtcggaaatttttncctatcagcgaaaggcgcagttcataaaagaagcttctaaaatttgccttgagcgctttggaggggatattccggattctctgaatgaactgcttgctctga

SEQ ID NO: 68152 - DNA, 438 bp, Zea mays
  unsure at all n locations
  Clone ID: LIB3076-010-Q1-K1-B6
cttatgtccatgtacgataagaaacccaaagtagtcatttgcgcagttggagctccagagaactgggaggcagttcttggaggcattaaaagcatgaggttatctggtgaagcccccgtagatacgaagggctgtgaaaaagctggttctctccttccacccaaggaaagaagatttgcagttctgatatcaactatgatgtcaagccagacaaaagatgaagttacacatgctgctgtggaacgcctctctgaaaacggtttacttgatccggatgctatagtgaggactgatgagaccacgcttgcgaatcttatcaaacctgtcnggattttttncctatcagcgaaaggcgcagttcataaaagaagcttctaaaatttgccttgagcgctttggaggggatattccggattctctgaatgaactgcttgctct

SEQ ID NO: 68153 - DNA, 336 bp, Zea mays
  Clone ID: LIB3076-010-Q1-K1-B8
gtcaagtggatcgacaagtcgagttagacatggagcagatccagtactccaggaagtacgacgacgacacctatgaatacgggcacgaaaaccttccggccgaggtcgccaagctcctccccaacaacatgcttctatacgagaagcagtggccgttgatgggagtgcagaagagccgcaggtgggagcactactctatccaccagccagagccgcacataatgctgatacgccgcccgatcaactaccagtagcaagaggaggaagcggctgcctagcatgtgctggacaagtgaaacctctgctggcgaccatgaatgataaaaaccgattttt

SEQ ID NO: 68154 - DNA, 434 bp, Zea mays
  Clone ID: LIB3076-010-Q1-K1-C1
cgcgctccggtcgctcagctccaccccgttcgccaaccacttcatcctgctcgcgttctggcccgtcgccttcggcttcatgctgctcatgtggtgctgctccaagaccttcgtcgtcagcttctactacctccgcggccacctccaccagacctggtccgtgccccgctacggcttccagtacttcctgccggcggcgaagaagggcatcaaccagcagatcgagctggccatcctgcgggccgacaggatgggcgtcaaggtgctcagcctcgccgcgctcaacaagaacgaggctctgaacggaggcggcaccctgttcgtgaacccaaaaagggcacccggacctgcgcgtgagggtggtgcacggcaacacgctgacggcggccgtgatcctgaacgagatccccagcaacgtgagggaagtgttcctg

SEQ ID NO: 68155 - DNA, 339 bp, Zea mays
  Clone ID: LIB3076-010-Q1-K1-C10
cgacccactcttactcacacacatacatccaatctattcattcactctaactttcctcacacaccacaacattcatgcttttttctcaactatcactgacctaaaactaacccttctactctcttaacccaatccctctattaatctacctacaacatacacaaacaccatcaaaaccctccttttcatatacacatttcaatctatcccaacctatcttatcaatacacaccaactacaacatcatcacactctcctcatattaatactctaaacatcaatctcctatacacctacacaactcacataatctccactaccatcatcatctgccaacct

SEQ ID NO: 68156 - DNA, 444 bp, Zea mays
  Clone ID: LIB3076-010-Q1-K1-C2
gtccaaaagcttgtggggaaaatggttaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgcattggggcttatgtcaaaaacaagaagaatcaaaaccagatatgctggttatgggaaaaggtaaaatcaacagaagacagagattttcaaagattcctggacaacgtgcaatacaaaacataagggttttgggatattacgttatgagcgtgtctttggtgaaagttttgtgagcactggtggaatcgagactacaaaggaatttgtgggcatgctcgaacttaaacc

SEQ ID NO: 68157 - DNA, 419 bp, Zea mays
  Clone ID: LIB3076-010-Q1-K1-C3
gcgcacataagtggcggcggcggacttaacgcatgcaaaggctagggttttagggggggaggtccagccatggtgcacgtcaagttctaccgcaactatggtaagacgttcaagaaaccaaggcgtacttatgagaaggagcgacttgatgctgaactgaagctggttggtgagtatggtctgaggtgcaagcgtgagctttggagtgtccagtatgcactgagcaggatccgcaatgctgcaaggcacttgctcacccttgactagaagaaccctcgtcgtatctttgaaggtgaggcacttcttcgccgcatgaaccgctatgggacattaggacccttgctgagggtcataacaagcttgattatgttcttgccctcaccgctgagaacttgctcgcatggcggcttcaaacactt

SEQ ID NO: 68158 - DNA, 378 bp, Zea mays
  unsure at all n locations
  Clone ID: LIB3076-010-Q1-K1-C4
cccacgcgtccgcccacgcgtccggtgcgttcgcggagacgatggcgacggagaagctgggcatcaaggtggagcgcaacccgcccgagtcccgcctctccgagctcggcgtccgccagtggcccaagtgggggtgcgagaagagcaagttcccgtggacctactccgccaaggagacgtgctacctgctgcaggggaaggtgaaggtgtaccccgaaggccacggngaggagttcgtggagatcggcgcgggagaccttgtcgtcttccccaagggcatgagctgcacctgggacgtcgccgaggccgtcgacaagcactacaacttcgagtaagcncccgggcctcggcgccgactagccctgcggcgctcgatgt

SEQ ID NO: 68159 - DNA, 368 bp, Zea mays
  unsure at all n locations
  Clone ID: LIB3076-010-Q1-K1-C6
cacagaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcactgagcaggatccgtaatgctgcaaggcacttgctcacccttgacgagaagaacccccgtcgtatctttgagggtgaggcacttcttcgccgcatgaaccgctatgggctgnctttggccccttgagggtcagaacaagcttgattatgttc

SEQ ID NO: 68160 - DNA, 354 bp, Zea mays
  unsure at all n locations
  Clone ID: LIB3076-010-Q1-K1-C7
actaactgccaccgacgcgccctcgccgcgatgatctccctgctccgacgcgccctcggcgcctccgcctccgcctcgtatccggcggccacgtaccggagactcctcgtcgtcgtgccactctctccgcccgcggcccctccaggcccatgccaggcgcccgcggcagggtcgcaggagccgccgaggcgggcgttccactgttctacgccccccctggggttcaggtccacccccgcgtcgtgggccggtccctatccgggggagggcgagggcgagggcgtggatacgggggctgagaaggggctggagatcgcgaggctggggaccttttnngggnccgcggatcgtgga

SEQ ID NO: 68161 - DNA, 186 bp, Zea mays
  Clone ID: LIB3076-010-Q1-K1-C8
aattgacggacgcacccacgcatccgcacataaactcctgctgtggattttacgcttactaatgcgacgctctaactggaggacggccaaatatgcaacgggtcagggtatatcctatctatcttaagacgttcaagaaactatctcgtccttatgataatgaacgtctttatcctgaacttaatc

SEQ ID NO: 68162 - DNA, 319 bp, Zea mays
  unsure at all n locations
  Clone ID: LIB3076-010-Q1-K1-C9
ccgggtcgacacacactcgtgctgccaggaagcgctcctgcacctgttctgcatacgcccaacggcctaatatttaggtancctggtacaacctacatggtcctcgatccgtcacccatccgttccggatcttgattcttgccaatgcgtgcaagatttctgcttcgccgaggttaaattttattcttctgtcgaccttctgcggacaacccgcacgtttgcttggtgccctctatttgcctgctactcattgcgctccaatcctatgctaatggaacgatcctactcaacattgccatcgtcacttctaccatattcc

SEQ ID NO: 68163 - DNA, 392 bp, Zea mays
  Clone ID: LIB3076-010-Q1-K1-D10
acacaagtatcagtgccacttgaattttctgcatccatacaaatgccaactacttcgtttgctgacaatcaatctgggctaatgggcacacttacaatggttactcaattcagggaatctttcccaacccaatactctcagctgcgactttaatatttgtcatgcgttatataccatgtagcttaatcttccgtgcatgatcacattgcaatattgctgatagctcacacactcatctcatgattactcgctacactatcttatatcgcactctacatgtgctaacacacttcaaaatcagcttcataggtcagtaccctgataactatcatagaacagacctatatagacaatatctacacgttacacaggttactacttatggaaatttc

SEQ ID NO: 68164 - DNA, 226 bp, Zea mays
  unsure at all n locations
  Clone ID: LIB3076-010-Q1-K1-D11
gccggttctacacactcgtcctaaantacccataccactttaatttactncatctatcaaaactcacactacttaagaancttttcaaaattctattgcccatctaaacacttacaaccatcactcaattcattaaaactctcctaatccaatactctctactatcactatcatctttaacatttttcatataacatataccttaattaacatacactcctcacaa

SEQ ID NO: 68165 - DNA, 287 bp, Zea mays
  Clone ID: LIB3076-010-Q1-K1-D12
acacatataccatttattcatagattttctccattcttacatcactcaacaatcttgctgcattaacaaaatcttgcggccaagaacaaccatacaacgctatcaaagcaaagcttatattaaacacctcgcaattaccacgatcaccattaacaccattcattccaaatataccataaaaaatatgcaaccctacatgaccaatacacaccattcataacagcacacacacacaacacatcaatactctaaacattacaaccaaacacactgcacaagtccacata

SEQ ID NO: 68166 - DNA, 333 bp, Zea mays
  unsure at all n locations
  Clone ID: LIB3076-010-Q1-K1-B11
ggtgggctggcttctactcaccctcttaccaactactattcggattacggttagttaaggtgtttgtggaggggagatggcggccgatgatgaggcctaccgtcgctcaatccgctggcttgcctaagccacaaacaactcatcgctggacaataccttcacctcctacggcgagatccctcactccaacgacattacctaccgggagactctgatgttatcccnagttccgaccttcattacctatctacaccggacaactcactacatcgacactatcgagaacatcacaccgaaaggatctccaacgcagtaacatcaccgttaaccact

SEQ ID NO: 68167 - DNA, 196 bp, Zea mays
  Clone ID: LIB3076-009-Q1-K1-G3
ccagctgagagccgacctggtcagggtagccaagcccattccgttctctcccggcgtcttctccctccggaccggggctcctgcgatggcgggcgtgggctccgcgctgcgtctgctctacctctccgtctacaactgggtcggcttcttcggatgggcgcatgtgctgcactacgccgtcctgacactgcctttg

SEQ ID NO: 68168 - DNA, 410 bp, Zea mays
  Clone ID: LIB3076-009-Q1-K1-G4
cccacgcgtccgaaaccattgaaatgcattattcaggttcaaggacaagcacaagctcaaacacaagcacagaatcgctatgctgagactgatagccgtgattggcgtgcacggtctgcacagctgactccgactaatgaagaaaaatcttgggacaacataagggaggctaaagaagcctatgcctctagcggtaggcagcaagagcaagctaacaggcaagatcagttaagctcccagtttgcttcgaaagctcaggttggccctacccctgctcttattaaggctgaagtgccctggtcagcccgaagaggcaatctctcggagaaagaaagagtcttgaaaacggtgaaaggtatactgaacaaacttacaccagagaaaatcgatcttttaaaaggtcaacttat

SEQ ID NO: 68169 - DNA, 400 bp, Zea mays
  Clone ID: LIB3076-009-Q1-K1-G5
cccacgcgtccgaccagctagcaccttctttcccacgactcccgagcgctctgcgtgtggcgcgcggcagcatggcgactgcgaacgggagcagcaaggggtcgttcgaggtgcccaaggtggaggtcaggttcaccaagctcttcatcgacggcaagttcgtcgacgccgtctccggcaagacgttcgagacccgggaccctcgcaccggcgaggtgatcgccagcatcgcggagggaggcaaggccgacgtcgacctcgccgtcaaggccgcccgggaggccttcgacaacgggccctggcccaggatgacgggatacgagcgtggtcggatccttcacaggttcgcggacctgatcgacgagcacgtggaggagcttgcggcgctggacacggtgga

SEQ ID NO: 68170 - DNA, 144 bp, Zea mays
  Clone ID: LIB3076-009-Q1-K1-G6
cccacgcttccgaccagctttcaccttctttcccacgactccctatcgctgggcacgttgcacgcggaagggtggcgactgataacttgatcagcatggtgtcgttcgacttgcccaatgtgtatgtcttgttcaccaagctct

SEQ ID NO: 68171 - DNA, 403 bp, Zea mays
  Clone ID: LIB3076-009-Q1-K1-G7
actttgcgctgtcagagctatctttgcatctataatgtatgctttatgtcaatttctctgctgcaggtgaaaggacttgatgtggataccctctatgtgtcgcacattcaagttaatcaggctcagaagcagcgacgcaggacataccgtgctcatggacgcatcaacccttacatgtcctccccatgccacatagagctcatcttgtcggagaaggaagaaccagtgaagaaagaggccgagtctcagatcgcaaccaggaaggcttagagaaggggctctatcttctgtgattggcttagtacaagttttggctgattatttgttgtctcatactgtttacctgagtattgtttgcaagtgctttatcactgtccgaactgtgcatgcaattcactggtct

SEQ ID NO: 68172 - DNA, 427 bp, Zea mays
  unsure at all n locations
  Clone ID: LIB3076-009-Q1-K1-G8
cgtttggcgagggatgtcattttctgcactttgtccctggtggttacccggcagttgcaaaaatgctgaatctaagtagctctgctgtatctgcgccatcaagaactcatgtggatcatgccgctcttaccggtgcctctcatccagcttctacggtcaagacacgcatgtgcaccaagtacaacactacagaaggctgcaagttcggtgataagtgccatttcgctcatagcgaaagagagcttgcgaagccagcctacatgtctcaagaaggacctcctatgggtggtcgatatggacgagctgaacctatgcaaccagctgccatgggccctccagcaggaaactttggtgcctcggcgactgccaagatcagtgtggacgcctntctggccggtggcataatcngcaagggtggggtcaacac

SEQ ID NO: 68173 - DNA, 401 bp, Zea mays
  Clone ID: LIB3076-009-Q1-K1-H2
cggacgcgtgggcgcaagaaggtcgacagcgccagcacgtcgctgctgtccccgtacctgcacttcggcgagctcagcgtccggaaggtcttccaccaggtccggatgaagcgcctcatgtggagcaacgacgacaaccacgccggcgaggagagctgcaccctgttcctctgctccatcggaccacgccggcgaggagagctgcaccctgttcctctgctccatcggcctgcgggagtactcgagggtggcgaggcgggagaggagtacgcgggagcggtaggcgagccgtggaggaggatatggaggtcaccgaagaggaagaaagggaagtcgtggactctgatgtggagggtttcattggtttgatgagtttacattacaggttgcttttcttaaat

SEQ ID NO: 68174 - DNA, 390 bp, Zea mays
  Clone ID: LIB3076-009-Q1-K1-H3
cctggaaagcgttctaagcctagtaatattgttgctaatgtggcatcttttatacctgttgtgaagccaaaggtgcaaccaacaacatgtgtgaaaaaagatgttagagtgaaagcacttgagacagctgaagctgcaaaacgtcttgaagaaaagaaacgaagtgaacgtgaaatgcgcaaagcagcagcaaaactagagcgtgagaaactgaagcaagagaaagagttaaagcaaaaagaggaagaggaacagaagaagaaaagaggtgctgatgtggcaacaaggaagaggcagagggatgaggaggaaaggagggagaaggagagaaaaaggaaatgcattgaagaagctcgaaaacaacagaagcgacctattgaaagaaaacat

SEQ ID NO: 68175 - DNA, 328 bp, Zea mays
  Clone ID: LIB3076-009-Q1-K1-H4
gccaagataggagtttctcatgttcatttggataaggagaaaattactagagcttctcgggtccattttttgcaaagataggaatttctcatatccattttctgtgatattcgttctgttatatagaaaatagtttgccaccattttctgcggtcacttatgcacagatcagagtgccccttgtgttacttctggttggttcatcaaaaaatttctttatctttgctttgctaagtatcatacttaatatatatctggagattcccaattttgctcaaaatggcactggtactagaatttgcatgtgcatgtatcaatgtatagtaaa

SEQ ID NO: 68176 - DNA, 438 bp, Zea mays
  unsure at all n locations
  Clone ID: LIB3076-010-Q1-K1-A2
accactgctacccaaccctcgcttccccaaaccctagccaagggacacggtggccggcgatggacggcgacggaggaggcgctggtgcgctgcaccaccacacgcgctcacccgaggacgtcttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaaccagcactggggataaactttgcccgtgatggaatggtcgaaaanaaaaaagactggttgtctctagttgcagttcatagtgatgcatggctcctgtctgttgcattctattttggagctcgttttggatttgacaaagatg

SEQ ID NO: 68177 - DNA, 302 bp, Zea mays
  Clone ID: LIB3076-010-Q1-K1-A3
cccacgcgtccgactagatctctaactgttactccacaaactccaactttgcgtgaaagggaccattacaaggacaatgcgctagtgcgtcaccccctccctcttcactaccctctgaactacaaacttgtaattgcactgaccctaccggggcacctccttggctgcttgcatcacaactgcaccaaaatcccatgagaatacacaacaacgacaacgatcgatcaaccaaccacacactacacgaaacacatgaccaagcacacgcatactcacgcacttgagatgccgcactatcccct

SEQ ID NO: 68178 - DNA, 430 bp, Zea mays
  Clone ID: LIB3076-010-Q1-K1-A4
accactgctacccaaccttcgcttccccattccctagtcaagggacacggtggccggcggtggacggtgacagaggaagcgctggtgcgctgcaccaccacacgcgctcacccgaggacgtcttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagctttcagaaccagcactggggataaactttgcccgtgatggaatggtccgaaaaaaaaaaagactggttgtctctagttgcagctcatagtgatgcatggctcctgtctgttgcattctattttggaactcgttttggatttg

SEQ ID NO: 68179 - DNA, 330 bp, Zea mays
  Clone ID: LIB3076-010-Q1-K1-A5
tgccgtaccgtgtcccgggtcgccggacgcgtccgaccactgctacccaaccctcgcttccccattccctatccaagggacacggtggccggcgatggacggcgacggatgaggcgctggtgggctgcaccaccacacgcgctcacccgaggacgtcttccgcgatttccgcgcgcgccgagccggcatcgtcaaggcgctaaccacggatgtggagaagttctatcagcagtgcaatccaaagaaggagacctgggcccttaatggtttgccaaatgagacttgggaggtcacttttccagctgaggaagtccctcctagagtttccaa

SEQ ID NO: 68180 - DNA, 271 bp, Zea mays
  Clone ID: LIB3076-010-Q1-K1-A8
acgcccacgcatatgtacaattcgattcccatttttgtaattaatccaaattaacctgcacagtactattataaagggcatgtgctcttgaaaaacataaagtcatctcattaatcccccatatacaccatagtcattgaaaaaactctttctctactcatacccattgaattaaaatacacatttataaaatcaactatcatatcaactcatacaaaatatcaagatacacatactactcactaacgcctctctgaaaaccatttacatt

SEQ ID NO: 68181 - DNA, 438 bp, Zea mays
  unsure at all n locations
  Clone ID: LIB3076-010-Q1-K1-B1
cccacgcgtccgcccacgcgtccgcggacgcgtgggttttggcacgacgggactataggattgatcaagatcggcttggcatttcagttccactaccaacatagttaaccatgtagtccgtggactgtattaatctaacatagttgatgaaaaaaaaacaacgacgtattacaagttaaccatgtacgaagaaaataaaacaggcaaaaatcaacatggcttcattagccacggtaccactctaccaacggttttccatccatcgtgacttgtgcaattaccgcagtacacttctggtctttgagttggtgactgtcttgataagctggnttnaaacccatccaccggtcaagcattcctgtcatggcgaatgtgccaccaagaactgcacatagacgagttacaaaatgaaggaagttccttctttcctctttgatg

SEQ ID NO: 68182 - DNA, 340 bp, Zea mays
  unsure at all n locations
  Clone ID: LIB3076-010-Q1-K1-B10
cacgaaactgccgaacataaacgagaccattttcaccaattgaatctattacgctacaccgggctccttgtcctcattgcgagcaaaaacgcctgagccatacttgtctgaccacctgatcgaactgatgacatcggcaacccttttattctccaacgagtataatcttgtagtcggcccattctttcgaaccctgctcatctatcgcccttacaacaatgtgacccacatcgacaaatacctctatgctcgtaccgtgctcgcactaactatgaaatattccaccancacgtgcaacttactacatttctacatccaacttcttccgcgacgtcatggc

SEQ ID NO: 68183 - DNA, 374 bp, Zea mays
  Clone ID: LIB3076-009-Q1-K1-G2
gccagctcaggagccgagcctggtcagggtagccaagcccattccggtcctctcccggcgtcttctccctccggaccgcggctccggcgatggcgggcgtcggctccgcgctgcgtcggctctacctctccgtctacaactgggtcgtcttcttcggatgggcgcaggtgctgtactacgcggtcctgacgctgcgtttgagcgggcacaaggccgtctatgccgccgtcgagaggccgctgcagttcgcgcagacagccgccatcatggagatcgttcatgggctcgtagggttggtgaggtctccggtctctgcaactcttccacagattggatccaggttgttccttacgtggtgtgtcttgtggagtttt

SEQ ID NO: 68184 - DNA, 401 bp, Zea mays
  Clone ID: LIB3076-015-Q1-K1-C9
gcactcatacttataacacaagcgtgatctgcattctgctttccggcatctgctacgtctaaggcttccgcgtctctatttcaccttcggaggccatactcacattcctagcttatcgttcatccatattatgactacacattctatcatctacactgactagtgttccaatctcactatgctaatcaccagatctaatctgacaacttttagcaacactcttaaataccatatttcaagtgtataacatctctgcatcaactaagctaaaataagttctatcgacaccaatcactgacacttctggcttcctatacaaaaacagattatagacaaactgccctctaaatggctcactattctatggcaatcacaacttaacgtctcaatgccaacttatc

SEQ ID NO: 68185 - DNA, 452 bp, Zea mays
  Clone ID: LIB3076-015-Q1-K1-D1
gcggacactggtggtggtgtcctcctccttctagctatggttgcctccgctcgtcgccgtgcggggcggtagctttcagatccccagcacagcgaggatgacattgaagacatccaaaagcttcaagctggccctcccttggatgaaatgtctattccatacatttcgagggacttgttacacgcaattgagtatctacattctgagggactagttcggaatcgagggccgcaagttaaagcatcaggtcaatggtcccgccaacaattaaaccagatggcggattggagcttgatgttgggatgatgcatgcacctttcaagtttcagaatgttgtcctcaaatgcagcttgtggttgttgaacctattctacttgcttctggatttaagttatagtttattaaacatatttgatgtttaatacttgtgtcggatgatttatgcttcaatt

SEQ ID NO: 68186 - DNA, 373 bp, Zea mays
  Clone ID: LIB3076-015-Q1-K1-D10
tcaatatattacttcgagtcttattgatccttctgtttctacttgatctcaaaggtggcaggttatatcgatctgctggatgtctgcccaagtccatctgagatgaaggtcactattgcacttgctgatacgggcatcaaatatgaatacatagacgaggacttaacgtactatagatctctactcctacaaatgtacccggttcacaagaagattccttctctcattcacactgacaaacccatttgagaatccctcatcactgttcactacatagacgaggttagtgatgacagaaatcccttgttgccctctgacccttaccacatagctcagcctagattcttggctgattatcctgattagatgatat

SEQ ID NO: 68187 - DNA, 450 bp, Zea mays
  Clone ID: LIB3076-015-Q1-K1-D11
tcaagtcattacttcgagtcttattgatccttaattatcttcttgatctcaaacgtttccgaggatatcgaaatgctggatggctactcaagtccatctgaaatgaaggtcactaatgcacttgctgaaacagatatcaaatatgaatactaagacaaggacttaacgtactatagacctctatttctccaaatgaacccggttcacaataaaactcctattctcattcacactggcgaacccatttgttaatccctcatcactgttcatttcattcacgaagttaggaatgacagaaatccattgttgccttatgacccttaccacatagctcaggcctgattctagactgattatgcagatccgaagatatactatcttggaatgaagatctggtcattaataggaaaagaacatgaagctgccattaaagagtacatagaatccctt

SEQ ID NO: 68188 - DNA, 445 bp, Zea mays
  Clone ID: LIB3076-015-Q1-K1-D12
cccacgcgttcgcccacgcgtccgaaaaaaccggccccaccgttcgccatgagcggcgaagcagaatgcgcagctccagccgccgccgcgccggatggggcgggcggcggcagggtggagatcgacacgtccgcgccgttcgagtccgtgcgggaggccgtcgaccggttcggtggcagcgccgtctggagctccgacctcgtcaggcgcatgttcgcgccctccaagaaacatgaacactctgaccaagctgcagaggccatcaacgccgaggagcaggctgcacagctagagaacgagctggcagataaagaaagggagactcttgatgtgctcaaggagctggaggcaaccaagaagatcatagcagacctgaaactgaagatacggaaagaagccactgaaacatcccctgaagaggctgcaaagtctgatgaaactgacc

SEQ ID NO: 68189 - DNA, 443 bp, Zea mays
  Clone ID: LIB3076-015-Q1-K1-D2
gaattcccggcctgggctcgggaaatgccctctggtctccccgtgccccattccacccgccgtcgtcgacgcgccgagcctgttcaagatgggtgtagaaaagcggacgaagatggcaggtgctgtgcgcactgtatgaaagggcatcatgcgcaggaagaagaacgcagtccacaagaccgcaaccaccgatgacaagcggattcagagcacgttgaaaagaattggagtgaacactattcctggtattgaggaggtcaacattttctaggatgacattgttatccaattacacaaccctaaagtgcaagcatccattcctgctaatacatgggtagtcagtggagtaccccagacaaaaagtctacaagaccttctgccaacaattatcaaccaactgggccctgataacctggagaacctcaagaggcttgctgaacatt

SEQ ID NO: 68190 - DNA, 308 bp, Zea mays
  Clone ID: LIB3076-015-Q1-K1-D3
cccacgcgtccgtaaaccctagagcctccttcccggtcgcgctagcgacacaaatgtcaggtcacccttagagaactggctcgcgaaggctgaactcatggctcgcgtcttcgttgggaacctggatccgcgtgtcacggcgcgggagattgatgacgagttccgcacgtttggggttctgaagagtgtatgggttgctaggaaaccaccagggtttgccttcattgacttctatgaccgcatggattcacaagatgccattcgcgatttgtatggtaagaatggttggaaggttgagctgtcaacca

SEQ ID NO: 68191 - DNA, 434 bp, Zea mays
  Clone ID: LIB3076-015-Q1-K1-D5
aaagcagagtatgataccgctggttaataatgacgagaagggatccagtaaagcctgcaggctaaaagatacaaagagaaatgcatatgaaagtgttgatgtagacagtaagtttgactatgacattgtagatgataaacaagaatgctcctctgtgtcagaagtagccagcaggagttttgagacaaagcatgtcactactgctcaggaatgcactgaagattgtgattcagcagaagttacagaacaatgtcccaggggtcgagaaagtaagagcataggctcaacaattacagatgttactactcatgacacacataagttgtgtctgaatactatgaatgaattggccctttgtaggaagcaactttcaagagatggataggaagcaaggcaaattttttggattggttgaaggaattaatggccagtta

SEQ ID NO: 68192 - DNA, 438 bp, Zea mays
  Clone ID: LIB3076-015-Q1-K1-D7
cccacgcgtccgtaaaccctagagccgccggcccggtcgcgctagcgacacaaatctcaaatcacccggagagaactcgctcgcgaaggctgaactcatggctcgcgtcttcgttgggaacctggatccgcgtgtcacggcgcgggagattgaggacgagttccgcacgtttggggttctgaagagtgtatgggttgctaggaaaccaccagggtttgccttcattgacttcgatgaccgcagggatgcacaagatgccattcgcgatttggatggtaagaatggttggagggttgagctgtcaaccaaagatggtggtggccgtggccgagaccgtaatggttctgatatgaagtgctatgagtgtggtgaagttggccactttgcacgtgaatgtcgcttacggattggttcgggagggctgggtagtggaaggcg

SEQ ID NO: 68193 - DNA, 408 bp, Zea mays
  Clone ID: LIB3076-015-Q1-K1-E1
cccacgcgtacgcggacgcgtgggcttacacgtggtacctttcatgcatgcctcactactgtcgaggaacgtatctataacgtcatggccacagctggcgacacccatcttggtggtgatgactatgacaacatgatggttaaccactttgtacatgagttcaagagaaagaacaagaaggatatcaatgtcaacccgatggctctttcacagctgaggacctcttgtgagagggccaagaaaactatgtcttacactgaccagaccaccattgagattgactcgatgtacgagggcattgacttctactccaccattacccgagccaggtttgaagagctcaacatggacctgttcatgaagtgcatggatcctgttgagaaatgcctgaaggatgccaatatggac

SEQ ID NO: 68194 - DNA, 435 bp, Zea mays
  Clone ID: LIB3076-015-Q1-K1-E10
cacacccactgacccacaccccagcccagcatacaacaagcagcctggtttacggtagctgctagcaaaacaatggagaaccctgctccgagcatcgtagtggccatcgccgcacccgtggcggcagagttcgtgaagctcaccttacgtgccctgtatatgcgccgggctggtccaggcagcagggagatgactgtgccgggaaggccatccgaccagctgggcaggagagtcgtcactgacagccccgtgtacgacggccgtggcgccgacgcccgactcgtggctcgcatacagggagtcacggtcctggtcggtaacgcagacgccttgttcaccatggtgttcgaaaccgacaggctaaagggctccacgctcgtcatcaacggaatggtcacggatgggtcagacgaatgggcgatctacggcggaacc

SEQ ID NO: 68195 - DNA, 449 bp, Zea mays
  Clone ID: LIB3076-015-Q1-K1-E11
cggacgcgtgggcggacgcgtgggcggacgcgtgggctcacttcaggtggagcctataagggcagcgccgaggtcacccagaacaactgccgcaccgacagagccaatctcatctcttctgccccatggattaagatcccctacccactgcaatggggtgcgccgaccttcaacgccggccagtcatttgggattgtgtctgctgttttggtctcgctggtagagtccacagcctcctacaaagccgctgctcggcttgcgagtgcgactccacctccggctcacatcctcagcagaggcattgggtggcagggaatcggcatcctccttgacgggctctttggaacggggactggctccactgtctcagtggagaacgtcgggttgcttgggtcgacaaggatcgggagccgacgggtcatacagatctcagctggcttcatgatctt

SEQ ID NO: 68196 - DNA, 451 bp, Zea mays
  unsure at all n locations
  Clone ID: LIB3076-015-Q1-K1-E12
caaagaataaaaatgtggaactcggattttcagatgaagagcgtgaccaagaacttcctgagtttccatcatttattccattcttacctcctctgagtgcagctaacctaaaggtctactatgccacacgtttcaccatcatagttgggataatggtgttcggtggttttcttgcaccaatcgtaagtcacagttctcagttttggaaccaccgatggttattgtcatagttttgttttgccatatatagattgctttgaatgcttaacaagttgatgtgctctcatgcggctggaagttaaacttggtctaggggcacatcttatgaagactccatccgcagcgttcatctgtcgacgtagttgaggtactaccactttttcatggtccattaatgtatcaaggttcatctagcaacagttgggactgctaggatctggngtgcgcaatg

SEQ ID NO: 68197 - DNA, 437 bp, Zea mays
  Clone ID: LIB3076-015-Q1-K1-E2
cgcggcacccggcctcacatggcgcaggcgcgcgacccagcgtgggcttggccagccaggggcgtgcctgtgcgggcacgcggcctcgccacaggcgtgcggccccggccaggtcccggcgcggtctcgacgctcggtgtgccgctgttaggcgggcgaggcctcgacggcacgggtgcggctggcatggccccgtccggccgtgggtgtccccggcgtgggcacgggcccagcagccccggtggcgtggcgtggccccaacagcccaagcggagcgggcgcgagactcctctggcgcaagttctggcgggcagcgctaccaccgtctgtccgcaagattgcagcacacatgtgtgcaagaacagcgccattgcagatgaggaccgacagatacataacaaaactgagtaagcataaatcgcataccatttttaatc

SEQ ID NO: 68198 - DNA, 392 bp, Zea mays
  Clone ID: LIB3076-015-Q1-K1-C8
cccacgcgtccgcccacgcgtccggagcgatcccactcccgatcagcagctgatggctcagtcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccggcggttaaccccaagccggccccgtggcggcggaggaagagacgccaaaagaagaagagacggca

SEQ ID NO: 68199 - DNA, 400 bp, Zea mays
  Clone ID: LIB3076-015-Q1-K1-B10
gcactcgtacgtccaaagcaaaattcccatactttttacgacatcatacttacctcactactcgcgatcgcgtccacttttaccataaggcacccaaattccactttcaacttcaagaacattataaactacatatcaaaatcacaaactctcttggatcaatacaactcaacccagattacatgattcacctacaatcatcataactatatctataatctatcttacatcaatctgccaatatcacttgccaatacatctacactagctaatccaaccagtcaaccaactacttcaattcattataacatactgacatttacactcaagcaatcagaatactagccacgactatatctatattatgacagacactccctcataatgtcgctacattatc

SEQ ID NO: 68200 - DNA, 359 bp, Zea mays
  Clone ID: LIB3076-015-Q1-K1-B11
acgcccacgcgtacgctaaactagtctaatctagtcatattcaatctaatctatctggtacttggtctaatacgatctaagctagtgagtgttacttaatgctggtacaaacgataaggccatactcctaaatcacttaagcctaatttggagacttatatcaacttggccatacacaacaactcgatctatataacacgttatataacttacccaatcaataaagtcttaatggattgcataatctatcaaccgacacctgacatcaaaccagattttgacctatatcatgtaatctatcttaccacatatatcttaaccatatgtccttaactcggatggcaactccaagaagaaag

SEQ ID NO: 68201 - DNA, 283 bp, Zea mays
  Clone ID: LIB3076-015-Q1-K1-B2
acgcaagtccaaccacagctacagatggatggtgcaccactgcgccaagtatcctcgaagccacgggttatactcgacaactgggtcgacaccgtcgagccggggcccgccaaggtcctgcgccagccggagccatggcgaccgtcggtgcacaccatcggacctctcgtgcacgccgagaacagtggctgcagcaaagactactcgccttgcccgagcgtggagtgtcaggaccggcagtccgccaaatcggtcatactcaatgccttcggctacagctgca

SEQ ID NO: 68202 - DNA, 322 bp, Zea mays
  Clone ID: LIB3076-015-Q1-K1-B6
caagtccaaccccagctacagatggatggtgcaccacggcgccaagttccgcaaggccacgtccatcttcgcaaactccttggacgccgccaagccgggccccgccaaggtcctgcgccagccgaaccccggccaaccgtcggtgcgcaccatcggcccgttcgtccccgccaaggacggtggcgtcagcaaggacaacccgccttgcccgtccttggagtgcctgtaccggctgccggccaagtcggccatcttcgcgtccttcggctccggctgcacgctgcccgccgaggagatgcgggagcttgcactaggcctggag

SEQ ID NO: 68203 - DNA, 443 bp, Zea mays
  Clone ID: LIB3076-015-Q1-K1-B7
cccacgcgtccgagctattcttcatatatctacattgagtgggcgattggagtctgataggagctagaaccttcatatgtgacaccagaatgaatgggtgattggagtcgaatgtacagacttgtaggatattccggaaatgttttagcatgccttttgatttaagcatgtacctgttaaaagtcttctgtgttttccaggttaatggagttggaaagaccgcagttacagtggagtacccagagcgtcctggacagcctctctgtgagtactatgcaaagaatggcacctgtaaatttggttccaattgcaagtttgatcatcccagggagggtggttttgtacctgtcacattgaacagcggtggattccccctgcgtctgggtgaaaaggaatgttcctattacatgaaaactggacattgcaagtttggagctacatgt

SEQ ID NO: 68204 - DNA, 456 bp, Zea mays
  Clone ID: LIB3076-015-Q1-K1-B8
cgtacgctaccaccgtgtccacagcaaccaacacacatttccctttggcggatcgaaggagggaaggggggggttggtttcagcatgggggtgcacaaaaaccggtggatcgaagagtggaacgccggccgggagaaccttgagttcaactttcgctggacccgccgcaaccttgccgtcgtcggcctcttcggccttgctgtccccattcttgtctacaagggcattgtccgcgaattccatatgcacgacaaggatgcaagtcggccatacacgaagttcctgtaagcggcgtccagagctgtagaatacgtcgattcctctaccggggctgtgaggagaggagtttctattcagtttgtatcggtattgttttagtctgaatctgatgaagcaatttggaatgctgaattatagtgcctgatccacatgaataatgtgtaatgactcgtcttt

SEQ ID NO: 68205 - DNA, 418 bp, Zea mays
  Clone ID: LIB3076-015-Q1-K1-B9
gccaaggtttatgtagcataggtgcttcttgctctggaatacctgcacatgctgggtatggtataccgtgacttaaagccagagaatgttcttgtgagggaagatggacatatcatgctgtcggatttcgatttatccctccgatgtgctgtgagccctactcttatcagatcttctaactccagtggggataaccataagggcaacccagcttactgcatgcagcctgtgtgcattgagcctgcctgtatgctggcttattgagtcacgacaaccacatgcttctctcctcgcttacactctgacaaatccaatgaggaaatcgatatactggcaaaggcagactctgcaaaataggtcagaccactttctgagcttgttgcataagtcgcagatgcaaggtctatgtcctatggtg

SEQ ID NO: 68206 - DNA, 357 bp, Zea mays
  Clone ID: LIB3076-015-Q1-K1-C1
acgctcttgtagcccgccggagatccatgcctttttgatctctcgagtggacagaaaaaaagtgacaggtttatatctaacgaccgtgatgctccagaatctgtgggactacgtggtggcctgtcctcactcgtagactatcctcgagaagctctacaatgcctccaccttccaccctctcgttgtcatcaacatagtttctttttgatgcaaatgatgccgtaaacaccgacgactccgttgactccttagaccactacgactccgctctgtgccagcactatgtggcgcatcgtgttctcacccattgagcaaccttgccaccaagatcatgttcgccaacctcttttacctcct

SEQ ID NO: 68207 - DNA, 460 bp, Zea mays
  Clone ID: LIB3076-015-Q1-K1-C10
tgcggcttcgctagctgattcccgtcaccatcaagcctcatctccccggcctcccactatctccgcgtcggggtcccatccacagtccggcgcgcccagcaccatccatccgtccgcaagggggaaagcacgctagctgagctgagctgctgagagagagagagaggcaaaccctatcacgcacaagcacagcaacgtatacgcttccccccgccgattcatccatccatcgcagcgcgcaccgggcgggcggtccgggacgacgacagctaagctagcacatcgcaatagcatagcatctatctccgtcgcagtacccaccaccaccaccaccatgatcttcccccctgccttcctgcaggattcctcgagctggaacgataaccagcagcagcagcaccaccagcagcagcaaggccacggccacctgctggttgccgtcagcggcagcggcgacgcc

SEQ ID NO: 68208 - DNA, 443 bp, Zea mays
  Clone ID: LIB3076-015-Q1-K1-C11
attcccggccgtcgtagcttacctagctgactcccgtcaccatcaatcctcatctccccgtcctcccactatctccgcgtcgcgttcctatccacagtccgacgcgcccaacaacatccatccctccgcaagggggaaagcactctatctgatctgaactactgacagagatagagagccaaaccctatcactcacaaacacatcaacatatacactatcccccgcccattcatccatccatcgcatcgcacaccgatcagtctgtccatgactactacagctaatctagcacatcacaatagcatatcatctatctccgtcgcagtacccaccaccaccaccaccatgatcttcccccctgccttcctgcatgattcctcgaactggaacgataaccatcaacatcagcaccaccaacatcatcaaagccactgacaccttc

SEQ ID NO: 68209 - DNA, 355 bp, Zea mays
  Clone ID: LIB3076-015-Q1-K1-C12
atacggaaacatttgacttgattgtcgattacaattatacccaatctgttattttttacgtttacggcgaatacaaacttcaggcagacaagacactaagtgtggcaaaactagcagtaaacactcttgaatctgatattacccaagacgccactctgaagctgctacattcactggatccaattaaaaataatgacaccaacgataggggcacattacatcttaaggtaaagtaccacccctttacaaaggaagagcaactcgaagccctatacatggaaaaacaagccatataggagaagaaccctctgaaggatgctgggataaatggtagcacaatggatgctgtttgttc

SEQ ID NO: 68210 - DNA, 452 bp, Zea mays
  Clone ID: LIB3076-015-Q1-K1-C2
ctcccaccgtctccacagcaaccagcacacatttccctttggcggatcgaaggagggaagggggggatggatggcggcatggaggtgcacaaaaaccggtggatcgaagagtggaacgccggccgggagaacctcgagttcaacttccgctggacccgccgcagcctcgccgtcgtcggcctcttcggcctcgctgtccccatcctcgtctacaagggcatcgtccgcgaattccatatgcaggacgaggatgcaggtcggccatacaggaagttcctgtaagcggcgtccagggctgcagaatacgtcgattcctcgaccggcgctgctaggaggggagtttctattcagtttgtatcggtattgttttagtctgaatctgatgaagcaatttggaatgctgaattattgtgcctgatccaaatgaataatgtgtaatgactcgtcttttt

SEQ ID NO: 68211 - DNA, 322 bp, Zea mays
  Clone ID: LIB3076-015-Q1-K1-C4
ctcccacccactccaccgcacccaccacacatctacctcactcccaaccaacaactgaaagatcagttttacatctacatcattcttcaccatatctatctctatcctatatccctacctcgtacctaacaacctccactcaactcctcatcctcctcatctacacccattgccactgcccatttccacaccccaaccccatctcaaccaccaaaacactcacctcgaataccctatctcctaccaccaatccacccgaccatactgccccctcctccaatcccaatcccaaactaccaaataccccaacttataccaaacc

SEQ ID NO: 68212 - DNA, 467 bp, Zea mays
  unsure at all n locations
  Clone ID: LIB3076-015-Q1-K1-C6
gaattccgggtcgatcacgcgtacgctcccaccgtctccacagcaaccagcacacatttccctttggcggatcgaaggagggaagggggagatttgtagccgcatggaggtgcacaaaaaccggtggatcgaagagtggaacgccggccgggagaacctcgagttcaactttcgctggacccggcgcagcctcatcgtcgtcaggctcttcagcctcgctgtccccatcctcgtctacaaaggcatagtccgcgaattccatatgcaggacgaggatgcaggtctgccatacaagaagttcctgtaagcggcgtccatggctgcagaatacgtcgattgctctaccgaggctgcgatgaagggaagttctattcagnctgtatcggtattagtttagtctgaatctgatgaaaccattntgaatgctgaattattgtgcctgatccaaatgaataaggtgtaatgac

SEQ ID NO: 68213 - DNA, 428 bp, Zea mays
  Clone ID: LIB3076-015-Q1-K1-C7
acggcagacactggtggtggtgtactcctccttctagctatggttgcctccgctcgtcgacgtgcggggctttaactttcggatggccagcacagcgaggatgacattgaagacatccaaaagcttcaagctggccctcccttggatgaaatgtctattccatacatttcgagggacttgttacacgcaattgagtatctacattctgaaggactagttcgcaatcgatggccgcaagttaaagcatcatgtcaatggtcccgccaacaattaaaccagatggccgattggagcttgatgatgggatgatgcatgcacctttcaagtttcaaaatgttgacctcaaatgcaacttgttgttgttgaacctattctacttgcttctggatttaagttatagtttattaaacaaatttgatgttaaatac

SEQ ID NO: 68214 - DNA, 362 bp, Zea mays
  Clone ID: LIB3076-015-Q1-K1-B1
cttccgctcaccataacccctggttcaatggttctttctccccccctgtggctaatggtatgttggggttaaacactaaggtcggccggcatcttatggcttttcccgttgctgagcttccaggttcactgattccctcatgctactgcctattggcctgcttcatggtttccttatggatactgccattctttccatgggttgcatggccattgcttccctcgccatgcaccacaaggccagcatgtctatacgtacttgaatgtgctactgctgtcactttgtgtgcttgtaatttccagcctaatctcattttatattatgtatttctgtctatgtcgcttttccttgatgttgtgtac

SEQ ID NO: 68215 - DNA, 451 bp, Zea mays
  Clone ID: LIB3076-014-Q1-K1-H3
cgaaagccctcgtcctgacccctcgcaaaaccctagctccaaccaccatgaagggcaagggcaacgcctccaagaaggatgagggcaggctccgggccggcggcggcggcgccggaaagcgcaagaaggccgccgcgagcggcaagcccaagcgccctccctccgcctccttcgtcttcatgtctgaattcaggcaggagtaccaggcgcagcaccctagcaacaagagcgttgcggccgtgagcaaggcagcaggggaaaagtggcgctctatgtcagagcaagagaagcaaccctatgtggaccaagctgggcagaagaagcaggactatgagaagactaaggcaaatattgagaaggagagcacaagctcaaagaaggctaagactgatgacgacgatggctcgaagtccgaagtcgatgatgaggatggcggtagtgacgaggaaaa

SEQ ID NO: 68216 - DNA, 449 bp, Zea mays
  unsure at all n locations
  Clone ID: LIB3076-014-Q1-K1-H5
tcgcccacgcgttcgcccacgcgttcgcggacgcgtgggctcgccgtcgcctgcccgggcctcgtcgacctcgacctctccaatggggtcgacctcggggacgccgcggcggccgaggtggcgcgggccagggcgctccggaggctctcgctggcccgctggaagccgctcagcgccatgggcctnggatgcgtngtcgtngggtgcacggagctgagggagctctcgctcaagtggtgccttgggctcacggatctggggatccagctcctcgccctcaagtgcaggaagctcaccagcctggatctcttctacaccatgatcacaaaagctagcttgcctcccatcatgaagctacccagtctttaagagttgacactggtggggtgtattgcgatcgatgaagatgctcttggtagtcttgagagagaatgcagtaaattactaca

SEQ ID NO: 68217 - DNA, 394 bp, Zea mays
  Clone ID: LIB3076-014-Q1-K1-H6
gggacgcgtgggatcctggacagaacgtttgtgtcatctatccttaattcgcttgctggggttgatcccaatgatccatctgttaaagatttgctggcatcgttgcacagccagggagagcaagagaagaaggaagacacgtcagacaaaacagaagacgagcagaaccgacctagccatgttcacgcctacatgcgcacaaagaaattgaagaccggtctgcgtttactctcttggtcgtggagtttgtttatcctcatataaccgtgctttgattataacttaccggcgagggaatttgtattatgacgctgcaacaatcttctatccatatatgttcaagggattttcgtgtttcaatgctctccatatatgttcaattgatattcgtgtt

SEQ ID NO: 68218 - DNA, 123 bp, Zea mays
  Clone ID: LIB3076-014-Q1-K1-H7
acgcccacgcgtccgcccacgcgttcgaggacgcgtggactctccgtcgtctgtccagaactagtaggggtggaactatacaatgggggcgaacttgctgacgacgtgatggcctaggtggcg

SEQ ID NO: 68219 - DNA, 242 bp, Zea mays
  Clone ID: LIB3076-015-Q1-K1-A1
ccccacaccacccttaacataacaatttaacaaattttcaactacatttccttccatcacctcattaaatcccccttcatacatattatcaatacaaccactatccaatttaaacttttcaataattacaacacccatcatttccacaacttccatatcaaaatcccactaatctaccataaaatcaatcctccttccttaaaattccataccacctttaacacttacaaacccaacctttt

SEQ ID NO: 68220 - DNA, 431 bp, Zea mays
  Clone ID: LIB3076-015-Q1-K1-A10
attcccggtcgaccgactcatacttccactcgtacttccactcatcctcacacatttactgttctagatctcgatctagaaccagtcggcattttcacagagtctacattgaccatatatctctctattaattcacgctcatcaatcggagattcacactccaccattgactctccatcgaacctacctatatcctcccaatcaagccctatcgcccactgctcctctcaatcccatcctacaatctctacacctacattccgcaccttcatctcccgcatctcctcttctctccatcacaccttctcacatcgcctaccgtgtactgagctcatcaaccctaacttcatgtaccgacccaacacccttgcctaagcatactcttcaatccgttagaacttcccctacttacacgtcaattacctaaccct

SEQ ID NO: 68221 - DNA, 412 bp, Zea mays
  Clone ID: LIB3076-015-Q1-K1-A12
cgaccctacaaagctgcgatcaggtgtagtcgtgtagagcggcggcggcgtcgtgcgcggggcgctgtggtgaagggcgaactgagaacactaggcagccagaggcactagccgagccgcgagtcgacaggaggaacggaggccggcgagtggttggcgcaagttgtcaggggagtcgccggagtcgagcggcagcgggcggcctggagtgggggcgatggggcgctacgagctcgttcgcagcgacgacgcgcctgccatcgccgtggatctggaggctggcaccgtcgcgccacgcgacgactaccccaaacgccgcgggtccgcgccgtctccggcgccggcgccgactcggcagcgcctcgtctcgctcgacgtgttccgtgggatcaccgtgctgcttatgatcatc

SEQ ID NO: 68222 - DNA, 404 bp, Zea mays
  Clone ID: LIB3076-015-Q1-K1-A2
caccacacggcctccacccagatccagacatacaatcttttttcgctcacatcttcagctcccaggataagtttaaataactcggctagctgccaactgatctggtaccaaacacttgaccaactcctcatcatgttcaaagcattcctcattcactacttcctcaacctcaagaacaaccaccactacccctgatcacaaacctcatcaacctcgacatacacatacactatcgccgctgaaattgccaccctaacctttcagccttactgcaatggcatcaatgaccagatttctgacaccgctctaccatgacaggacccatcaattacaaatgcctcttaccaaggagcctaagttgcactgctcgactaccatgacacccatctcgccaccttctacaa

SEQ ID NO: 68223 - DNA, 453 bp, Zea mays
  Clone ID: LIB3076-015-Q1-K1-A3
tcatacgctcaccagaacccctggttcaatggttctttctccccccctgtcgctaatggtagggggagtagatatacaaagtcgggcgccatcacaaaactgttcccgttgctgagcttccaagtgcacagattaccgcatgccactgcctattgacctgctgcagattttccttattgatacagccattctttccatgggtggcatggccatggcttccctcgccaagcaccacaaggccaacatctcgatgcctactttaaagtgctgcttctggcagtttatgtgcttgtaattgccaacctaatcgcattttagattatatatgtctatccatatctctattccttgctggtgcttaccgtagatctaacatcattgcatcttacattgcttccaaatttttatgtccatgtgtaaaaaatattttattctatcgctattaaaatactt

SEQ ID NO: 68224 - DNA, 456 bp, Zea mays
  Clone ID: LIB3076-015-Q1-K1-A5
aacgcgcacgcgtgggcggacgcctaggtggcatctggctgcgctaccagagcaggacgggttagcacaatttgaacaaggggtaccgcgacaccaccctgaacggcgcagtggagcagatgtacaacgagatggcctcccgccaccgcgtgaggtccccctgcatacagatcatcaagacagcgacggtccacttcaagctgtgcaagatggacaacaccaagcagttccacaactccgagatcaagttcccgcttgtgtaccgcaaggtcaggccgcctaccatgaagctacggaccactttcaaggcttccaagcccaaccttttcatgtgagaagtatatcgtacccgtgttctgtgtcttgagcgccctaaaaataatgattctttctgtgcaagtttttggtgcccttgtccgatgagcactttcgtttgattccaattaatgatttgaa

SEQ ID NO: 68225 - DNA, 457 bp, Zea mays
  Clone ID: LIB3076-015-Q1-K1-A6
ctgcaccagaccacccggctccagcgagatccagacccaaaaccttttctcgcagccaacctctgctcggaggggaggggaagggaagcaatggcgggcaacggaggcgggtaccgggcggaggacgactacgactacctcttcaaggtggtgctcatcggcgactccggcgtcggcaagtccaacctcctctcccgcttcaccaagaacgagttcagcctcgagtccaagtccactatcggcgtcgagtttgccacccgcagtctccaggtcgacggcaaggtcatcaaggcccagatttgggacaccgccggccaggagaggtaccgtgcaatcacaagtgcctattaccgaggagccgtaggggcactgctcgtctacgatgtcacccgtcgcgccacgttcgacaacgtgggccgttggctgagggagctcagagaccacaccgaccagagca

SEQ ID NO: 68226 - DNA, 430 bp, Zea mays
  Clone ID: LIB3076-015-Q1-K1-A7
cgcaccagaacccctggttcaatggtgctggcgccccccctgtggctaatggtaggggggggagttacactttgtcggccgccatcggagggctgttcccgttgctgagcttccaggtgcacggattcccgcaggcgactgcctatgggcctgctgcagggtttccttatggatacggccattctttccatgggtggcatggccatggcttcccgcgccaggcaccacaaggccagcaggtcgatgcgtacttgaaggtgctgctgctggcagttggtgtgcttgtaattgccagcctaatcgcattttagattatgtatggctggcgatgtcgctggtccttgttggtgtgtaccgtagttctagcatcattgcatcttatatggctcccaaagtttgatgtcaatgtgtaaagtattgtggatgcttc

SEQ ID NO: 68227 - DNA, 437 bp, Zea mays
  Clone ID: LIB3076-015-Q1-K1-A9
acgtccactcgtacttccactcatcttcatacttttacggtcctagatctcgatctgtgaccagtcaacatattcacagagtctacattgcccatatatcaatctattagattcacgcgcagaaactctagattcacactccaccattgactctccataaaacctacctatatcctcccaatcaagcccttacgccgatctgcgcctcgcaactacatcctacaatcgctacacctacattccgcgccatcatctcccgaatctcctcgtctatccatcacaccttctcacatctccaaccgtgtactgagctcatcatccgtaacttcatgtactgaatcgacaccctctccgaagcatactctcgaatccgctagaacttcgtctactttcacgtcaattacctaaccctaatccagtactcgctagcggactct

SEQ ID NO: 68228 - DNA, 432 bp, Zea mays
  unsure at all n locations
  Clone ID: LIB3076-014-Q1-K1-H2
tcgcccacgcgttcgcccacgcgtccgcggacgcgtgggctcgccgtcgcctgcccgggcctcgtcgagctcgacctctccaatggggtcgacctcggggacgccgcggcggccgaggtggcgcgggccatggcgctccggaggctgtcgctggcccgctggaagccgctgactgagcgccnctnggatgcgttgtcgtngggtgcacggagntgatggagatgtcgattaagtggtgtcttgggattacggatctggggatccagctgcttgccctcaagtgcacgaagctcaccaggctgtatctctcctacaccatgatcacaaacgctagcttgccttccatcatgaagctacccattcttcactagttgacactggtggggtgtattgccaccgatgatgatgctcttggtagccctgagagagaat

SEQ ID NO: 68229 - DNA, 158 bp, Zea mays
  Clone ID: LIB3076-014-Q1-K1-D3
acgcggactcgtgggcaccgcatccgccgcccgctcgctcgcctccgcttcggcagcgagctctatccccctcgactagcagtagttgtcaccgactcacgcataccgcggaataaatattggtattggtagtgtgatatctatattaagtcaagatg

SEQ ID NO: 68230 - DNA, 471 bp, Zea mays
  Clone ID: LIB3076-014-Q1-K1-D6
ctgagctaagcatacgcggtctggtgtgcacgtcagccattgcaccctccgtcgcctacgctccgggcctgttcaagatgaatgtggacaagctcaagatgatggcggctgatgcgcacactggaagaaagggcagcatgcgcaggaagatgaatgtagtacacaagaccggagccaccgacgacgcgcggcttcagagcacgttgaaacgaattggactgaacactattcctggtattgaggaggtcaacattctcaaggatgacattgttatccaatttcagaaccctaaagtgcaagcattcattcctgctaatacatgggtagtcagtggagtaccccagacaaaacgtctacaagaccttgtgccaacacttatcaaccaactgggccctgataacctggagaacctgatgaggcttgctgagcatttccagaagcatgtacctgatgccgaagccagctccagtg

SEQ ID NO: 68231 - DNA, 84 bp, Zea mays
  Clone ID: LIB3076-014-Q1-K1-D8
tcgtctagatcgcgagcggtcgtccttttttcttttgttcgtttactctcctctagttagcttggtccggttcttttagctgca

SEQ ID NO: 68232 - DNA, 220 bp, Zea mays
  Clone ID: LIB3076-014-Q1-K1-D9
tcgggggtatgtcttcaagatcacgggtggatgtgacaaacaaggctttccaatgaagcaagggggtctgacttctggtcgtgtgcgccttttgcttcacaaaggcactccctgctttcgcggatattgcaagcgtaatggtgagcgcacgaggaaaactgtacgtcggcgtattgtgagccaagacccatatgttatcaaactctggaattgttaaaaa

SEQ ID NO: 68233 - DNA, 271 bp, Zea mays
  Clone ID: LIB3076-014-Q1-K1-E12
tcggcctagccttgctccgagcggtcgttgcggcgactgccacgatgatggactgcgctggaggccgagaccccgtggaggacttcctcctcggcggcgccggctcctgctacgacggagatctcgtcgccgtcttctgcgacggcggggccggtgacggacgactcggcattgagggtatccatcgagatgcttgtggatttgagcaatctaattcggggaacaggggcagagatgaaccctgatcatctcgtccaacctcccaagcttg

SEQ ID NO: 68234 - DNA, 282 bp, Zea mays
  unsure at all n locations
  Clone ID: LIB3076-014-Q1-K1-E2
cccacgcgtccgcccacgcgtccggttctagatcgtgccttgcctcgtgtataataatactgttttgtatcgtaaaaaaaaaaaaaaaaaaaaaaaaaaaaaaaaaaaaaaaaaaaaaaaaaaaaaaaaaaaaaaaaaaaaaaaacaaaaaaaaaaaaaaactttctnttctncaaactaaaaaaaaaaaaaaaaaaaaaaaaaaaaaaaaaaaaaaaaagggtaatgattttaaaataaatatattaataacaatagtataaaaaaaaatatattttttta

SEQ ID NO: 68235 - DNA, 455 bp, Zea mays
  unsure at all n locations
  Clone ID: LIB3076-014-Q1-K1-E3
cggacgcgtgggcggacgcgtgggcttggaggtggtaccttcgatgtctccctccttacaattgaggaaggtatctttgaagtcaaggccacagctggcgacacccatcttggtggtgaggactttgacaacaggatggttaaccactttgtccaggagttcaagcgagagcgcaagaaggatatcactggcaacccgagggctctccggcggctgaggacctcttgtgagagggccaagagaactctgtcttccactgcccagaccaccattgagattgactcgctgtacgagggcattgacttctactccaccatcacccgtgccaggtttgaggagctcaacatggacctgttcaagaagtgcatggagcctgttgagaaatgcctganggatgccaagatggacaagagcagcgtccatgatgttgtccttgttggtggctccactaggat

SEQ ID NO: 68236 - DNA, 361 bp, Zea mays
  Clone ID: LIB3076-014-Q1-K1-F10
tcggcttcattgctctgttcatggaccctctgtacttctatgtgcctgaaatcgattacaggcggacctttcattgtgtcaggaaggatacacgcctagccatcatcgttactgtgttccgatcaattgtcgacctcttttatgtcatccagatgatgataaagttcaggactgcatatattaatccaagctcaaacttaggggtttttggtcgaggagatctcatcacagatcctaaggaaatcgcatagcagtacttgagatctgactttgatgttgatttggtggcttctttgcctttaccacagatcattatttggtctgtgataccatctatcatatattcttcgtctgagcatgg

SEQ ID NO: 68237 - DNA, 441 bp, Zea mays
  Clone ID: LIB3076-014-Q1-K1-F11
gtggagaacctgcccgatccctcccgccgcctccgacctcaccgtcggcgggctcagcttgttcctggggtctgatcagccatgttcaagaaacctgttgatgtgaaaaccatacagcgcttgtctggggcagacaaaaagaagctaagaagaactgccaagggaaggtttccacaggcttctgatgctgaccttgatgccatccttcctcccaaggctgagataacagttgctaagtacccgaaccatgttcttgtatatggcatagagggagagttcccaatgattttcaacactgacgcaagaggtcatgaactgtttcctacagtttatgcgctttggaaggtcccccatctgttgccagcttttacgcttaaaggtggtgaggtttcacgtttcgtgattggtggcgctgatctgatgtttcctggtatcagcata

SEQ ID NO: 68238 - DNA, 444 bp, Zea mays
  unsure at all n locations
  Clone ID: LIB3076-014-Q1-K1-F12
aaagaagaaaggcatagcagcgggcagcggcatgggcaccagccccgtcatccctgcgacgatgctcttcgtcgctcttcttgtcgctgtctgcttcggcgccaccgccgccaggtccagccacgcccgccacaccgacgccgacgacgcgattcgtctccccagcagctttggcgctggtggtcgaccgtggaattgctgcgactccgctatcaaggacgcctccctgccggcgtggcgctgcaacgacgtggtggacaagtgctccgccgactgccaggactgcgaggcgtcgccggccggcgacggcttcgtctgcggtgactntatcttaagcctgaccgagcccccggtctgcacaccgaggccgtgggactgctgcgacagcgtggcctgcacaagggactacatccacaactgcatgtgcctggacaaagtggagtc

SEQ ID NO: 68239 - DNA, 454 bp, Zea mays
  Clone ID: LIB3076-014-Q1-K1-F3
gctcgcttggacatttgaaagacaaggtaccaagttggaatggcggtggaagctgcagccttcaccaaacacgcagcagactatatctgagatcctggattttcttatggatgcaaatatacgcttaagtgtatgtccctttgcttcacctcttcactttttcaagctagcccgcattctgaaacaggtttgccaatcgctaagctctgcttatgttgatgaccaagggatgaattggttcttgaggcgcagatgaatataaacttgatttccctgaattattcctaccaaagctactgaaccacttcagcacgtttcttacttggccctaaatttacggaattctctatattttcctcactttaggaagaggttgtgaggaaaacacaatcctttgacaagttgaaacaagaagctgagaagtgcttgcaacaaagtgagagatttaacaatg

SEQ ID NO: 68240 - DNA, 430 bp, Zea mays
  Clone ID: LIB3076-014-Q1-K1-F6
cggacgcgtgggcgcgcgttcgacggccacgaccgcgtccacgtcatcgacttcgacatgaggcaggggctgcagtggccgggcctcctccagagcctcgccacgcgcgtggctcccccggcgcacgtgcggatcaccggcgtcggcgagtcaagacaggagctcgcgacgcaccggcgcgcggctggggcgcgtggtcgccgcgctcgggctcgcattcgagttccacgccgtggtggaccgcctcgaggacgtccgcctgtggatgctccacgtgaagcgcggcgagtgcgtcgccgtgaactgcgtcctcgcggcgcaccggctgctccgcgacgagaccggcgccgtggtggccgaacttcttgggctcacgcgcagtacgggcgccggcatcctacttctgggcgagcactaggacgccctcaac

SEQ ID NO: 68241 - DNA, 415 bp, Zea mays
  unsure at all n locations
  Clone ID: LIB3076-014-Q1-K1-F7
gcaaggggtccgggactggacgggcaccggttataaataaccacacacgcttaagggctgaagcggaccaagcagtggcagtgattagccactatactactcgtaggtactaccagcgggttgcttgaacagtggaagagagcgagccgaggatggcgtagcgggactcgttgttggnggtcctgctgctgctggttgaggtggacgtgctggcgctggcgcgcgcggacctgacgcacgacaactgcgtgaagaacaagaaggtgactgagcataacctgtgcagcgacgacgtgacgctgatgctggagccgctggccaacagtgcgccgatgttcgtgggcacctacacgttgtacccgtgcagtcacgccgagttacccgtgtgctggtggacggagagcctgcgcgcgcc

SEQ ID NO: 68242 - DNA, 453 bp, Zea mays
  Clone ID: LIB3076-014-Q1-K1-F8
gaccggttgcttaactatgtaaacgaagagttggcagaaagcgacgtttacatgtcttaggttcctcttgcacacatctttgatcgtgttgtggaggaattgtttattttccatggtgcctctattggattctggcaaggggatgttaagctactagttgcatcgaatcgacgtgctgaaaccaacaattatgtgtgctgtttctagtgttcttgatcggatattttctggactacaagctaaaatttcctctggtgggtttttaaagagtacaatgtttaatcttgcttacaaattcaagcagtttagaatgatgagaggagctaagcacaatgaagctgcttccatatgtgacaaagtagtttttagtaatgtgaaagagggttttggtggaaatgttagagttattttatctggagctgcttcacttgttaccaatgttgaagaatactt

SEQ ID NO: 68243 - DNA, 446 bp, Zea mays
  Clone ID: LIB3076-014-Q1-K1-G8
ctcatcttttcgcgtttagaacctctaaaatttcccccactcgccagtcgcagcagcacgtgtagccatggacgccagcggagccggtagcaaggggaagaagggtgcggccgggcgcaaggcaggcggccccaggaagaagtcggtgacgcggtccgtcaaaggcggagctgcgttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcattccgcgccacgtgctcctggcgatccgcaacgactaggagctcgggaagctgctggcaagcgtcaccatcgcgcacggcggcgtccttcccaacatccactccgtgc

SEQ ID NO: 68244 - DNA, 453 bp, Zea mays
  Clone ID: LIB3076-014-Q1-K1-H1
acggttgaccatgctggcgagtcagctgcgcaagggaacggtcatggatggcaatggcgtcaaagatcctcggttggactacgcttggttacagaggaatttttgcagctgacactataccacccctagttgagtctgacaaagaagcagatgaacgccattatgactgtcgcggatagaaaatggagtcgcagaaggttcgactgagatcccaaaaggcgaagcaatcccgctggagtacaatcttgctggcttgaacgccatttcgttcgagaagggctgctacatcgggcaggagcttatcgctcggacgcaccatcgcggtgtcatccggaagcgcctaatgccaatgaagttcgtcgacgggaatgggcaagaactcgagcatgccgtcgctccaggctcggatgtcgtggacgaggcttcaggcaagaaagtctgggcagtgagcac

SEQ ID NO: 68245 - DNA, 338 bp, Zea mays
  Clone ID: LIB3076-014-Q1-K1-H10
gttcttcagtaggcagaggtgctagcattccagatgttgagcaccacagctcaattccaggctttgatggaccctcagaggatgaatccaacattctttttgttgattgtcttcctactgattgcacaaggagagaagtagctcattagtttcgttgttttcctggcttcaaggacatcatagtagtgcacaaggaacccagacgtagtggtgacaaggcctatgtcctgtgctttgtggagtttgagaacgcgaaattcgcacgcacttccatgcaagctatacaagggtaccgcttcgatgaccggaagcctgacgaccggtgtctctagatccat

SEQ ID NO: 68246 - DNA, 322 bp, Zea mays
  Clone ID: LIB3076-014-Q1-K1-H12
taccggatcggaatttcgggcgggacctcatgttagttagccatgttgaacggtgcttatcgcaattttgatcgccacaggatcaatggcaacgcattggacaggacccttagagagatggtgacaacattctttataagggagtagggttcctactgattgcacaacgagagaagcagctcattaggtcctgtgtattcctggctttaaggacatctgagtaatgcacaaggtacccagacgtaagggtgacaatgactatgtactgtgctatgttgaaattgagaacccctaaaattcactcactacaatgcaagcttta

SEQ ID NO: 68247 - DNA, 110 bp, Zea mays
  Clone ID: LIB3076-014-Q1-K1-D10
cagacggacgcccacgcgggcgaaaaaaaaaaaacaaggaagaaagaaacaaaaaaagaaaaaaaaaaaaaggaaagggggaaaacggggggacgggagccaagaaccaa

SEQ ID NO: 68248 - DNA, 453 bp, Zea mays
  unsure at all n locations
  Clone ID: LIB3076-014-Q1-K1-A5
cccacgcgtccgatcatcactgactactgcatgcccggcatgacaggatacgatctgctcgagcgagtgaaggggtcctcatcgctcaaggacattccggtggtgatcatgtcgtctgagaacgtgcctgcccggatcagcaggtgcttgcaggatggcgcagcggngctgctcctgaagcccgtgaagccggccgacatgaagaagctcaagtcacacctgctgaagcggaagcagcccaagcagaagaacaagcctcaggcgcaggcggtggagtctcctgagcagcagctggacccgcatccgcagccggtgcacgagccggaggaagccgcagcagatcgcaacggcgtcaacaagaggaaggcagcggccatggaggaggggctgaccgtggtggtgacggcgccggagagcaccaagccgaggaggctgtctacgaacaagctgact

SEQ ID NO: 68249 - DNA, 454 bp, Zea mays
  Clone ID: LIB3076-014-Q1-K1-A6
cggacgcgtgggcgccgccgcagccatccgcttctcttcggttcagctctcgagtttccaggatgaaggtaatagctgcctacctgcttgctgttctgggtggaaacacttccccgactgctgatgatgttaagagcattctggaatcagttggtgctgaagctgatgcagcaaaactagagttcctgctcacagaactcaaagacaaggacataacagaagtgattgcagctggaagggaaaggttatcctctgtgccttcaggtggtggtgcaattgacatgggagctccagcagctgtagctggcggtggcgcagcacctgctgaagaggcaaagaaggaagaaaaggttgaagagaaggaagagtctgatgaagatatgggtttcagcttgttcgattaacacaccactgccagtttacagtttctctcgcgaatggtctcacaatattc

SEQ ID NO: 68250 - DNA, 287 bp, Zea mays
  unsure at all n locations
  Clone ID: LIB3076-014-Q1-K1-A7
cgcggacatcagcaccaggcgctcccggactggcaccgggctcaccacgcctatgccaagccatncttccgggcacgcgcccgcgtgccgacgatcgactgccgttgccagtgacgacgcgctactcctccttgccggcgtattactcctctcgcgccgcatttcacgcagttctgcataggtcagccaagattcgagcgccggcgaggcgttgtcagagtggaaccagaacataagcttgaagaagctcaagtttcggcaaggcggatgtggccggagcgcgcgag

SEQ ID NO: 68251 - DNA, 335 bp, Zea mays
  Clone ID: LIB3076-014-Q1-K1-A9
acggttccgccgtcctgcagcagaggcagggggttgccgctctcgccgccgcacgctgcggctgtgctctgctccgcctgatccttcctgcggcccttgttttttcctctcgtttcaggtggccagccttggttttgcagagctcattcagtggcctctgctgaaaagtgttcaatggcgtcaggagccaccttaagctgggttaaaaccccatttgacacccgaagatttcatgacctatctaatctaagtttccgctgccgaaacccttttggatcaattcagccctggtggctgcaaactgatcaagactcatccctaatcaaggttcgcgt

SEQ ID NO: 68252 - DNA, 438 bp, Zea mays
  unsure at all n locations
  Clone ID: LIB3076-014-Q1-K1-B1
gaagcaacataacgctggcatggctgaagcagggaaatctgactcctctgatggtcctacggccaaccaagaagaatttcgtcaggaaattcgcagtataattcacgatgaatttgaaaaatactgtagaacacagcccattcaaaactctgtgagcacaactgacgacagaaaccttcatgtggctgatgaaccaacggcactgaaatccaaggacatgaagatggctaattcaggattgacaaatctgcacagccaagcaatgacgtatgcaaggctatctgaagccccaggacttaagatgggttcttccttgagtgggaactaccaagatcaatctaaggagatggatgggctgctaactgtactgccaatatcagctgaaagtgctggattacttnncaagccgccagatggaccaacaggctcagatctagt

SEQ ID NO: 68253 - DNA, 229 bp, Zea mays
  Clone ID: LIB3076-014-Q1-K1-B10
acgcccacgcgtccggtttccctctttgaataacagcggaaacacatcaccatgaccagcatggtgccaggcatatttctgggagggaaacttacacaaaatgggtgctatagactatataacgatcctaaaccatcggatcaataaccaaaacgaggtctgtatggaggatacgccaaagatgcttgatgacgttaatggtggatctctcatattttacaaaggaata

SEQ ID NO: 68254 - DNA, 379 bp, Zea mays
  Clone ID: LIB3076-014-Q1-K1-B11
acgggcgccttcgtgcagcctgctttctacgaggctttcgggctgacggtggttgaggccatgagctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtaccgggttctggaagtacgtgtccaacctggagaggcgcgagacccgggggtacctggagatgctg

SEQ ID NO: 68255 - DNA, 75 bp, Zea mays
  Clone ID: LIB3076-014-Q1-K1-B12
gacgcccacgcgaccggaagccctctatgaataacagcggaaacacagcaccatgaccagcagggggcaaggagg

SEQ ID NO: 68256 - DNA, 146 bp, Zea mays
  Clone ID: LIB3076-014-Q1-K1-B3
tcgttcattacgtagctcgagcatgaatgtacctgtgtgctctgatacgctgacacggtctgggggcaatcattaagaaagatgtcacggtaattgcgccctatatgtcctccataacatgtaggtattgtagatcacatgctatt

SEQ ID NO: 68257 - DNA, 122 bp, Zea mays
  Clone ID: LIB3076-014-Q1-K1-B5
acgattgttaggtcttggaattgattttttacctagcagattgcacaatctcatgtggggtaggtcaattataataggtgttgggaatgcacttatgataattacatgtattatcatgattg

SEQ ID NO: 68258 - DNA, 345 bp, Zea mays
  Clone ID: LIB3076-014-Q1-K1-B6
ttcattaggtagatcgagtcttagcgtccgtctctgcgcctctacgctgagacggtttgtttgggttaattaagttagctttcgtggagatttcgccccggggcatcaataaaatgttggcatgcgtggtgggatgctatccttttttttattttattttattttattcttaacttggatcagttggggttttgaacattgctagtgtcgtgtgattgggaaggctaatgtgatgccttcgatgcagagttttcaatgaatgccttggtgcaaacgtacgattgtgtaataatgccttctattgatcagcgactccaatagtccaatgtgcaagtattcttcgtc

SEQ ID NO: 68259 - DNA, 452 bp, Zea mays
  Clone ID: LIB3076-014-Q1-K1-B8
attgtcaggtcttggaattgtttttctaccgagcagaatgcacaacctcatgtatgctatttcaatcataataggagctgcgaatgcacttatgacagtgacaagtattagcatggaaggtgttttagtaggagaagatctaaatggttgtgcttttgtgtatcgctcgttaggttttgttgacaaagtttcatgtggagtagttctgtatattcttgagtcctatcaaggaagtacagagatcagatcaaatttaggaacagcatttggctattcaattacaagacttggcttgggcttagttccagctgtctgttcgctgctttcatcaatagtggcttataccatggacctccctgaccctgatactcggcggagacctttggtggagccccttctagtataacttcactggtgacctgttacagtttcatcctgaacatttacattaa

SEQ ID NO: 68260 - DNA, 461 bp, Zea mays
  Clone ID: LIB3076-014-Q1-K1-C3
tcgcgcttgtagcccgccggagatccatgcctttgtgagctcgcgagtggagagaaaaaaaggagcagcgaagagcgaacgaccgagatgctggagaagctgtgggacgacgtggtggccgggcctcgcccggagacgggcctcgagaagctccgcaaggccaccaccgcccgcccgctcgtcgtcgtcgacaaaggtgcgttttgttgcagtcgatgccgtcgaccccgacgacgccggtgacgccttcgacgacgacgacgccgcgcggcgccagcaacgtgtggcgcagcgtgttccacccggggagcaacctggccaccaagggcatgggcgccaacctcttcgaccggccacagtccaacttccccaccgtctacgactggctctacagcgacgagaccaggagcaaccaccgttagatcggaacggacgaatcgggtggtagtggtggatgaaga

SEQ ID NO: 68261 - DNA, 448 bp, Zea mays
  Clone ID: LIB3076-014-Q1-K1-C4
cccacgcgtccgcttccttcttgaagcttcgtggcgctgtacgaccgggaggacgtggaggggattgggctggacgacgcggccaagcgtctcggcgtcgagcgacgccggatctacgacatagtcaacgttctcgagagcgtcgggattcttgtgcggcgcgcgacggctcggtatacatggctcggattcgggggagtccctgctgcgctgaaagaactcaaggagagggcgctaaggaagatgtccggatcaccggtgttactgtcaatggaggactcctctactgccaacttatcagatgatgaggatgatgaaaaattgggcgatgctgatgaagatgctgagagcgagaagctcagccaacctgttgacaatacgtctgataagcctgacgcacccagctgccgccttagatctgatcatcggaaggagaagtcccttgggc

SEQ ID NO: 68262 - DNA, 423 bp, Zea mays
  Clone ID: LIB3076-014-Q1-K1-C5
tcgcggcaacctggagctcgccgccgcctcgctcggcaacaccggcgtgcagatgttcgcctacggactcatgctgggcatgggcagcgcggtggagacgctgtgcgggcaggcgtacggcgcccacaagtacgagatgctgggcatctacctgcagcggtcagcggagcgctgtgcgcgacgggcgtgccgctggccgtgatctacggcttctcggagccgatcctggtgttcctggggcagtcgccggagatcgcccgcgcggcggccatcttcgtgtacggcctgatcccgcagatcttcgcgtacgccatcaactttccgatccagaagttcatgcaggcgcagagcatcgtgctcccgagcgcgtacatctccaccgcgtcgctggcgctgcacctgctgctgagctgggtggtcgtg

SEQ ID NO: 68263 - DNA, 184 bp, Zea mays
  Clone ID: LIB3076-014-Q1-K1-C7
gtaccggtttcggaattccgaggtacgcgtacgcgtacgcgtacgcaccggattcgttgtccgatcgttctgctctgtccgacagtgagctgggtccggggatacgagtaggagatgccaccgacacactcagacctgagaataaatattggtattgcgtgtgtgatatttattagaagttaag

SEQ ID NO: 68264 - DNA, 439 bp, Zea mays
  Clone ID: LIB3076-014-Q1-K1-A4
cccacgcgtccggtggatcgcttcaaggaagtgataggtgcactggaaacagccgtggagaggtcttcaatcctggaaccagaaagcgcagcagcagcttgtagcgtactagaatccttttgggatatggtgcctggatctggcagcggaggacaaggtcgacggcggcagctgaaggacagtcattctatacagaaggatgattcaagcaaaggacaaggcggtttgaatttcagtatcgtagccgctctgattgtgctactggttgctctgatagctggactgctcttcactggttccgccggatacccaatataatacctacgtaactaactgcgctgtaccccaccagtagatgcgaaaagcaaagatgttagaaactgttgaagtggagagttgaatttatttaatgttagaagctgttgttcacatctctatt

SEQ ID NO: 68265 - DNA, 370 bp, Zea mays
  Clone ID: LIB3076-014-Q1-K1-C9
tcggaccggttgcttaactatgtaaacgaagagttggcagaaagcgacgtttacatgtgttacgggcctcttgcacacatctttgatcgtgttgtggaggaattgtttattttccatggtgcctctattggattctggcaaggggatgttaagctactagttgaagatattggtgtgctgaaaccaacaattatgtgtgctggtcctcgtgatcttgatcggatattttctggactacaagctaaaatttcctctggtgggtttttaaagagtacaatgtttaatcttgcttacaaattcaagcagttcagaatgatgagaggagctaaacacacatgaagctgctttcatatgtgacaaagcccctttt

SEQ ID NO: 68266 - DNA, 434 bp, Zea mays
  Clone ID: LIB3076-014-Q1-K1-D1
cggacgcgtgggcaccgcagccgccgcccgctcgctcgcctccgctccggcagcgagctctatcccccgcgacgagcagcagctgccaccgacgcacgcagaccggggaataaatattggtattggtagtgtgatatctataagaagtcaagatggtgaagttcacagctcaagagctccgtgctatcatggacaaaaagaacaacattcgtaacatgtctgtcattgctcatgtggaccatggcaagtctacgcttacagattcccttgtggcagctgctgggattattgcccaggaagttgctggtgatgttcgcatgactgatactcgtgcagatgaagcagagcgtggcattacaatcaaatctactggtatctctctttactatgagatgactgacgagtcactgaagaactacaagggtgaaagagat

SEQ ID NO: 68267 - DNA, 378 bp, Zea mays
  Clone ID: LIB3076-013-Q1-K1-E1
cgcccaccgcgtccgcccacgcgtccgggatcgtgcataatccgaggttcttcctctctgtcgtctccgatccagacgggtgtgcctggtctgcatcttcatcctctgcaagaaatcacacatctcgtggcgcaccttgcatcagccgcggccggcacctctactctcgcccgccccctatgtcgtaagcgcgcaatcagaactcccgatcacccgcacgctggtgcgccagtgtcgtcttcgccaccatgaactccatcgagcccttcaacaggctggtgaagctggcggcccgcgccttctacgatgacgtctcaatgaaaggcgacaaccagcccaagacctcccgcggggacaaccgcggcatggtcgtcgtcg

SEQ ID NO: 68268 - DNA, 338 bp, Zea mays
  Clone ID: LIB3076-013-Q1-K1-E2
gcgttcgtccacgcgttcgcccacgcgaacgcgatcgtgcataatccgaggttcttcctctctgtcgggtccgatccaaacgggtgtggctggtctgcatcttcatcctctgcaagaaaccacacatctcgtggtgcaccttgcatcagaccgggccggcacctatactctcagccgccccctatgtcgtaagcgcgcaatcagaacttcctatcacccgcacgctggtgcgccagatgtgtttttgccaccattaactccatcgagcccttcaacaggctggtgaatctggctgaccccgccttctactataacatctcaatgaaaggcgacaacca

SEQ ID NO: 68269 - DNA, 436 bp, Zea mays
  unsure at all n locations
  Clone ID: LIB3076-013-Q1-K1-E4
gggggggggggggggggggggngnnnnngggggggggggggggggnnnnnnggggggggggggggggggggnngngnnngggggggggggggggggnnggggggggggggggngnggggggggggggggggggggggngnggggggggggnggggggggggggggggggggggngggggggggggnggggggnngggggggggggggnnnggggggggnggggggggggggggggggnggggggggggnggggggggggggggggggggggggggggggggggggggggggggggggggggggggggggggggngggggggggggggggggggggggggngggggggggggggggggggnngggggggggggngggggaggggggggggggggggggggggggggggggggggggggggggggggggggggggggg

SEQ ID NO: 68270 - DNA, 79 bp, Zea mays
  Clone ID: LIB3076-013-Q1-K1-F6
tgaaatcttgctgttgcaccttgtgcctcataaaaaaaaaaaaaaatacaaaaaaaaccgggaatttaaaaaaaaataa

SEQ ID NO: 68271 - DNA, 334 bp, Zea mays
  Clone ID: LIB3076-013-Q1-K1-F7
tcacaccgtgccaatctacgaaggttatgcccttcctcatgccatcctgcgtcttgacctgggtgggcgtgacctgactgacagcctgatgaatatcctcaccgagagaggttactccttcaccaccacgggcgaacgggaaatcgtacgggacatcaaggaaaagcttgcatacgtggctcttgactatgatcaggagctggagaacgccaagagcatctcatctgtggagaaaagctactagcttgctgatggccaggtgaccaccattggggcggagaggtttcgatgcccctaggtgcttcttcaagccttctttcattggtatggaaac

SEQ ID NO: 68272 - DNA, 238 bp, Zea mays
  unsure at all n locations
  Clone ID: LIB3076-013-Q1-K1-G1
agctgggaaacccggtgctggagttcgcgacggacttcaacgcccgagccgagtacttgtgggcgcacggtctcatctccgacgccacctaccgcgtgttcacctccgcctgcaactactcccggtacgttaccgagtactacggtggntcgatgtcgccgctgtgcgcccgggtgatgaaccaggtgacgcgcgagaccaggcgctttgttgacaagtacgacgtcacgctcgacgt

SEQ ID NO: 68273 - DNA, 375 bp, Zea mays
  Clone ID: LIB3076-013-Q1-K1-G10
ggtcgcagacctcaggccacgagtgaacgatcagacggatagcaaacatctaaaagctgctacaacaccatcggggggaactgactccttacgggcgctagtccatatcaactgttatttgggctcttcctttcccgcgccatgtgttggcgatcgtactgataatactgaaggctgtcagaagttttttttataccttacatggttagcctttctgtacaaaggtgaactctatgtctggtgtttgttggcatccatgccttattttgcgaggtacatcaagttgacaaaatgttcggagggatagggtgaaaacgctgcacgcgccatattttgtggagtgtgaaaacagagcctgtacagcatattcaccac

SEQ ID NO: 68274 - DNA, 331 bp, Zea mays
  Clone ID: LIB3076-013-Q1-K1-G11
aagcagcttctgcaacttcaggcggggctgtctcttgacgggcgctagtccataacaactgtaatttgggctcttcccttcccgcgccaggtgtgggcgattggtactggtaatactgaaggctggcagaagttttttttcttccttccatggttagcctttctgtacaaaggtgaactctatgtcgggtgtttgttggcatccaatccttattttgcgaggtacatcaaagtttgacaaaatgttcggagggatagggtgaaaacgctgcaagcgccatatttttttgagtgtgaaaacagagcctgtacagtatattcacccacccatt

SEQ ID NO: 68275 - DNA, 115 bp, Zea mays
  Clone ID: LIB3076-013-Q1-K1-G12
tcgggtcaactagctttaacgcctcaccctgcgaatatggaccatgcaactctccgtaaacgtgtgttgttaatggagacagagtctattcctctttcaaagatacaacgtgttc

SEQ ID NO: 68276 - DNA, 414 bp, Zea mays
  unsure at all n locations
  Clone ID: LIB3076-013-Q1-K1-H1
ccacgcgtncgcaatagtgtctggctcacctcacctgcagcaggtctcgtctcggtcatgcagcgcattgctctcgatcgctgcagcgcatccagtccaaacacacaccggtcgaatcgagcaatggccgcggggctgcaggtgttcggacagccggcttccaccgacgtcgccagggtgctgacctgcctcttcgagaagaacctcgagttcgagctcgtccgcaccgacaccttcaagaagtcgcacaagctccccgagttcatcaagctgagggatcctaccgggcaggtgactttcaagcacggtgacaagacaatcgttgattccaagactatctgccggtacctgtgcacgcagttcccggacgacgggtacaagaagctgtacggcacggggtcgctggagcgggcg

SEQ ID NO: 68277 - DNA, 405 bp, Zea mays
  Clone ID: LIB3076-013-Q1-K1-H2
atagatctcagtgcagtgcttccctgttccctccatcaagaaacagcaaagatccagtgcagagagagagaagcgccatggctctctgaacaagaaaagaaagagctagagagatctcagtcagccagtctctcacaacacaatgccggcgaccaccaagccgatcttgctcccaagggcgtgggcagcagcgccactcctactactgctgctgctcgttctgcacgggagaggaggccactgcgtcggcatggatgcggcggatcttgagatggactcagaggcgcaccggcggctgctgtgggaggcgaccacggagcggaggtacatcagctactacgccctgcggggcgacatggtgccgtgctccaagaccggcgtgacctactacaactgccggatctt

SEQ ID NO: 68278 - DNA, 242 bp, Zea mays
  Clone ID: LIB3076-013-Q1-K1-H3
atcgatctcacggaataagcttccgtgttacctccattacgaaacagcaaagatccagcgcgcagagagagaatcgccatggcactctgaacaagaaaagaaagagctagagagatctcaggcagccagtctctgacaacacaaggtcggggaccaccaagctcgatccttgcttccaagggcgggggcagtagctccactactactactgctggtgctagttctgcacgggagacgaggtc

SEQ ID NO: 68279 - DNA, 310 bp, Zea mays
  unsure at all n locations
  Clone ID: LIB3076-013-Q1-K1-H5
cccgggccgacccacgcgcccgccaacccatgctcaaagaaaaaaaaccggggcggngaaaaccctcgaaccctaaggcttacgcccctcatgggggacgctgatgcggctctgccaacgccgccttcggaggtagtagcccccgaagagcatcccgtgggcgccgaatccaccgtcgccgcgccggccgaagtcaataacaagcggaagctagaggaggtcacctccgactcggaggtgaaaggcaccagcgaggacgccaagcgcccgcccgtggacggcgagccctactccccaacacgggttgagc

SEQ ID NO: 68280 - DNA, 451 bp, Zea mays
  unsure at all n locations
  Clone ID: LIB3076-014-Q1-K1-A1
ggatgtcactatttatgccagccagattcgccagctatttggatttcacgagtcatcgactcgtcttcacagcttatgctatggcacctctgaccctcctcgtcgccctcacggcggtgttgctccgggtacagcttacgtcgcggctctgttccgaccgcccttcccagagcgcgcgcgacgctcaccggcagatttcaccacaacagcaaagtttctctatcagcttatgagacggacacttctgccgcggatagggtacagggaggccaccactcatatccagctctggctccttggtgccctgatatctcactcagagttcgatgttgtggatttccttatttgtgagatcgaggacaccattctggatggtctgcgtgcacgacgacagctgccatatgctcactatctatgtcacatttttgctcagctgattcgacctncacag

SEQ ID NO: 68281 - DNA, 320 bp, Zea mays
  Clone ID: LIB3076-014-Q1-K1-A10
cggacgcgtgggggggtcacccagaccaagactgaggatatgaatgtgactaggaaggaaacgatgaaggggggagagaggaagggggacgggagtaggacggagatgattaatgcttcggaagagcgtgtgtaaacggacgataagaccgggactgaaaatgatagaggatgcgtgcggctctacattcctcttctgcacagaatgagtcctgattctcatttgtccaatggtttcagtcttttgctttatcaggtttactatgctgtattttgcatacactatctttactgatatcttcttattctcagcacctccaa

SEQ ID NO: 68282 - DNA, 203 bp, Zea mays
  Clone ID: LIB3076-014-Q1-K1-A11
acggggcatcaaggggtggactaaactgctggcggacaatgcgcccaacgctacgaacgaggcgaagatcgagaactacttcgggcgctaaatcggccgcgacaccagcatgagcatctacctgagcctgtacgaagttctgagggcaggcatggggactgtcacagatgatgttggagaagacactggtcatttgcctggaa

SEQ ID NO: 68283 - DNA, 458 bp, Zea mays
  unsure at all n locations
  Clone ID: LIB3076-014-Q1-K1-A12
cccacgcgttcgcccacgcgtccgcgcactacacgcacgggacgcatatacatatagagagaggttagctatagcttgcacatctatttaactaactaactaactggctagctagctcgatccgcacagcaaagcgaaagcagcaagaagcaaagcaatggagaaccctgcgagtgtgctagttctaccaccgcacttcaccaaactcaccttcggaaacctgtacatacgccgggccgggccgggcagcacggagataacctaggagggcaggcgcgacctgtacaggatatacgtgagtaactttcccgtctacgactgccgcgggccctactccagccttgtggaccgcgtgcaggggatcaccagcgaaatcgggaacgcgcaccaactgttcctcantgtgatcgacaccgacaggctcaagggcttcacgctcgtaaccaatggcgcgataa

SEQ ID NO: 68284 - DNA, 217 bp, Zea mays
  Clone ID: LIB3076-013-Q1-K1-D4
tcgtccacgcgtccgcgccttctctcgcgccgtcgccgccgccgccgctacaccccgggccgggtttcatttcgtggcgccaagatgactaatcgcactaataagggaggaattgttggcaaatatggaaccaggtatggcgctagcttgcgtaagcaaatcaagaatatggaggtatctcatcattccaagtacttttgcgagttctgtgggaagt

SEQ ID NO: 68285 - DNA, 447 bp, Zea mays
  Clone ID: LIB3076-014-Q1-K1-A3
gagaatcaagagcagtccctgcccctgatgcaaatgcagaattagtatcatcattgcagaaaaggcaagcccaagctaataccaggagcaggagcgagatgttcaatccctgcaaagaagactccgcgtccggattccgaatcgaaccaccccagccaactcctgtcacaggctcgtctgaagacccacaacgtgcctacccaaccaggatcttccattccgggcctctagttaaccagagccagccatcaaaggctggaggcggcaaaaatggtgaacctcaggtccctggtgttgcgaatcaccctgtggttttgttgacaagatcaggtccccgggcagacggtagtggccagacaatggtcgctcaagctgaagcatttgctcatgggcggaggctgtcggagtccatcaatgagcatttcagtaacagtgggaagtacgatc

SEQ ID NO: 68286 - DNA, 257 bp, Zea mays
  Clone ID: LIB3076-019-Q1-K1-A3
cgtgcgactgtactgatgcgacatgccttgttatagactttattactgttagacgattcaccaaatcatgataacggtggctatcaatcctgcgtggagcatactgaatgctcatacttagacagggcttctaaaccacatagggcaagggaaaatctcaaggatatccaataactcggcaatatattactttgtgtcaccctatcaggttctgatcctgcgttgtcactataaggattacaatctgcatccctaat

SEQ ID NO: 68287 - DNA, 161 bp, Zea mays
  Clone ID: LIB3076-019-Q1-K1-A4
aggacgcgtgggcgcagttgcacagccgtactctctccacttgcattactagcgacacgggccgggcagatgcgtcgaacctctacgctgctgcagaagccaagcctctctcgtgcaacgagcaccacacacacacgggatggcactcctggtgctgctcg

SEQ ID NO: 68288 - DNA, 444 bp, Zea mays
  Clone ID: LIB3076-019-Q1-K1-A5
attttctgatggactgcctgtagagctgtattctcttgatgttcagaaatcatatgagagggcaataatctccgtggagcaactgaatgctattcttagacaggcttctaaaaccaaggaaaaggaagatctcaagaagatagataactggcaatatattagttgggtcaccctatgggttcggattctggggtggcactattaggattaccatcttcattccttaatttcttaaggtctttaagtgatatgagaggatggtcacactaattcacaggcacagggcactcaccgttgacactgaaccttgcgcaaatgctaaacgagctttacacttgcagtcagatgttctatccaattccatagatgctctgtgactgcctagaattaagagaagtttctcagaatgaacaaacacatagaacaaagatcaacttttcggct

SEQ ID NO: 68289 - DNA, 444 bp, Zea mays
  Clone ID: LIB3076-019-Q1-K1-A6
tccgcattcgttccaactcctgagcactttctcctcgtaccagacaagccaatcgaaggggagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagcttgtgggcggcgtgaccatcgctcacggcggtgtgctccccaata

SEQ ID NO: 68290 - DNA, 269 bp, Zea mays
  Clone ID: LIB3076-019-Q1-K1-A7
gcgtcggcattctcttcaactgctaagcactttctcgtcgatacgatacactccaagagaaggcgagatacaactatggactccaccggcaccgcatcaaggggtaaggtgaagaagggatcggcaggacgcaaggtaagcaggtcaatgaacaagtcaatatcctggttcgcgaaggccagcttacaattccgaataagtcgtataaggcgctacttgaagaagggcagctacacgcagcgtatcagaacggacgcaagggtgtacct

SEQ ID NO: 68291 - DNA, 309 bp, Zea mays
  Clone ID: LIB3076-019-Q1-K1-A9
aaaaaaaaaaataaaatattaaaaagaatttaaaaaaaagcatataaaacgtgaagataaaaaaatttgtacgctatcattagcctaatgcatcccttttaaatcgatacttgcactcaagtcactgatctatctatcacaacttaatgactgccaaggcgtcatcgattcctgataataccataattccaataaacaccatgatcatcataggcgtttactgattgcactctgtgtcgaacgtcttatcaatccttatcaccattccaaactgcaaatagaacacccattctcgaaatctcccaatct

SEQ ID NO: 68292 - DNA, 340 bp, Zea mays
  Clone ID: LIB3076-019-Q1-K1-B1
gccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaaccc

SEQ ID NO: 68293 - DNA, 413 bp, Zea mays
  Clone ID: LIB3076-019-Q1-K1-B10
gcagatcattggtcacagaagcactctctcatgataaacctttgcaagctgcgcattggcagccagatgccgcaaatgggcattctaatggctatggtgatggttgtgttgatgatgctgacctgcattgtattagcatcgagaagaggaaggtagaagtagagagggtggagatgctcaagaaagaggtggttgaactgaaggaagtcattgagggaaaggactttgtgcttcagggctacaaggaacagaaggtggaactcttctcaaagatcagggagttgcaggaaaagctctcagcacaagtgccaatcatcttgtaagatctatctgtgatactttttagaagattgaatctaagcataatgttgccatgtcccatgagcagcagaaggggtcccgcttcagtgaag

SEQ ID NO: 68294 - DNA, 366 bp, Zea mays
  Clone ID: LIB3076-019-Q1-K1-B11
gtcggtcgttgctagccttcaactaactttccagagagcgagcggacgggggaggaggggcccggataggggcagcagtcgaattgagaagaactttcattctggtcaaggcggtgtaccgttcctgccctctccgacaaagctgagggagctcgaggctatactgactaaactcctacgctttatcgacttccagaacatgcacaatgccaattcttacgcatgctcaggaagtgctcccaagaatcaagactatgggttcaggatgaacacactagcagcagacgacgcaaaggacaagaattctcaatagcaggcatttgttgatactgctgattgcaaagcatcagatattgatggtcatga

SEQ ID NO: 68295 - DNA, 403 bp, Zea mays
  Clone ID: LIB3076-019-Q1-K1-B12
cccacgcgtccgcccactcgtccggtagagcagcaagagcacgccgcgccaagcaacagagagggaccccgcttccatggaggtggtgggcggcgtgtcgctgaggccgtcgccagcgccggcgcgtatccggactaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgctgctgccgaaaatcgaggacgacggcaacccgcgattcgtcatcttcatccgcaccgccaatgtctacttctggtacccgctcaacatcatcacgggcggtacgacggcgaagatcatgctc

SEQ ID NO: 68296 - DNA, 85 bp, Zea mays
  Clone ID: LIB3076-019-Q1-K1-B2
cccacgcgtccgtgaataacaacaggcatacaaataaaatacattctgctactatattagtgagagtcaggctcctaatttgcag

SEQ ID NO: 68297 - DNA, 388 bp, Zea mays
  Clone ID: LIB3076-019-Q1-K1-B4
attttctgatggactgcctgtagagctgtattctcttgatgttcagaaatcatatgagagggcaggaatcttcgtggagcaactgaatgctattcttagacaggcttctaaaaccaaggaaatggatgatctcaggaagatagataactggcaatatattagctgcgtcaccctatcggttcagtttctgtgttgtcactataaggattacaatctccatcccttattttctgaaggtcttcaagtaataagaagagtggctcacttattgccaagcccaatgtactcaccgctgaaactgaatcttgtgcagatactgaacgagctgtccacttgcagtcatatgttctatccaattccatagctgctctgtgactgcctagaatta

SEQ ID NO: 68298 - DNA, 327 bp, Zea mays
  Clone ID: LIB3076-019-Q1-K1-B5
aacgcctccgaagcaacctcactacgctgacatgattttacagtccatacgcttacctcaacgtgatcgaggctttaagctcgctagccatcagccagtacattgagggcaaacatggcgacaaactcgttaccaactttcacaagcagcttactgcgcagctcaagacgctcactgtcgacgacaagctgacgagggtgaacaactccttcaagctgcctgccaccgacgccaatcccatcgccagcaactccaaggtacccaacgacgcgcccaatagcaacacctcgcactaagcgaatgccaataccgcttccaagcccaagg

SEQ ID NO: 68299 - DNA, 396 bp, Zea mays
  Clone ID: LIB3076-019-Q1-K1-B6
taccgttcggaattccaggcacgactgcctgtcccagatggatacggctacagacgctgcagtttcgaggctgacaaatgaatctctgggactgtcttctcagatgtcccacatcctacacaccttactcaaccgccacaccctgtcgatactcatggatctttgcaacctctaagccaaccccgatgcattggcctccctcgtacgctagctctcctgtgctgctcctccaaccttcaccgatggttacctccttcttgagcaacgtcgaccagtaatcagactcgtcaattacgcccacgtactcctacggccttcaccgttcctactgagctgctaaaaagtctgaatgcaaccggtgtagttgttcaagcatgacaagatcttgctgctgga

SEQ ID NO: 68300 - DNA, 432 bp, Zea mays
  Clone ID: LIB3076-019-Q1-K1-B8
catcggccaggccgggatccaggtcggcaacgcctgctgggagctctactgcctcgaggacggcatcgagcacgatggcaccatgcccagtgattcctcggttggcgtcgcacatgatgccttcaacacgttcttcagcgagactggttccggcaagcatgtgcccagggccatcttcgtcgaccttgagcccactgtcatcgatgaggttcgcactggctcgtaccgccagctcttccacccagagcagctcatctcggggaaggaggacgcagctaacaactttgcccgtggccactacacggttgggaaggagattgtcgatctatgcctggaccgtgtgcgcaagcttgcagacaactgcactgggctgcagggattcttggtgttcaatgctgttggtggtggtactggctctggacttggttcact

SEQ ID NO: 68301 - DNA, 395 bp, Zea mays
  unsure at all n locations
  Clone ID: LIB3076-019-Q1-K1-B9
cggacgcgtgggcccgtctcggttctcaaacaccgccgccgccgttctggcaacatctggccgtgaccccgtccaggtcgttgggtcagcccctatccttcaccttcacgacttcacctgcttctccactgcgcgccccgcccccggccccgtcgtgcgccctgctcagatccatcgcacggggcttgccgcaccactgcgccaagcaaaaggtgggcggccagcggcgcgtgcgcagatcatgcactggtaggactaatttgcaagatcttggaccgggatggttcgcctgttagttgtcttatgaagattggtaaggtgagaatgacgatgaggaatatacagcgaanatcatctgccctcggttctgatgcaggatgtggatcttctttatc

SEQ ID NO: 68302 - DNA, 375 bp, Zea mays
  Clone ID: LIB3076-019-Q1-K1-C1
cggacgcgtgggcggacgcgtgggcggacgcgtgtgaaatccttatggccttgactatgttggggtgagggttgttgcagccatgaaggcccgcattctcgtcagaggcttcggcatccgcctgcgcctgctgacgctcagtgtgcccgagtcgttggtggatttcagcgacaagcccttgatcatgcactagtacccaatgattcagactcatctaatgcttctgcttccttacatgaatatgcattaacagaacaatgcacccccagtacctagtccactgtagagcagtatacgacagatacgcccagtacccctagtcattcgtgggcattggtaatatcaccacacgcttccggagtcctgctgtgatcc

SEQ ID NO: 68303 - DNA, 403 bp, Zea mays
  Clone ID: LIB3076-019-Q1-K1-A2
ttccgaattcgaggcacgagtcacgcgctgatcccgcatctcgtgccaactaccatagcactttcatcgtcgtacgacacaagcacaatgcgaaggggaaatacgacgcactgactccaccggcaccgtgagcatgggctaaggctaagaacgaagcgggccaacacaaggtccgccttccaaggaagaaaccagggtcgaggtccctgaaagccgatcttcaattctgcgtacgacgtatcgggcgctacttgaagaagggccaatactcacagtacgtcggtaccggcgcccatgactacctcgacgctgctctcgaatacctcaccgctcaggatctggaactcgacggtaatgctgacacggacaacatgaagactcgtattattccgcgccacgtgct

SEQ ID NO: 68304 - DNA, 277 bp, Zea mays
  Clone ID: LIB3076-018-Q1-K1-G2
attgaaagcctgaaaccgaacaaaggcgacacacccatgttccatgtccattcgatcggtcgcaagatcatttacccgattggtttttactatgcgttttttggttgggaaaattttgccatttcacctgggaaagtggtgggggggtgttggaggtggaagagaagatggcggtccctgtaaactgctgctgcagtaaataatccctggaatttgtctccctgcatttaaacaaaatatttatggctgttataatggacgccgtcgtagggtttat

SEQ ID NO: 68305 - DNA, 445 bp, Zea mays
  Clone ID: LIB3076-018-Q1-K1-G4
gttggttcaggattgccactcgaaaaacatgcagctgcctaactctggctctgagaagggaacagggatggagagcgagagcttagaccatgtacgtaagcgtgtcattgagatgcttgatcaggtgactccagtggtgaaagaaatgttcagttccatggaaagctccagttctgcacaggcggcggcggcagcagcagcttggccggaggatctcccagaaagaagaacactccctcctgttctctgtcgcactacatcccatcatccatcagacggtgacgaggttgcgatgcacacaggacgttgcaaagttgaagcaccggcgcctgggcacgagacagatgaaggcgtttgcaccacggaggaggatggccaaaccagcagccgtgaaccgtcgtcagctcctattcctaccgctgagtttttaccgctgcagccgacg

SEQ ID NO: 68306 - DNA, 153 bp, Zea mays
  Clone ID: LIB3076-018-Q1-K1-G7
ctgcaaatgctactcgccctgtatcatctcattaatcagcgctggctgtagtggttactcgcaccgtgactcatacactatccagcaccctatctccagctcctttcagtttctacactatctttctcgtcacgttcgccctctttccccgtc

SEQ ID NO: 68307 - DNA, 140 bp, Zea mays
  Clone ID: LIB3076-018-Q1-K1-G8
actatctctctcctaagtgcacgagtgtggttagagagatcttatgccatgtacctaagcgtctgatactcatgcttcatcagatgactccagctgagaaggaaatgttcactctccatggaaagcttgatttctacaca

SEQ ID NO: 68308 - DNA, 413 bp, Zea mays
  Clone ID: LIB3076-018-Q1-K1-G9
ccgacgcgtggggtgcaacccttatttttgtcttctaataccatcacaacgcatgtggagtaaaccaagcttttatacgcttcatgcttgcaaaactttacttcttattctaatgaactgctggtttgtgatgaagttttgtttagggttcagggtttggcattgtgtataaaggatgtgtttaattgctcaccccttattttgttcaccttcactggatgatatacaatagtatgtgctttcccaagaccctctagttcagaaacatgaaatgctcctgaatctccttatccaagacatcttttggtaactaacacactgcaggcattgccagaaatagctcaaaagattacaccgctggagaatgaagataccttgcttgattcttctggtgagactagatcttcgcacat

SEQ ID NO: 68309 - DNA, 381 bp, Zea mays
  Clone ID: LIB3076-018-Q1-K1-H10
gagacaggctttagctgatccatactttgcattccttgctaatgtggaacgtgagccatcggtacacccgagttctaaacttgagtttgaatttgaaagaaagaagctggccaaagatgatgttagagaactgatctatcgagagattttggagtatcattcacagatgctggaggagtacatgaaaggcggagaacagattagcttcctctatccaagcggagtcgaccgcttcaaacggcagtttgctcatcttgaggagcattacagcaaaagagaaagaggttccccacttgcaagaaagcatgcttacttaccaaaggaaagagtggttgtatccaacgattgcaatactgaacaacaaattaatgaccaggagag

SEQ ID NO: 68310 - DNA, 212 bp, Zea mays
  Clone ID: LIB3076-018-Q1-K1-H11
acacgctttacctgctccataccttgcattccttcctaatgtgcaactttagccataagtacactcgaatactacagttgactctgaatttaaaataaagaatctgaccaaagattatattacagaactgatctatcgaacgattttggcctattatacacagatgctacactactacatgacactgctacaacatattagtttcctctatc

SEQ ID NO: 68311 - DNA, 314 bp, Zea mays
  Clone ID: LIB3076-018-Q1-K1-H12
gcgttgttgaataaggattgtgaacttgtgcgtggaggctttggtactgtttacaagggggtgctcagagatggccagccagtggccatcaagaagctgacagtttcaagtatggtcaagtcagagcatgacttcaagcagcacgtcaagcttctaagcaaggtgcggcaccataacattgtcacccttaaaggcttctactggactttctgacttgagctccttatatattaattcattcctgcttggaatttggattaacaccttcatgagtgcttataccaaaactcggtttcatgggttgaaaggtttgg

SEQ ID NO: 68312 - DNA, 443 bp, Zea mays
  unsure at all n locations
  Clone ID: LIB3076-018-Q1-K1-H3
caatcctcagaaagagagagggagagagatggcggcgagcgcgctgctgacggggtcgccgtggctgcgcatgcgcctcctcccggacgcgcctgcgcgccccttccgccgcctctacctccgccgggcgctctccgcccgcgcctccgccgccaccggcggcgccgagggcaactccggccccgtccgcgtccgcttcgcgccgtcgcccaccggcaacctccacgtcggcggcgcccgcaccgcgctcttcaactacctcttcgcgcgctccaagggaggacgcttcgtgctccgcgtcgaggataccgacctcgagcgctctaccaggaagtccgaggaggccgtnctcgccgacctcgcttggctcggcctcgaatgggacgaaggtcctgacgtcggtggggagtttggtccttatcgncagtcagaacggaattcac

SEQ ID NO: 68313 - DNA, 425 bp, Zea mays
  Clone ID: LIB3076-018-Q1-K1-H4
cccacgcgtccgcccacgcgtccgcgcattcctcccatctgccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgacca

SEQ ID NO: 68314 - DNA, 444 bp, Zea mays
  Clone ID: LIB3076-018-Q1-K1-H5
caatcctcagaaagagagagggagagagatggcggcgagcgcgctgctgacggggtcgcggtggctgcgcatgcgcctcctcccggacgcgcctgcgcgccccttccgccgcctctacctccgccgggcgctctccgcccgcgcctccgccgccaccggcggcgccgagggcaactccggccccgtccgcgtccgcttcgcgccgtcgcccaccggcaacctccacgtcggcggcgcccgcaccgcgctcttcaactacctcttcgcgcgctccaagggaggacgcttcgtgctccgcgtcgaggataccgacctcgagcgctctaccaggaagtccgaggaggccgtcctcgccgacctcgcttggctcggcctcgaatgggacgaaggtcctgacgtcggtggggagtttgggccttatcgccagtcagaacggaattcact

SEQ ID NO: 68315 - DNA, 417 bp, Zea mays
  Clone ID: LIB3076-018-Q1-K1-H6
gcggatagatctggctgtcattcctcctatctaccaagacctcctcataccggataagggcaacttctaccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgactaagagctcgggaagctgctgaccggcgtgacca

SEQ ID NO: 68316 - DNA, 369 bp, Zea mays
  Clone ID: LIB3076-018-Q1-K1-H7
gcagcactcctcagagaagagagagggagagagatggcggttagcgcgctgctgacggggtcgccgtggctgcgcatgcgcctcctcccggacgcgcctgcgcgccccttccgccgcctctacctccgccgggcgctctccgcccgcgcctccgccgccaccggcggcgccgagggcaactccggccccgtccgcgtccgcttcgcgccgtcgcccaccggcaacctccacgtcggcggcgcccgcaccgcgctcttcaactacctcttcgcgcgctccaagggaggacgctttgtgctccgcgtctaggataccgacctcgagcgctctaccaggaagtccgaagaggccgtcctcgccgacctcgct

SEQ ID NO: 68317 - DNA, 442 bp, Zea mays
  unsure at all n locations
  Clone ID: LIB3076-018-Q1-K1-H8
cggacgcgtgggcggcgctatcgacggagcttcgccacacgtacaatgtgcgttccatgcgcgatctcgcaaggacgaccaggtgcaggtcttgcgctgcacctacaagggccgtgagggcaaagtggtgcaggtgtaccgccgtcgctgggacatccacgttgagcggatcacccgccagaatgtgaacggctgcaccgtgaacgtgggcatacatccttacaaggtcatggttacaaagctgaagcttgacaaggaccgtatggctctcctcgaccgtaaggtccgtggccgctccggcgacaaggctaagggcaagtttactgccgacgacgtcgacgacgctgatggtggcgccgccgncactggtgcgtatctgcaagagatcgactatgcgcattctggtgatctgatggtgcgtctaccgcctattactgcttat

SEQ ID NO: 68318 - DNA, 125 bp, Zea mays
  Clone ID: LIB3076-018-Q1-K1-H9
cgagctccagcgcaagctgttctagttctacgacactaaactgaacattaaaggcctattgaactcctgcgtgaagttcattccgtccatcttcgactaaccgccggaagccctgagccacataa

SEQ ID NO: 68319 - DNA, 388 bp, Zea mays
  Clone ID: LIB3076-019-Q1-K1-A1
ccccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtccggcctgctccttatctatgggcctttcaagatcaatggagtaccgat

SEQ ID NO: 68320 - DNA, 352 bp, Zea mays
  Clone ID: LIB3076-019-Q1-K1-A10
ccgagccagttcctccacatctgcttcaacgagaccatccacggcggggagttcaggactacccggagccccgcaacaggtcgggcatcctcgtcgccgacatgtcctccaacttctgctccaagcccgtcgacgtctcccgcttcggcgtcatctacgccggcgcacagaagaacgtcgggccctccggcgtcaccatcgccatcgtgcgcaaggacctcatcggcgccgctcagcccatcacgcccgtcatgctcgacttcaagacgcacgccgacaacgcctacctctacaacaccccgacctgcttcgccatctacgtttgcggtctcgtcttcgaggacctgctcgc

SEQ ID NO: 68321 - DNA, 329 bp, Zea mays
  Clone ID: LIB3076-018-Q1-K1-G12
cacacacagcgtacggatccggaacaattccgcggcaccagacgtacactgaaccaggggccgctcagagatatccaggcatacatcattaacagcctgtcacgcgtacggctggtgaacccagacgatgactcctagcacctcatgatgctcgtaggtcacctgctgctcacttacattgccagcttcaaaggcctgtactggaccacgtcatagccgcacttcagatatgaattcattcctggccctagctttcataagcacatggataaccgctcatactagaactagctcgcatgtgtccaaacttttgccataatcgctggctt

SEQ ID NO: 68322 - DNA, 347 bp, Zea mays
  Clone ID: LIB3076-019-Q1-K1-A12
gttgccaatgctatctgtttcacacactttcttgctccccttgctaaaggcattcattgcaacttttgcattctagaaggctcgatgacaactgatcatgccatcacttacacccacaatactattgatggaccctcagtccattacttgatagctcgcagtgctgccaactttaacatcattcccaacagcaccgctgcttccaaaactatcggaatggatcttcctgaattgaatcgcaatctcactggcatatccttccgtcatcccaccaccaatctgtcatatgtatacctcactctaacaatcgagaatgtgtcctcctaccaataaatcaataactctat

SEQ ID NO: 68323 - DNA, 355 bp, Zea mays
  Clone ID: LIB3076-018-Q1-K1-E11
cacggcttgagccacgcgtccgctaataacactgttcgattaggattccctgcaaacccttctacaaaccgggtaactgagaagagcgcaagatgttcgatttacagcaccacggtcacacacagacagaacccgtcggctcactgaatggtgcaccagcccaccttgaagatcttctgcaaggcctacgaggagtactggcttacctgtcgcaacggcaacgtagggctaccccctggcaacccgcgcgactagcaccatcactagtactagtacatgcgcttcaacacccatgtcaaggactaggaggccaaccctgcgtttaccctgaactacaaagccactgggctcgcca

SEQ ID NO: 68324 - DNA, 398 bp, Zea mays
  Clone ID: LIB3076-018-Q1-K1-E12
gcgccaacccttcggtgaaaatctcagtggttattcgaagcatcatgactcatctgattcagggtatatgcgttcaggaccccacgctactgtttgtattcaacgaagcgtgtgacatctgaatcttcaaccaatcgacagtgttcacagcctagacacttgtaccatgccaagagctaagtcaacaacacactgatcagatatcaacgaagatgatcgccactctgtcggaacttttgcatctagctccactaattttccagctgccttcgctgaacacacctatacaaatgcttctactcacactgtgcgagtgttatattctgcatggattctgacgtgagcagcaggcattctgaacccgctatctcaatctgaagattcggtagatcctgaac

SEQ ID NO: 68325 - DNA, 450 bp, Zea mays
  Clone ID: LIB3076-018-Q1-K1-E2
tcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacgg

SEQ ID NO: 68326 - DNA, 65 bp, Zea mays
  Clone ID: LIB3076-018-Q1-K1-E3
atccaatcttggaagacctactcagaccctataagttcacctccagccatgcacgccacgggcac

SEQ ID NO: 68327 - DNA, 257 bp, Zea mays
  Clone ID: LIB3076-018-Q1-K1-E6
atctccgaacatctgctcagaccttttaagttctgctccggccatggacgccacgggcactggtactttattgaaggctaacaacgtatccgccggtcgcaaggccggccgtcccatgaagaaatctgtgacgaggtccgtcaaggccgggctccagtttcccgtctgccgcatcgggcgctacctcaaaaatggccgctactctcagcgcgtctgcagctttgcccccgtctacctcgcggtcgtcctgtaatacc

SEQ ID NO: 68328 - DNA, 329 bp, Zea mays
  Clone ID: LIB3076-018-Q1-K1-E7
cggacgcgtgggtccgtatcctccgcttccactccttctccgtcgccttcctgctactagttctacgtcttctcatgaacgcatcgcccctctccacctgctgatccttcgccatctctccatctctctttctctctgagatagtctttcgaatccatctctagggctcttgtttctccccatcctccccccaccctaccctccaccatacacaagtccccttgttcaatcctacaagacaagcatccatgtcatcgtcacgcccgagctcgagccccgacagcaactacacgactgacgagcgcaagcggaagcggatgctgtccaac

SEQ ID NO: 68329 - DNA, 424 bp, Zea mays
  Clone ID: LIB3076-018-Q1-K1-F1
ctccctcccccgcctccacaacccccctcccaggagccgcccaggtacgtcgccggcggggatgacgacgcgcttcaagaagaaccgcaagaagcgcggccacgtgtccgccgggcacggccgcatcggcaagcaccggaagcatcccggaggtcgcggtaacgccggtggcatgcaccaccaccgcatcctcttcgacaagtaccatcccggctacttcggtaaggtcggcatgcgctacttccacaagctccgcaacaagttctactgccccgcggtcaacatcgagcgcctctggtcgatggtgcccgccgacaaggcggcggaagccggcggcgacaaggccccgcagatcgacgtcacgcagttcggctacttcaaggtgctcgggaagggggtgctgccgcccaagcccatcgtcgtc

SEQ ID NO: 68330 - DNA, 312 bp, Zea mays
  Clone ID: LIB3076-018-Q1-K1-F10
ccgatcgtgcgtcccgccagctagccattcactttcctctctttcacttacgcttctaaggcttctctggcgctttaccaaaccttaaccggatcggttcccatgccgagcttaaacgaatgactggactgactacaactccatatccaattgcacttgaacggtcgctactagtactccagctaagccactgcttctctgctaacctctaacctccatccctattatacttccacaatctactaccgaaccctataactgtataccaggatactaatggcctctaccagatcgtgcgactacagcatacac

SEQ ID NO: 68331 - DNA, 394 bp, Zea mays
  Clone ID: LIB3076-018-Q1-K1-F12
acgcagacgcctgcgacgacgattgtgctgtcgcctgacccaaaactcttagtgctcgttggagagcctacaatattgcacacaggaaagctcatctacagtatgctcttcaacctactggtgactcaacatcacacttagcatagtatgactgagactcacagaagagggatactagccgacgcactggatgttcgcaatactgtgattaccattgctcttatacttcgcaatcctacacgtgatgtctctaactgtcctgtacgagacaccacacatgcatgtgatcctgctactagcggacacacttcaacatcctgtgacctacgaggtaccctacgactatgccctatgtcatctatcgggccaatgcaaggaagactcggatgcacat

SEQ ID NO: 68332 - DNA, 359 bp, Zea mays
  Clone ID: LIB3076-018-Q1-K1-F2
tctcactcatccgtctccacatacccccttttacgtttcgtccaccaccatctacctatcggaccagtacaatcttcaagaacaacctcattaacctcgaccacatctaccctcatccaccttcactatctcaagcaccataaccattccacaaccttcacttaccccaccttcttacactaacacaccatcactcttcaacccctaccatcccttcttcttcagaaaccacaacttccactactttcacaatctccaaaacattttctactcccacaatctcaacatccagcctcatccctcaatccttcccaccgacactactttttaatccttcaactacaaagacccacatatct

SEQ ID NO: 68333 - DNA, 187 bp, Zea mays
  Clone ID: LIB3076-018-Q1-K1-F3
caatttccgaaccgacccacgcatccactcactcctccaactccacaatcgcccttttaagattcacacacatacttacactgtatgggacttgtataatacttaagaccacactcaaaatattggtgctaaatatgtacgccaaactacttataaaacaaacgactttgcttataataggacaacc

SEQ ID NO: 68334 - DNA, 351 bp, Zea mays
  Clone ID: LIB3076-018-Q1-K1-F4
ctgactcgtgggcgtgcataggcacatttttgtattaatgaaggacctactccagtgcgcgaactgtctactgtccatgggcgacaacaagtccaacgagaacatgatccagctgatcgccaccaatgcatgcatgaactcgctgacatccaatgctgtattgttcgtgtgcaccgctagcctcaagcccagctaggccaactacttcctcgacgactcgccctaagtagtaaggctaatacaaagtctctcctacgtctactatgagctcgcgcttgcgaaccatccacattaagacaaggactcctctttgcactacttgtgacaataggaaagagcgttgccttccca

SEQ ID NO: 68335 - DNA, 215 bp, Zea mays
  Clone ID: LIB3076-018-Q1-K1-F6
gaaaaaccggcccgacgcactcaaccgcccactcctacccccgaaacttaaaccattcacaaccaccccaacaccaatgggcacatgctacttttaaaggaccccatcccacacaataaaaacaaccaaacactacatacaccaaatatccactaacacaaaacccaccaaccacacaacacataaacattacaaaacaaacacaaaaacacaaa

SEQ ID NO: 68336 - DNA, 439 bp, Zea mays
  Clone ID: LIB3076-018-Q1-K1-F7
ctcgaaagcaagtatggctcacctaaaattgtcaatgatggtgtcactgtggcaaaggaggttgaacttgaggaccctgttgaaaatattggtgctaaattggtccgccaagctgcttctaaaacaaatgacttggctggtgatgggacaaccacttcggttgtccttgctcaagggatgattactgagggtgtaaaggttgtagctgctggtgctaatccagtgcagatcacccgtggtattgagaaaacagccaaagcactagtcagtgaactccaaaagatgtccaaggaggttgaggacagtgagcttgctgatgttgctgcagttagtgcgggaaataactatgaaattgggaatatgatagctgaggctatgaaaaaggttgggcggcagggagtggtcacacttgaagaaggaaagagtgctgaaaataacc

SEQ ID NO: 68337 - DNA, 284 bp, Zea mays
  Clone ID: LIB3076-018-Q1-K1-F8
aaaccatacagattcttcacacttatgttccatgtccattccatcgggcaaaagagcatttacacaagtccattttactatgcttattatgcttgcgaaaattctgccatttacacactgcaaaagacttgaatcagtattggacgctcatatgcaaagtgcttgaccattacactattactctcagaggctaatacttgacttcctcactccaacatacttatctatcaattcatgcatgctgaaaacatccataacaaccttcatataacttcatactatat

SEQ ID NO: 68338 - DNA, 331 bp, Zea mays
  Clone ID: LIB3076-018-Q1-K1-F9
gcgcccacgcgtccgcccacgcgtccgcccactcgtccggggttggcttctcctccccctccggttaccgttgggattcctgagggtctccggggttccgcttcgtgcgtgagcggatcgagatggcggcctcggatgttgactaccgctgatttttcagaccgtctcgcctgggccacagacgaccactctctccacaacgccttgagcacctacggtgaggtcctccagtccaagatcatactcgatcggcgagacgcagaggctccgctgcttcagctacgtcaccttctacacggacgacgctatgctgaacgctcatcgacggcat

SEQ ID NO: 68339 - DNA, 264 bp, Zea mays
  Clone ID: LIB3076-018-Q1-K1-G1
gcgacccatggaatggcagcactgacattctagccactcaacaaccaccaccacctgcgcccccggtcgatccaggcagtggcagcggctctggcggtcctggtgtcggagggggccggcacatgcatcacggccgcagtgctcaacacggaccgtctcgcgctgctggcgctcaagttcggcgtctaagacgacccgggcagcgcgctgtacacgtgacgtaacgcggacgccgacccctgcgcctggtgtcagcgtcacatg

SEQ ID NO: 68340 - DNA, 246 bp, Zea mays
  Clone ID: LIB3076-018-Q1-K1-E10
ccaaccttcgcttatatagttcctggctttctacacctttttcatgactgatatacacagcgtactctcgatcaatcatacaacaatagaacaccaagcctaaaatccactccttcttctgccctactgcctactactccttgtcctcatcctcactccgatcatcatactcgagcccactccaacaatcctacaccatgctatccaccatcagcattacccaccacctctgaatctcatctcctt

SEQ ID NO: 68341 - DNA, 394 bp, Zea mays
  Clone ID: LIB3076-018-Q1-K1-G10
cggacgcgtgggcgacccctggaatgagttctgcagcatggtgcacaagatcttcgtgtgcacgagggaggaggtccagcgcatgaacccgggcgccctgaactcgaggccggaggacagcggcctggccaattcgacggacaggggctccgcatctactgctgctgctagagaggcacccggctaccagtccgcctcgccgcttaactccgacaactgctgatgccttggcagctagctggtcgtcccaagtagtagagaacacggccaatgtatccatagatctgcttgtagcggagcttaatgcctgattttccccttgctaatatgcattggatgagcccgtagcgcaccgtagtcgtatctaaagctggcgttctgagtcggttggacc

SEQ ID NO: 68342 - DNA, 406 bp, Zea mays
  Clone ID: LIB3076-018-Q1-K1-G11
cggacgcgtgggggaggagagtgagcagtcagagaacagggaggtagagagaaggaggaggaggtagaaggcgaaagaaggggaaccaaatcttggacgggaacacatagatttctttggtggaggaaggaggagggcaacatgaggaggttacaggtagcccaatagatctactgctgttgagggagttgatgcaaagctgagttgctgcgcgttggctttctttagagatggcttcagctggtgttgccccttctgggtacaagaacagcagcagcaccagcattggtgccgaaaagttgcaagatcacatgaacgagctaaagattagagatgataaggaagttgaagcaaccataattaatgggaaagggaccgaaactgggcacataattgtcaccactac

SEQ ID NO: 68343 - DNA, 411 bp, Zea mays
  Clone ID: LIB3076-018-Q1-K1-C3
ggattccatgggcgtgagcatagacattccaataaccatccacctctgccaccaatgccacctggaatttcatccgtgtccatgcaaaatactgattcagttaataggcagtcatcttcgttcagtgctcgagatcgaccaacacctaatccttctggttatcctacacaatcttttgactctagtatgcctagtgctttcacaggccttcagggtcaaactcaatacatgcttgcaggcgctggcagttcatcagcgaatgagttacccaatgtggaggccaagcttctatggaacacatttccagcaaataggatccctctggagaccttcagctcaggtttacctgctcggccgatgccaccccttacaccttattcagctgttgctactcagcacgctacgatgaac

SEQ ID NO: 68344 - DNA, 391 bp, Zea mays
  Clone ID: LIB3076-018-Q1-K1-C4
tcagtcctacaacccatactcctaaacctacacattctcaatattcatccacatctgacaacaataccgtatccgactacattcacacatcattcaaaccaacacttaacctactaacaacctacctttgttcataacactagatcaacctacacataatcctatactataacctacatatcctttcacatatattatccactatcctacaacattcactatacaatcaaacttaatacatactgctcaccaccttccatttcatcaacgaataattatcacaatatgcaactcaagcttacatgtcacacattatcaactaataatatacctctctaaacctttatttctacattaccacctcttttacttcaactctttataccttatt

SEQ ID NO: 68345 - DNA, 358 bp, Zea mays
  Clone ID: LIB3076-018-Q1-K1-C5
cattccaatatttataacacctatgccaccaatgaccggcctagggaaaacatccaatgtacatgcaaaaatactgattcagctaataggcagtcatcttcggtcagtgctcgagatcgaccaacacctaatccttctggttatcctacacaatcttttgactctagtatgcctagtgctttcacaggccttcagggtcaaactcaatacatgcttacaggcgctggcagttcatcagcgaatgacttacccaatgtggaggccaagcttctatggaacacattttcagcacataggatccctttggagaaccttaacttaagtttacctgctcggtcgatgccaccccttacacctt

SEQ ID NO: 68346 - DNA, 464 bp, Zea mays
  Clone ID: LIB3076-018-Q1-K1-C6
cggtcgacccacgctgcacgaggagccctgaggcaggtaggaggatgaggtttaagcaggggacgagaggaggcggggaggagtcagatcacttcgtgaggattgcggacactgagccgacgaaggcacggccactgcaagggctgtggaagactttgaacccttaactgttatcagaactacctgtccatgtggcaattgggttaatgaaatgacaagttttctttgtcaagcaaagctgtatggtttggttcctgctatcccttgcacagatcgattctcatagtgttatgtcattgttgattaagagccatgaactgaagtgtactacgcctttggccatactgtgagtcttgaccatgaaccggtgtcagcaggaagcatgctagtgctgaattgcattatgcgaatgggtgcccaaaacaaccctaaaaatttgtttaatttcatcggatcttgatact

SEQ ID NO: 68347 - DNA, 436 bp, Zea mays
  Clone ID: LIB3076-018-Q1-K1-C7
ggattccatgggcgtgagcatagacattccaatattcatccacctctgccaccaatgccgcctccgatttcatccgtgtgcatgcaaaatactgattcagttaataggcagtcatcttcgttcagtgctcgagatcgaccaacacctaatccttctggttatcctacacaatcttttgactctagtatgcctagtgctttcacaggccttcagggtcaaactcaatacatgcttgcaggcgctggcagttcatcagcgaatgagttacccaatgtggaggccaagcttctatggaacacatttccagcaaataggatccctctggagaccttcagctcaggtttacctgctcggccgatgccaccccttacaccttattcagctgttgctactcagcacgctacgatgaactctggctttcctgcaaacctgtata

SEQ ID NO: 68348 - DNA, 442 bp, Zea mays
  Clone ID: LIB3076-018-Q1-K1-C8
ggacgcgtgggcggacgcgtgggcggattcgtggggagcggttaagaatcgagtacgagaagaggctgacacatttgaggaaccaagatgtgaaaggcgaagaacctacctctgttgataagacttgtgcagcattgagaagcttgcatactcggctgaaggtgtcaatacacacagttcagtcagtatcaaggaggattgaaattctaagggatgaggagctgcatcctcagcttatggagttgattcaagggctatcgcggatgtggcgcgccatggctgaacgccacaaagctcagaagcgcaccatcgaggacgctaaacttctcttcctccagcaccacccctcggccgccacggctatctcccttggtccgctggaggccgcaactccccctccggctgccttggcactggaatccgagatccaggcctggcgagg

SEQ ID NO: 68349 - DNA, 384 bp, Zea mays
  Clone ID: LIB3076-018-Q1-K1-C9
cggacgcgtgggttttgcatcagatgagaacacttcttgttcagaatggaatacagccgtggaaaaacgtacaggatggtcgagaggtgaagttgttggtaagtttcttattggagaggtgtttggaaattgttgtcgactcaagggcccagatgcattgacaaaattcatggttattattcacaacgctataggaggacaggattatgagaagttccctttttcattttttgacaagaatggaaagtatgtgcaggccttattgaccgccaatacaaggagcaaaatggatggtaaatccattggagccttttgtttcctgcagattgcaagcactgaaatacagcaagcctttgagattcagagactacaagaaaagaagtg

SEQ ID NO: 68350 - DNA, 393 bp, Zea mays
  Clone ID: LIB3076-018-Q1-K1-D1
cccacgcgtccgcccacgcgtccgttttgttcgggctgtcttaattgccaatttagctggtattggatatgacgaaaagaccatgtacatggctgcatatgattggaggttatctttccagaacactgacgttcgtgatcaaactttgagcagaataaagagcaatattgaactcatggtagcaacaaatggtggaaatagggtggtggtgatcccacactccatgggggtcctctattttctgcattttatgaaatgggtcgaagcacctcctcccatggtgggcggcggtggtccgaactggtgtgagaagcatattaaagctgcaatgaatattggaggacctttcttaggagttcccaatgctgatgctgggcttttctcatctgaagc

SEQ ID NO: 68351 - DNA, 438 bp, Zea mays
  unsure at all n locations
  Clone ID: LIB3076-018-Q1-K1-D12
gcaatcgttaccggtgatttccctcttggttcttggtaacacctagccacctggtccgcattacaaatggaacaaaaaacaaagatgcgtgctttggtcgttttttattttccgattcgggataagctccccccttttttttcctggctgcattttgctgcacactggtggaacctcccgatctcatcctctgcctgtaaagagttcgcgggaaccggtggatctttccgtcatctggccagtggccgtctgatttgttcgtgatctccccgaccccgtgtttgggctgggacaaggagaaaccgccaaaggagagatttgttttcccgcgacactcggaaacacaagtgtaatcccccctaccgttctctctgctcaagtgtcgccattaatggccaggcctctnccataaagcaccatcaattcctcatgcaaaaa

SEQ ID NO: 68352 - DNA, 415 bp, Zea mays
  Clone ID: LIB3076-018-Q1-K1-D3
acttgtccttactgacccactcctgggaatgaaaggagctgtcaagaaagcggaagagatacaagcaaagacacccaactcgtacatccttcaacaatttgaaaatccagctaacccaaagattcactatgagactactgggcctgaaatctggaaagctacagcaggaaaaattgctggccttgtatctggtatcgggacaggaggtaccatcaccggtactgggcgatacctcagagagcaaaatcctaatgtcaagctctatggtgtggagccagtggagagtgctgttttgaatggtggaaaacctggaccacacaagattcaaggaattggagctggttttatccctggagtcttggatgttgatctccttgatgagactctacaggtttcaagtgatgaagctattgag

SEQ ID NO: 68353 - DNA, 383 bp, Zea mays
  Clone ID: LIB3076-018-Q1-K1-D4
aactggctcttactcacccactccttcgttttcaattagctgagactatcgcgtaatagaggcaaggggggacacccaactcgatcatccttcaacattctgaatatccatgtaacccaaatattcactatcagactactcgacctcaaatcttgaacgctacaatcacgaaaaaatgctgactcttctatcatctataacgtacagagacgtaccatcaccttgtactcggcgatacctcagatagctaaatcctaatatcaagctctattgtatggacccagtatagagcgctctttacaatggtccataacctcaaccatacaccattcactgaatagcaactcgttttatcccttgagacttggacttgagatctcctt

SEQ ID NO: 68354 - DNA, 440 bp, Zea mays
  Clone ID: LIB3076-018-Q1-K1-D5
gcgacttgtccttactgacccactcctgggtttgaaaggagctgtcaagaaagcggaagaggggcaaggagagacacccaactcgtacatccttcaacaatttgaaaatccagctaacccaaagattcactatgagactactgggcctgaaatctggaaagctacagcaggaaaaattgctggccttgtatctggtatcgggacaggaggtaccatcaccggtactgggcgatacctcagagagcaaaatcctaatgtcaagctctatggtgtggagccagtggagagtgctgttttgaatggtggaaaacctggaccacacaagattcaaggaattggagctggttttatccctggagtcttggatgttgatctccttgatgagactctacaggtttcaagtgatgaagctattgagactgccaaggcttttgctctga

SEQ ID NO: 68355 - DNA, 441 bp, Zea mays
  Clone ID: LIB3076-018-Q1-K1-D6
cccacgcgtccgcgcttctctctctccttaggcgcagcggtggggtggggtggggtagggagcggtattgcgagctcacaccacctgcggcgcggcgatcccgggccaccggctatcgggctatgtgatgatccgggccgtgatctcgacagctattcgcggctgaacgggcggcggcgatgaacggagcgagcgccggtgccggcggggaggcgccgctggtgtacaaggcctggaaggggaacaatgtgtttctactgaaggggaggttcatatttggccctgatgcaaggtccctgtttatcaccatgttccttattgtcgcgccggtatcaatcttctgcgcgttcgtcgcataagaattgatggataagttctcttatggtctgggattgccggttatgattgcagcagttctattcacagcatatgatctgagtc

SEQ ID NO: 68356 - DNA, 407 bp, Zea mays
  Clone ID: LIB3076-018-Q1-K1-D7
gcgacttgtccttactgacccactcctgggtttgaaaggagctgtcaagaaagcggaagaggggcaagggaagacacccaactggtacatccttcaacaatttgaaaatccagctaacccaaagattcactatgagactactgggcctgaaatctggaaagctacagcaggaaaaattgctggccttgtatctggtatcgggacaggaggtaccatcaccggtactgggcgatacctcagagagcaaaatcctaatgtcaagctctatggtgtggagccagtggagagtgctgttttgaatggtggaaaacctggaccacacaagattcaaggaattggaactggttttatccctggagtcttggatgttgatctccttgatgagactctacaggtttcaagtgatg

SEQ ID NO: 68357 - DNA, 212 bp, Zea mays
  Clone ID: LIB3076-018-Q1-K1-E1
cccacgcctgggccgactaccgcgaggtttgtaatataatgctacaaatcccatcattgtgacctgtgaaattctcccgtactactttcctagccaaacactctcgctccataagacgacggatacaatgataaacactatccatgaccttcggacctatcatcacgtcatcgctggccagttgcctcccaacactgacctgcaccgattcc

SEQ ID NO: 68358 - DNA, 446 bp, Zea mays
  Clone ID: LIB3076-018-Q1-K1-C2
aggaggagccctggggcaggtaggaggaggaggggcaagcaggggaggagaggaggcgggatggaggcagagcacttcgtgaggattgcggacactgagccgacgaaggcacggccactgcaagggctgtggaagactttgaacccttaactgttatcagaactacctgtccatgtggcaattgggttaatgaaatgacaagttttctttgtcaagcaaagctgtatggtttggttcctgctatcccttgcacagatcgattctcatagtgttatgtcattgttgattaagagccatgaactgaagtgtactacgcctttggccatactgtgagtcttgaccatgaaccggtgtcagcaggaagcatgctagtgctgaattgcattatgcgaatgggtgcccaaaacaaccctaaagatttgtttaatttcatcggatcttgatac

SEQ ID NO: 68359 - DNA, 312 bp, Zea mays
  Clone ID: LIB3076-018-Q1-K1-A3
gtgcgatatggagtaaaaatccctggcttattaagtggagaagaacgttcagcacaacgcttcgtaggcgctcgatgatgtaccctaaccagggatcatcgatgagtctatgggtgccgaatcataatcttcgatatggtacgttaattgatcgcacgatgtggatgaaacgtgttggattaatctcaaagtgatgctcacacatgaaccagaggaatggatgatctgatcacgtgccagcatggaacatgctcacaatgccgtcattatctaaccacactaacatagtgttatctcgggcaagccccagtg

SEQ ID NO: 68360 - DNA, 445 bp, Zea mays
  Clone ID: LIB3076-018-Q1-K1-A4
ggccgacgccaagggccatggtgaagccttgaaagagaacgagcagggggcgccagaaagttgagatccgccgcatcgacaacaaggagagccgtcaagtcacccagtgcaagcgcaagggcgggctcctaaagaaggcctcggagctccatctcctctgtggtgcccaagtcgccatcatcgtcttcaagagaagggaccccgaaagaaaggaggtgcccgttccgccccgcggccaacgcgacgacggcggccttgccttcgcgatgggcaccctctccgtcgaccacgtgctccaccgctgtggcctgctccacgccgacgagggcctcaccgcgatccaggatgtgggcgccatcgtcgcatagcgtgccgctatggacgcgagagcggggcagaccgagcagaccatggcgctcgtggaggcggagaatgcgctgaatga

SEQ ID NO: 68361 - DNA, 146 bp, Zea mays
  Clone ID: LIB3076-018-Q1-K1-A5
ttgcgatatggagtaaaaatccctggattattaagtttagaagaatgttaacttcaaagtttattgcgaatttcaaaatttacctcaaccagagatcatccatgagcctatgggacccgaatcaaaatcttactcatggatcatta

SEQ ID NO: 68362 - DNA, 174 bp, Zea mays
  Clone ID: LIB3076-018-Q1-K1-A9
gaccgttgccaagggacattgcaagaccttctaagagaacaagcaggactcacgagagggtagtgaggggactgatcgacgacaatgatagtcttcaaatgacccatgtcaatcgcagggactcatctcctatatcaaggactgaattcttcatatgctgtctagtatccaagt

SEQ ID NO: 68363 - DNA, 374 bp, Zea mays
  Clone ID: LIB3076-018-Q1-K1-B10
caagccttcggcagatcatgcgtccatatacactgtttcatgatgaacctttgcaaggtgctcattgggatgcacattccccacatgggccttctaatggctatagtgatggtcatgatcatcatcctcacctgcatcgctttagcatcgctaagaagcaagttgaaccacataggctccatatgctcactaaagaggtgatctaactgactgaagtcatcgaaggaaaggaccatgtgcttcaaggctacagcgaacacaaactcgaactcttctcaaaaatcagaggacttgcaggaaaacctcatgacacaagtgccgatcatcttgtctgatctatctgagatactgtttagatgattgaatcttatcat

SEQ ID NO: 68364 - DNA, 396 bp, Zea mays
  Clone ID: LIB3076-018-Q1-K1-B11
gcgggcggcggctgctagcctgcaacgaacataccagcgagcgagcgggcggaggaggagatgccggtaaaggggcagcggcggacggagaagaacttccgggcggcgcacggcggggtaccgtgcctgcccccgtcgacaaagcagagggagctcgaggccatcccgactaaacttcgtcgcctcatcgccttccagaacaagcacaacgccaatgctgacgcgttctcaggaggtgctcccaagaagcaagacgatgggttaaggaagaacaagctagcaacagacaaggcaaaggacaagaaaaccaagaagcaggcattggtggttcctgctgatagcaaagcatcagatcttaaaggtaatgatgaacgttcagctgccaatgaagatgtg

SEQ ID NO: 68365 - DNA, 338 bp, Zea mays
  Clone ID: LIB3076-018-Q1-K1-B12
gccgatcattctctcacttatccactctttcatgatcaacactcccaagcgtcccattgggagccaccacccttacatggacattctaatcgctatgtcgatgatgccgtcgatagatgcctgcgctgcattctgactaccctgcacaacagtcaacgtagacttacacttgcttctcatgctcatcaaagagctccatgaactgaatgacgcccttgtctgaaaagcctttgtgcttaagggctacaacgaacagacagatgcacctattatcaacgatcaccgattctcacgaaaatctctgaccacaagtacccatcattttttatgatctatct

SEQ ID NO: 68366 - DNA, 446 bp, Zea mays
  unsure at all n locations
  Clone ID: LIB3076-018-Q1-K1-B2
cggacgcgtgggggtgggttggcttctcctccccctccggttcgggttcgggttcgtgaggttctgcggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaagcagccgcggcagcgggtacggtggtggccgtggaggctgcggctacggcngtggcgggcgccgtgatggcggc

SEQ ID NO: 68367 - DNA, 431 bp, Zea mays
  Clone ID: LIB3076-018-Q1-K1-B3
atgcagctgaaactgcaaagtgcaagaaggtggtctgtgatccttcgtatttaccaaacaagggtaggaggattggtagagttgttcgtgcaattgctatcatgagccacccaatccctaatacaaatgagtcccactcggttcaaattattttgcctcagaaacaacttggacgtagatcagacatgtatgttttctgttgttcatacacgcacaatgttgcgccaagagggaagttcattgcatttgtgtctgcagaagcagagactgataacccgcaatctgagctaaagcctggaattgatctacttggttctgtggatgagatattatatgatatttatgacagatatgaaccagtgaatgaaccatctcttgataattgctttgtcacaacgagctatgacgccaccacacattttgagacaact

SEQ ID NO: 68368 - DNA, 424 bp, Zea mays
  Clone ID: LIB3076-018-Q1-K1-B5
aaggcatctcatcccctctctacctgcttaccctccgccgcctcacccccagctcctcgctccgcgccgacgccgccatgtcctcctcctcgtccgctgtggccgccccgatcgagcacttcgtgctcttcaaggcccgtccggaggcggaggcctcgggcgccgcggcggcgatggtctcctcgctgcaggcgctggccacgctcgtcccgggcctggcctacatccacgcggtaccggtgctccgcctccggtactcggccgcggaggcgctgggccccacgcacctactgcacacccgctacgccaccaaggaggacctggcgttctacgcggcgcacccggcgcacgtggccgacgtgcaagggcacgtgcttcccaacgcgctcgacatcaccgccgtcgactgggtcaacgccgtgcc

SEQ ID NO: 68369 - DNA, 448 bp, Zea mays
  Clone ID: LIB3076-018-Q1-K1-B6
ggcgctgcccgagatggacactgaactgaggctgcagctgcgaggcgggcgaaggagtctcgggagctggctttccagatgtcccagatcctatacaccggcctcgaccgccacaccctgtcgctgctcatggcgctttgcgaccgcggagccaaccccgaggcattggccgccctcgtccgcgagctctcctatgctgctcccccaacctccgtcgaggcttcctaccccgtgagcaacggcgctccggggccggcctcggcaattgcgcccacgttctcctccggccttcgccgtccctaaggtgctgctaaaaagtctgaatggaaccggagtagttcttcaagccagacaagatctcgctgctggaatcgctggatgaaaaggattgcctttacaattccatgtgcgcgctgctgttgtggtgtggtccgaccacaaaacatgt

SEQ ID NO: 68370 - DNA, 445 bp, Zea mays
  Clone ID: LIB3076-018-Q1-K1-B7
acccacgcatccatgcgaaactgcaaagtacaagaacgtggtctgtgtttacttctatttaccaaacacggtgacaaggagaggttcaattgctcatgcaatagctatcatgagccaccaaatccctaatacaaatgagtcctactcacttcaaattattttgcctcagaaacaacttgcacgtacatcacacatgtattgcacctgtagttcatacacgcacaatgttgcgccaagaaggaagttcattgcatttgtgtctgcagaagcagagactgataacccgcaatctgagctaaagcctggaattgatctacttggttctgtgcatgagatattatatgatatttatgacacatatgaaccattgaatgaaccatctcttgataaattgcttgtcacaactagctattacgccaccacacattttgagacaactggaaca

SEQ ID NO: 68371 - DNA, 401 bp, Zea mays
  Clone ID: LIB3076-018-Q1-K1-B9
ctgacccatgctcccttcttcactctctttcaccctccccttcctactggcaacattggcaactttcccattacagatcgcttgatcacaacttatcattcaattactccaattcacatgactgttcactgaccgctcacgcaaccactccagacgtgcgccctgttcacattcatacatcattcctagccgcaccactgctccaaacacatattgtacggtcatcgctgcattcactgatcatgcacttgtcatactaatttccaagatctaccaccatgattcatctcctgacctcactctcatgaaataagaataggccatactacaaataataataaacctattaaagcatcttccttacggctcaatccagggtatcatatcctacttatcatgaa

SEQ ID NO: 68372 - DNA, 423 bp, Zea mays
  Clone ID: LIB3076-018-Q1-K1-C1
cggacgcgtgggcggacgcgtgggcggacgcgtgggaaatccttatggccttgactatgttgggaggagggttgttgcagccatgaaggcccgcattctcgtcagaggcttcggcatccgcctgcgcctgctgacgctcagtgtgcccgagtcgttggtggatttcagcgacaagcccttgatcatgcactagtacccaatgattcagactcatctaatgcttctgcttccttacatgaatatgcattaacagaacaatgcacccccagtacctagtccactgtagagcagtatacgacagatacgcccagtacccctagtcattcgtgggcattggtaatatcaccacacgctcccggagtcctgctgtgatcccgcccgctggcccgacttcttccctgggtgcaggtgattcatgaatat

SEQ ID NO: 68373 - DNA, 278 bp, Zea mays
  Clone ID: LIB3076-018-Q1-K1-C10
gagagattcgaacgggcacacgtgacctgattttagcacttttcagcacgaggatgacgagggatacaattgggaacttgctgacatacatgacctagcgagggaaggagcaactgaagatatagtgaagtatctggcagcgggtgtagaattcaacacgaaagattctgaaagcagtactgcgttgcactgggctggtgacccttgccatcttagagctagctaggctcttacaaaagcgaacgctgaccttaatgccaacgacaaatacaggaaaa

SEQ ID NO: 68374 - DNA, 246 bp, Zea mays
  Clone ID: LIB3076-018-Q1-K1-C11
gacccactcgtccgccgacccatcgttgctacatcacatgagttcacttcttttccacactggcatacagccagggcatttgtgacattttcttccagatgtgaccttcttgatcagcttattatccgacacatgtatacatatttgacacatactcaccgactcaaatgccttgacacatctcatgattactattcacatctctataacactacaggatcataagataatccctttttcattttt

SEQ ID NO: 68375 - DNA, 412 bp, Zea mays
  Clone ID: LIB3076-018-Q1-K1-C12
tcgacccacgcttgaggcactcgttcgcggacacgtcagccgactcttgtcaatttcaacatcgcctctacttgcgggatccattaggggatagtcgctacgagatgccaccttcaaaagtcgtggatgctccaaaattggatgcgcaatctctttctgtatcgcctttgagagccgcaccgctctcgaatcaagaaaggcttgtgctaatgaagctagcccttcaaatgaagaacagacctgactttccatagggaggaacaatgccatcaccggagttgcaaaaaccataaaaacgcacttcaagaatcaccctcttgctatcgtgaacatcaagaacagagcggacgggactccgattcagcaactgatatctgaactcgaggaggcgacaggatcggtgctagtgtca

SEQ ID NO: 68376 - DNA, 442 bp, Zea mays
  Clone ID: LIB3076-018-Q1-K1-A2
gtgcgatatggagtaaaaatccctggagaattaagtggagaagaaggttaagttcaacgcttcttgggtgttcgatgatataccccaaccagggatcatcgctgtgtctatgggtgccgaatcaaaattttcgttatggtacgttaattgatcgcacgatgtggaggaaaagtgttggattaatctcaaagtgatgctgacaaataaaccagaggaatggatgatctgatcaagtgccaggatggaagatgctcaccaagtggtcatcatctaaccacactaacctagtgttatctcgggcaagccccagtgcatttgccacctccttgctgttttaaaaacttttatcacttatatgctgcattaggtgatacgagttgtgtgaattaacagttgatgcattaccattctttggaatttgattactattccttgattcatg

SEQ ID NO: 68377 - DNA, 185 bp, Zea mays
  Clone ID: LIB3076-017-Q1-K1-E12
gacccactcttccgacagcaaaacgccagcaaccacctgtaatttatccacccaaaatccaatgactgttacatgtcactttaaacaagtatagacatcctcatatatattaacaagacatatattatcactaataaaaaatcacctatcttctatcatataatacaaccttataaggataccat

SEQ ID NO: 68378 - DNA, 214 bp, Zea mays
  Clone ID: LIB3076-017-Q1-K1-E3
cgaacccttggccggacccttggggtcgccgtcctttcccgttcgcaacgccacgctccggaccgccgaaatggccccgaagcgaggtggcagggcaccggtgccggccaagaagatgacggataaagtgacgaaccctttgttcgagaaaaggccgaagcagttcggcatcggcggcgcgttgcctcccaagaaggacctgcaccgattcgtc

SEQ ID NO: 68379 - DNA, 413 bp, Zea mays
  Clone ID: LIB3076-017-Q1-K1-E9
gtttattactatgcttttggttcatccgtcagcaactaaaaactgagtctcttgttaatgatatataagatgttccttttcccacgaaccaagtacgtgctacttgaccaactaccggaccgaattgcagcagctaatttgggacagctcacgccgaaattaaaaccttgtccaagcaataatcagtgcttctagacgtagaagcgatataatcattgtgttcgttcatcgatctgtcatgaaaacgacgcacgtacgtactcctacgacgtgcttcaaagattcctgggtttaataccacagctgtagccgagaaccgaaagcgatggtcgcacgtacgtttccagagggtatgttggtctctctcgccgcagtcgatgatgatgatgatgacgacgacgaccgtgcatttt

SEQ ID NO: 68380 - DNA, 456 bp, Zea mays
  Clone ID: LIB3076-017-Q1-K1-F10
cccacctcggcggccggcctcctcttctcttcacccacacgctggtcatagagatgtcggctgcagaggcgaaggcggcggcggtcccggagtctgtgctgcggaagcgcaagcgggaggagcaatgggcagcggacaagaaggagaaggcgctcgcggacaggaagaaggcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctggttgtggttcgcatccgtggtatcaatgccatgcaccccaagacccgcaagatcttgcagctcctgcgattgaggcagatcttcaacggtgtcttcctcaggttaacaagggcaaccccccattaacatgcttgcgcaggtg

SEQ ID NO: 68381 - DNA, 415 bp, Zea mays
  unsure at all n locations
  Clone ID: LIB3076-017-Q1-K1-F11
cagagacatcagagagcggtcctccttgtgtgtctgagctgaagaggaggaggaggaggaggagaagcagcagcgcagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagtcggggcacaagcagggggacatgctgctggtggtgccgcanggcgcgcacgcggtgcggctgggcaacgaagcgtcgatcccgcaagcgctggccgtggcgcgcggcgcctacta

SEQ ID NO: 68382 - DNA, 396 bp, Zea mays
  Clone ID: LIB3076-017-Q1-K1-F12
ggtttggtcatgtctatcacaaccttcaaaatcggttaactaaaacattgatccatgcatgtcttgatcctgccaaatcactgacacaacattatggtgctgtccaagggatatctgcactggggcccagcgcgattagactcctccttttgcccaaccttgtgacatatatgcaacttctggagccggaactgcagcttgagaagcagaaaaacgagatgaaaaggaaggaagcttggcgtgtttatggtgccttgctgtgtgctgcaggcaaatgcttgtatgatcggttgaaactatttcctggtttgctttctccgtcgatgcggcctcttttacagagcaacaaaagggtcttaaccaacaacccaaataagcgaaaatctagcacagatc

SEQ ID NO: 68383 - DNA, 56 bp, Zea mays
  Clone ID: LIB3076-017-Q1-K1-F7
acgtccacgcgttcaaccacgcgtccgctcactcgaacttggcgctagatatgtca

SEQ ID NO: 68384 - DNA, 303 bp, Zea mays
  unsure at all n locations
  Clone ID: LIB3076-017-Q1-K1-G10
gctgcgctcatgtctatcacattcttcattatcgggtaactaaaacattgaggggtncatgtctagttcctgccggatcagtgacacaacattatggtgctgtccaagggatatctgcactggggcccagcgcgattagactcctccttttgcccaaccttgagacatatatgcaacttctggagcctgaactgcagcttgagaagcagaaaaacgagatgaaaaggaaggaagcttggcgtgattatggtgccttgctgtgtgctgcaggcaaatgcttgtatgatcggttgaaactatttt

SEQ ID NO: 68385 - DNA, 277 bp, Zea mays
  Clone ID: LIB3076-017-Q1-K1-G11
cggacgcgtgggtggagcgtgttaatgtctactacaatgaagcctcctgcggaggctttggtgcccgcgctgatctcatggatcttgagcctgggacaatggacagtgtccggaccggaccctatgggcagatcttacgacctgacaactatgagtttgggcaatctggtgctggtaacaatcgggctaatggccactacaccgagggtgctgagctcattgactatgctctggatgatgtgaggcaagaagctgacaactgtgactgcttgcaagg

SEQ ID NO: 68386 - DNA, 417 bp, Zea mays
  Clone ID: LIB3076-017-Q1-K1-G12
cccacgcgtccggaacaagggcctgaagcgataacagcagctgaagaacagttgagctcgcagcattccacacttcgttaccagtgcctgtccatgtcttcaggaggctgaggcacacttttcccgattcatacagatttggattcaggcggagaccaccagaatgatagtgaacagaaggtggttcatgggggtaatcaggaggaaagaaaatatcgaagaaaaaaagattgtcatggtaaggtgttccaggtgccccaacgatgcaagccctcagaagatccatcctttcctcataaactctcacatgaataccatctggtaggtcattttgcaggatgttccattccagtcgcaccttcttcagccaacctcttgtaacactttcatggccattttccttcacaaaatgatgat

SEQ ID NO: 68387 - DNA, 209 bp, Zea mays
  Clone ID: LIB3076-017-Q1-K1-G3
tccgcatcttcacagcgtatcatcgtggttcatcgctcctactcctatcatccataaaatgtgagcggtattgatggcgcccaaggcggagaataagccggcggcgaagaaggtggcggaggaagagccctcggagaaggcggctccggcggagaatgcccccgcggggaagaagcccaaggcggtgaagcggctacctgcgggcaagt

SEQ ID NO: 68388 - DNA, 148 bp, Zea mays
  Clone ID: LIB3076-017-Q1-K1-G5
ccttcctcgccgccttcactacagggctttgctcctcccaactctcgaaaccctacgccaggcgatgagagatcgatcggtcgagcgcgaattccccagccgcgagcggtgggatcggccgtcgtccggtgtgcttgggcccccgcgc

SEQ ID NO: 68389 - DNA, 112 bp, Zea mays
  Clone ID: LIB3076-017-Q1-K1-G7
gaaacactggatctatacactgatgtgatgtgctaaagaagctcgataagcactaggatggggtctacaatattgaatgagagtagcctaatattgatacataggatatggc

SEQ ID NO: 68390 - DNA, 381 bp, Zea mays
  unsure at all n locations
  Clone ID: LIB3076-017-Q1-K1-G9
cccacgcgtccgcccacgcgtccgcccacgcgtccgcccacgcgtccgcccacgcgtccggtctcggcttctctctctcatcggcacacccgagctcgcgccctccttccacgtcgaggtccgagtcctgctttgatggcgaccgacgtgactgagactcccgcgccgttggtggatgcggccccagaggcgcccgccgacgccccggcggcgcctgctgccgacgcgaagccggccaaggccaagaaggccaccgcgccgaagaagcgcgccagcccgacccacccgccgtacgccgagatggtctcggaagcgatcacgtcgctcaaggagaggacggngtccagcagctacgcgattgcccagttcgtggaggacaag

SEQ ID NO: 68391 - DNA, 322 bp, Zea mays
  Clone ID: LIB3076-017-Q1-K1-H10
cgacagtcgcgcgcgcggagcatccgttgtcgggttacagaagtgtgcatgatgaaccgggcgatcttttgttcgatctagctccaccgacgtgcgacgaagaagatagaatgaaactacaacagctgcaatacatttgagctgcagagctagcttagtgcctgtttgggatcctggtctttcactgcctggtgtggtagatgaacggtggtgagcactcccttaagcctagtgtttgggaggaaaggggggctatacctagagagggaaaaccccacagataactaaatatcttatttaaatgtctttttaagccttgttc

SEQ ID NO: 68392 - DNA, 397 bp, Zea mays
  Clone ID: LIB3076-017-Q1-K1-H11
gggtacgtcccgccatgttcagataattcttacaaagttaaccgaccaccagcgaccttcgggaaggtgtacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcatgaattcgtgagcactgtgtcctgcataaagatcctctccccgcaggaagtgcagcagatggggaagcagggcctggagctcctgaactcggcccccgcacggaggctcagtagcagctgtgacgactacgttagcaagc

SEQ ID NO: 68393 - DNA, 321 bp, Zea mays
  Clone ID: LIB3076-017-Q1-K1-H12
caatgctaactgcaccttaaactgttttgctccccttgctaaagacaggcacaacgtccatttcataatggatccctcgatcacaactgttcatgccatcactgccacccaaaagactgttgatagaccctcaaccaaagactggacaagtggcacctctgtcagctttaacatcatacccagcatcacccttactgccaacgctttcattaaagatcttcctcaaatgaatgccaaactcactggcatgttcttccggaatcccaccccagatgtatcaactgtatacctcactgccagaatctagaaactgtccttcta

SEQ ID NO: 68394 - DNA, 311 bp, Zea mays
  Clone ID: LIB3076-017-Q1-K1-H9
gctaaagttgtcgattttggagtggcgtgtgaagaaacatactgcaatttgttgggggatgatccaggtacttatagatggatggcaccagagatgtacaagcacaagccctatggccggaaagttgatgtgtatagctttgggcttatcttgtgggaattggtcaccggttcactcccttatgaagatatgactccgcttcaggcagctttcgccgttgttaataagaacttgaggccggtcattccattgagctgcccagcggcgctgaagcttctgattgagcagtgttggtcctggcaaccagaaaa

SEQ ID NO: 68395 - DNA, 447 bp, Zea mays
  Clone ID: LIB3076-018-Q1-K1-A1
gtgcgatatggagtaaaaatccctggagaattaagtggagaagaaggttaagttcaacgcttcttaggtgttcgatgatataccccaaccagggatcatcgctgtgtctatgggtgccgaatcaaaattttcgttatggtacgttaattgatcgcacgatgtggaggaaaagtgttggattaatctcaaagtgatgctgacaaataaaccagaggaatggatgatctgatcaagtgccaggatggaagatgctcaccaagtggtcatcatctaaccacactaacctagtgttatctcgggcaagccccagtgcatttgccacctccttgctgttttaaaaacttttatcacttatatgctgcattaggtgatacgagttgtgtgaattaacagttgatgcattaccattctttggaatttgattactattccttgattcatgtttat

SEQ ID NO: 68396 - DNA, 363 bp, Zea mays
  Clone ID: LIB3076-017-Q1-K1-E11
cgagcaagaagccaggaaccagctcaaagttattcgtccaagaaccccaccccgctccccgaatagaaatttcgtcttggagagccaccaatggcttgttccactgcatctttagcggcgacgctgctggcgttcgcgctgatgttccaggcctgcgtcgcggggaggaggaggctcaccgcgctcgtgcaggagccggccatcaccatgaagtaccacaagggcgcgctcctgtcgggccccatcgccgtcaacttcatctggtacggcgacttcacggcgccacagcgggcggtgatcaccgacttcgtctcgtcgctgtccgcggccccgcgggcggcggcgcagtcgcagccggagccg

SEQ ID NO: 68397 - DNA, 363 bp, Zea mays
  unsure at all n locations
  Clone ID: LIB3076-018-Q1-K1-A10
acccacgcgtgcgcccgacgccaggtggctccacatctgctctaacgagactatccacggcgtggagttcagggactacccggagccctgcaacaggtcgggcatcctcgtcgccgacatgtcctccaacttctgctccaagcccgtcgacgtctcccgcttcggcgtcatctacgccggcgcacagaagaacgtcgggccctccggcgtcaccatcgccatcgtgcgcaaggacctcatcggcgccgctcagcccatcacgcccgtcatgctcgacttcaagacgcacgccgacaacgcctncctttacaacaccccgacctgcttcgccatctacgtttgcggtctcgtcttcaaagacct

SEQ ID NO: 68398 - DNA, 477 bp, Zea mays
  unsure at all n locations
  Clone ID: LIB3076-017-Q1-K1-B10
gctgatgctatccacaggggtggtggacaggtcattcccactgccaggagggtcatctatgcttctcagctcacggccaagccaaggctgctggagccagtgtacctggtggagatccaggccccagaaaatgcgctcggtggtatctacggtgttctgaaccagaagagaggtcatgtctttgaggagatgcagaggccgggcaccccgctctacaacatcaaggcttacctccctgtcatcgagtcctttgggttctccagccagctgaaggctgcaacctctggtcaggcgttcccccaggctgtctttgaccattgggacatgatgggctctgatcctttggaggctggctcccaggctgctcagctggtgctggatatccgcaagaggaagggtctcaaggaacagatgatcccactttctgagtttgaggaccaagnccccttctaaaatttgtggtttgttggtgacact

SEQ ID NO: 68399 - DNA, 340 bp, Zea mays
  Clone ID: LIB3076-017-Q1-K1-B11
gtgagccggagagcttagagctaagtcctcgtgtgaaagatggaaatggcgcgaagcccagctcatgttgctctctgctcgcttgctctgctcctcctcctcctgcttccagccgcgcggtcggcgacgttcacgctgaccaacaactgcgggtacacggtgtggccggggctgctgtcgggcgccggcacggccccgctgccgacgacggggttcgcgctggcgcgcggcgcgtcggcggcggtggacgcgccggcgggctggtcggggcggatgtgggcgcgcacgctctgcgccacggacgccgtcaccggcaggttcgtctgcgccacgggcgact

SEQ ID NO: 68400 - DNA, 451 bp, Zea mays
  Clone ID: LIB3076-017-Q1-K1-B12
cggacgcgtgggcggacgcgtgggctacgatgtggagatattgattctgctgttaagatgtttgaagagtattcaagctcgaggtccccacccgctgagttgtatgcgacacttgctgagggagctatgattgggtacactccaagaggaatgcaacttgctcaagaaactatagagaagatgacttcaagaaattttttcttgaatgccaagatgggaactgatctcctacttgcagctgccggtgaaacggctggtggatatacgactgcaaattatgtctgggatctcctgcaaagccgtaaaatcactccaacacttcctgctgttgaggcataccacaagggtctgacggcgcgagagattccttctgacgatccacgacttctcaatgttacccatgttttggacaacctgaaacctcccgaattttttggaccaaagagaaaca

SEQ ID NO: 68401 - DNA, 193 bp, Zea mays
  Clone ID: LIB3076-017-Q1-K1-B2
gtagaggacagggtggccccaggaaaggatgaagtaattggaaggacaatcattgcactgcagcatgtacccctgaggctggatcacaggttgctaaccaaccagtggtataaccttgagaagcatgtgattattgatggtgagcctaagatagagaccaaattttcaagccggatccacttgagaatatgtc

SEQ ID NO: 68402 - DNA, 439 bp, Zea mays
  Clone ID: LIB3076-017-Q1-K1-B3
cccacgcgtccggagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttatt

SEQ ID NO: 68403 - DNA, 410 bp, Zea mays
  Clone ID: LIB3076-017-Q1-K1-B7
ggaacatcagatatcctgttgcatcaaattcaggttaaaatcaagtgggctgacacaaggagtggtgtgatcaagaagcacgagaaagaatttgaagacagagtggaagaggcctaaaaatcaattaaggtgagctagattaaactgaagcatttgttatgaataaatttgcatctgcttgtgatgagttatgctctgttttcttcattttcctacttctgccttactggctcatgtttagatatataattattttttgagtgttcatataatggcaactactgtattaaatagtgttgccgaaccatgtttcttacttgatggcagaaagtgaacaatttaagcatgcagacatcgacatacgatggcatgacaactacctctctgaatctgtatgaataatggatttt

SEQ ID NO: 68404 - DNA, 181 bp, Zea mays
  Clone ID: LIB3076-017-Q1-K1-B8
ccaaagccatggctctccgcaccctggcattgaagaaggtcctatccttcccgttcggcggcgcgggccggccgttgacggcggcggcgtctgcgaggtgggtgacgacaggtcacactttccgacctctactacgactttggctcgctggtacctgccatctcgggtgagatcatgcgct

SEQ ID NO: 68405 - DNA, 231 bp, Zea mays
  Clone ID: LIB3076-017-Q1-K1-C1
ccaaagccatggctctactcacccttgcattaaataaagtcctatccttcccttggggaggctctaaccgaccgttggcagcttcagcatatacaagattgatgactactgttacatctactatacctctactactactacttcacgctgtaacatgccatctcacattagatcatacactagcaccaccaaaatcaccacaccacctactttatcaactactactaggca

SEQ ID NO: 68406 - DNA, 152 bp, Zea mays
  Clone ID: LIB3076-017-Q1-K1-C10
gacaactatgcgctgctggccgcgttgccggacacggcgcctgcgcggcccgacgggcgcgcatatccgatgcttgcgggcatgtcgcgcaagtcgatgctcggcgcggtgatcggcggcaagccgccgctggagcgcgtcgcggcgagcgt

SEQ ID NO: 68407 - DNA, 393 bp, Zea mays
  Clone ID: LIB3076-017-Q1-K1-C11
tgaaagctgatggttcttcgttcccttcctttagtcttggtgctgccagcaacgggagtgccgccacagtgcttgctacctcagcagaagcacccaagaaatttgctatggcagaaggccctgtcgaaaccggcgaagaaaacgagaaggctgtatttactgccgattctgccttgtatgagtacctagatgggggctggaaagaaagaggaaaaggtgaactgaagctgaacgtccctgtatcctcctccggcggcgagagagcccggctcgtcatgcgggcaaagggcaactaccgtctggtcctgaacgcgagcctctacaacgacatgtcgctcaaggacatggacaagaaaggcgtgacgtttgcctgtatgaacagcattggggagt

SEQ ID NO: 68408 - DNA, 408 bp, Zea mays
  Clone ID: LIB3076-017-Q1-K1-C12
cggacgcgtgggaaagaagaaactccgcatggctcagcaatctaactctcatgtacagcagtcaaaaattggatctggtgagggtgattgtgtcgctaccccagcacccccatccattgaagcttcacctgcacttcctgtcgattgcgatgatggtgagccttcactcaacttgaaatctgcatcattgtcatcttcagctggcagcaaggggctagatgagttacctcccgcatttaaagaagcaaatcaaaccgtggatggctcagaagctgttgcggccaagtcagatgctcctgaaattggttgtcaagtacctggttcctctccattacatgacaaaggtagcgaatccttcgggtcgccagtgaaggacactcctgaggctggaatcagattgccaggatc

SEQ ID NO: 68409 - DNA, 145 bp, Zea mays
  Clone ID: LIB3076-017-Q1-K1-C4
cccacgcgtgcgtccacgcgtgcacccacgcgttcgaccacgcgtgcggcgagcgccggggttggggttattatgttattttagctgggacttacttagtcaaccttatagtatggttaaagtgttcacattacacgtttggcaa

SEQ ID NO: 68410 - DNA, 300 bp, Zea mays
  Clone ID: LIB3076-017-Q1-K1-C9
cggacacgtgaactatcacccttattatttttttatcatgatcactttaatcggggcagagcctattaagaatagcccaagcataaaccacttcgccacatactaacgccttataaacatggatctcatccaatcaaccaataaatgcatcatatcctctggtaaccatcctgaagtacccaaatacaaatcattctagtctgtaaaatctgacaacttgtaatactatgaccactaactgcccattataatttatcaagcacatcgattatgtatgcatatataagcatataccgtatc

SEQ ID NO: 68411 - DNA, 405 bp, Zea mays
  Clone ID: LIB3076-017-Q1-K1-D10
cccacgcgtccgcggacgcgtggggttggcttctcctccccctccggttcgggttcgggtgcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaagaggcgatgcggaacgccatcgagggcatgaacggcaaggagctggacggccgcaacatcaccgtcaacgaggcccagtcccgcggcggccgtggaggcggcggcggccgcgggtacggtggt

SEQ ID NO: 68412 - DNA, 392 bp, Zea mays
  unsure at all n locations
  Clone ID: LIB3076-017-Q1-K1-D12
ccggcccgacgcacgcgtccgcaagtccccctgtcccgctaggattccctttataccctcccccaaaaccccaggtcgnaggagagctcttgatgggcggcttcgggcaccacggccaccacggccagaacccgccggcgcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcaacacccaagtcaaagacgaagaaggcaaccctgcgtttcgcctggtcaacaaagccactgggcttggcattaagcacttcctttggcaatcccaaccggtgaaactt

SEQ ID NO: 68413 - DNA, 368 bp, Zea mays
  Clone ID: LIB3076-017-Q1-K1-D7
agctaagaaggctcctgccaaggaggaagaggaggaagacgaagatgagtctgacaagtccaagtcggaggtcaatgacgaggatgacgaagagggtagcgaggaggatgaagatgatgacgagtgatggagagctcgctcgagacattggacggtgcttcatccaacaatggagcggttacacaaggccccgtggcgatcaaaaaataggagcctatatccatgtactagaattattcagtttcactccacatcgtgatgttttatttttacttttgtcgtgctataactggatagcgctcctcgttggcgccactagcgggtggatctacctctggtctggtgtagttgtgtgtggtcacacttgt

SEQ ID NO: 68414 - DNA, 230 bp, Zea mays
  Clone ID: LIB3076-017-Q1-K1-D9
aggagatggcggagcagatcgccaaggacctcgcgttcacggagaatgcggagccactggggaaaaacgtggtgtccccccgggaacaacaacaacaacttgacccggaaaaataccttgccaccattccacaacttattccaaaaccggaagttgtgggccttgccgaaccggttagccacgccctctttccagaaccttgcaatgtcgccattcttggggggcttaac

SEQ ID NO: 68415 - DNA, 444 bp, Zea mays
  Clone ID: LIB3076-017-Q1-K1-B1
cacacgccgacgcgaaccaaccaaccagctggtagtaggttcgccgcgctgacgatgatgcctcgccgcgcccttctcttcgccgcggtgctcctcgcggcctccgccgccgcggtctccgggttccacctgggaggggacgagagcggtctcgtgaggggtgtgctcgccgcgctccgcgagcgagccgaggccgaggacgccgctcgcttcgccgtcgcccactacaacaagaaccagggcgccgctttggagtttactagggtgctcaaatccaagcggcaggtggtgaccgggaccctgcatgacctgatactggaggcagctgatgctggaaaaaagagtgtgtacagagcataggtttgggtgaagccgtgggaagatttcaagtctgtcgttgagtttcgccttgttggagactctgaatctgaacccgaaccttct

SEQ ID NO: 68416 - DNA, 447 bp, Zea mays
  Clone ID: LIB3076-015-Q1-K1-G5
tgctgatcagagtaaagcaaagattcttaagtatcatattgtgaagacaccgagagcggtgtacaaaactgtcccaaactgtgagccttgccggcctctccaaaggtcacctatcgaaggtttctatctagctggtgattacacaaagcagaaatacctggcttctatggaaggtgcagtcctatccgggaagctttgcgcccagtccatagtgcaggattatagcaggctcgcactcaggagccagaaaagcctacaatcaggagaagttcccgtcccatcttagttgtagttgcctttagctatcgtcatccccactgggtgctatcttatctcctatttcaatgggaacccacccaatggtcatgttggagacaacacctgttatggtcctttgaccatctcgtggtgactgtagttgatgtcatattcggatatatatgtaaa

SEQ ID NO: 68417 - DNA, 347 bp, Zea mays
  Clone ID: LIB3076-015-Q1-K1-G6
cggacgcgtgggctcatcaccagacgtttttccatggttgaaaccgtgatcgggcgcccgaacagcaacaagaaagtgatactctttatcagtcagtcaagctgaatattttcaaaattttcagaccaaacagtgataagcatgctactgctggacagtcgccctaattgtctgtcctgcggaattgtttctgggagtgtgtattgttaagtcggttttctccgagttatacgagacatatggcttgagttgtgtcaccaatatgcttatgccataggactatcagagtttacttttaatttcagagaacataatttccatcaatttcagtaggttcatttttaatg

SEQ ID NO: 68418 - DNA, 59 bp, Zea mays
  Clone ID: LIB3076-015-Q1-K1-G7
actatctcccatgctctcatcaccaatcttcatttcatctttcatacctttcacttgcg

SEQ ID NO: 68419 - DNA, 424 bp, Zea mays
  Clone ID: LIB3076-015-Q1-K1-G8
agcagcggcgcccccaggccaggccccacccgctcagcctcctcagctgcccaaccttctgcccatctgctcagcctgagctgtcattcccgcgaagcgccgtctcccggctctatcgatggaccgagtcgccgccctcgtcgtcgcgctcctcgccctcttcttcgccgccggggccacggcgcaagccccggcctcgtcgcccaagcgcactccagcgccagcgccacccaggacggccttcctcccgtcgccgccggccagggcgcctatggcctccccgccctcgcctgccgcgatggcgccggtgcccgcgcccttcgccggcgtgccggccacgagccccgacggcgcgggagctggtgacgacgcgatggccctcgccagagccgtggcagctctgactccggctgacgggcccgtc

SEQ ID NO: 68420 - DNA, 445 bp, Zea mays
  Clone ID: LIB3076-015-Q1-K1-G9
ctcacgcccattgactagagcatattcagttcgtactgaaccaaaaagacactgggggctggagtcatgtaaggcttggtctgcagcttcctcgtattatgctgtatcacaatcaacactagcgccttctcaccttctggatggaccaatgcccatgccactttttatggacgtagcgatgcctaagggaccatgggaggagcttgtgggtatggaaatctgtattcgacagggtacggaactgatacagcggcattaagtactgccatatttaacgatggagcttcatgtgatgagtgttacaaaatcatatgcgattatcaaacagatcccagatggtgcttgaaaggagcatcagtaaccataactgccacaaactattgccctcccaattttgctattcccaacaacaactgatgatggtgcaacccacctgtcaaacatt

SEQ ID NO: 68421 - DNA, 330 bp, Zea mays
  Clone ID: LIB3076-015-Q1-K1-H10
tcagatcatatgttaggtaggttatcactctttttcatcatcttcgatttggagcgcttggtccatacacaacgggagctaccattcttggtcttcacgatcgacacgcaccaccgtaagtgcactgcacactttccgagcctggactttcacgagcgcaattgctacctaaatgtcatgctcaccgtcatcattcatgatcctgccccaaacccaactattgccaaaatcgccttccgttaacctatcagatacaataagcatatccagctattgatagcctgccagggactctacacctgtcacatcatataatgctgcaacaaggcc

SEQ ID NO: 68422 - DNA, 205 bp, Zea mays
  Clone ID: LIB3076-015-Q1-K1-H11
tcgtccgccaactcctatgtaagtcacccatacctctcttacgacatcaatgtgactagagagtaaagccgtactctgtgagagcgcacaagctacgtcatcacgaatgacactctcaaccgtagcgaccctcctctcataacgtgacagaactactggcaagcacaacgactaccaaaatagcgtcttaacattcatattcctt

SEQ ID NO: 68423 - DNA, 291 bp, Zea mays
  unsure at all n locations
  Clone ID: LIB3076-015-Q1-K1-H12
ttaagttgggatgaccttttcatgtcgagattcatcaagctcaattgaagtttggttcagtctttcttggcaaactcagtctctgactcgacactgaacataccattgcctattcttatgtttttctgggccatgtggcgatcaacaggccatttcttacatgatgcccaccaagaaattgatanacagctaaggattgtaatgctattagaattctaaaccagtaacacagatcaatttggttgagcgccttgtccaagaattgttttatcaatcatattgtaaaggcac

SEQ ID NO: 68424 - DNA, 185 bp, Zea mays
  Clone ID: LIB3076-015-Q1-K1-H2
attttctcaatctgatctagtcattcccactaaacaccaactccctactctatccatttacctattcaccatcctcatcatcactctcctcaccctcttcttcacctccatttccactacacaatccacttcctattatcccaatcacactccaacaccaacaccacccattacttatctttctc

SEQ ID NO: 68425 - DNA, 298 bp, Zea mays
  Clone ID: LIB3076-015-Q1-K1-H4
cttctcgccttcttttttctctagtgctactgccactactgatccgacaggaaaaccgcggggaagagacgtgttcagagttctaactcgtgctgcttgctgtctgtaggcgtgctgaaatcactacaaactttacaagattcccctacaatggcgagcgatccgtcgacgttctcgccaatcggggtggacgccatgggcggcggctactttatggccggcagcagcagctactgaggcggcggcatttttagcgcccaggtgcctcactttcaccaccccggcgtgcttcttgacc

SEQ ID NO: 68426 - DNA, 373 bp, Zea mays
  Clone ID: LIB3076-015-Q1-K1-H5
tgatgttacaacaatcagagcaagtaccccaatgtttttgatgtcacgcaaaatcaaatctttgggtgtgaagatgggtatttctggcgaaaggtcagatgaaatttttggtggttacctttattttcacaaggcaccaaaccagaaagaattccatgaggaaacatgtcggaagattaaagcactacatctgtatgactgcttgagagcttacaaagcaacttctgcctggggtgttgaggctcgtgttccattccttgacaaaagtttcatcagtgtatcactggacattgatcctgaatgtgaaatgataaaacgtgacctctgtcgaattgagaaatggggtatctcgcatgcatttgatgatgaggag

SEQ ID NO: 68427 - DNA, 423 bp, Zea mays
  Clone ID: LIB3076-015-Q1-K1-H7
cccacgcgtccgcggacgcgtgggctcgggctagattagcaaatggagttgcagggggcagtcaaaatggtttccatgatgcagatcgaattgcccgtaaaggtgaagaaccatcaagcgctatactaaatggaagagtgcatggtgctgtctctgcagatgaaacactttccctgatcacacaaaacattgcttctaccgagcgaccagcagaaaatgctgctgctgttaggactgagcaacataaggcgaacttggtacttacgccaggcatgaatgcttctagaagttctcatgatgcagttgaggtggctggtgaaagcaagactggcaatgaaacattgctttctgccgaaggaagggagaagttgggaccatctttaaatggcaccagccagggaattaaaaggccgctaaataatg

SEQ ID NO: 68428 - DNA, 334 bp, Zea mays
  Clone ID: LIB3076-015-Q1-K1-H9
tcgccaaatcataggataggttggttaacactctttttcatcgtattcgaattgcgagttgttatccgtacacagtgggagcaaccatgcttggtcttcaagatcgactcgcacgaccgtaagggcactgcacactttcggagcttggactatgacgagcgcaacggctacctcaaggtcatggtcaccatcataattcatgaccctggtcaaaacgcgacagttgccaaagtcgccttccggcaccctatcagatacaacaagcatatcgagctattgatagcctgccagggaatctacacctgtcacaccatatacatgctgaaagaaggcc

SEQ ID NO: 68429 - DNA, 283 bp, Zea mays
  Clone ID: LIB3076-017-Q1-K1-A10
gcggtctaccttccgccatgttcagataatgctttcaaatttaccgaccaccagcgaccttcgggaagcgttacaattctggaacctacgggaggtcgcttgatatcactaggtttagcagctatcacgagctccgtacggaactggggcgcctatttggccttgatggccagttggaatacccattgagatcacgctggcagcttgtattcgtcgaccgtgacgaggacgtccttctcgtgggcaacaacccttggcaggaattcgcgagcacggtgttctg

SEQ ID NO: 68430 - DNA, 179 bp, Zea mays
  Clone ID: LIB3076-017-Q1-K1-A11
caccatgattcacctaacagagtggaaccctggctaatatatgcgtgacttgatgcaacacgtaacgctttttgccactgaactatgccttaacataggctgattactacgcatataatggacttgcatcactaacgctacatatatatgagttcagtcacatggagagcttgtatgac

SEQ ID NO: 68431 - DNA, 186 bp, Zea mays
  Clone ID: LIB3076-017-Q1-K1-A2
gtgatggccagcccatcggtcgctacgacgacatgtgggcaagatggagtgtgaaggtcagtctgggaccaccttagcctgggagtcaagactggcctggcatacatctggcacagcgaggctagcaaccccttagttaacttggagaaggagtacaagggcatgttctggcaagaggacatcatg

SEQ ID NO: 68432 - DNA, 444 bp, Zea mays
  Clone ID: LIB3076-017-Q1-K1-A3
gagaaagtcagctgctaagccacctcctaagaagcggatggacaagcttgacactgtctggtcctgcccattctgcaaccacgggagtagtgttgagtgccgaattgacatgaagaatctgattggcgaagcatcttgtagaatctgtcaggaaaacttcagcacaactgttaatgcactcactgagcctattgatatatatagtgaatggattgatgagtgtgagcgtgtcaacactgttgaaggcgacgatgatgcgtgagcttgccccatgcgatgaaactgttacctacaatcgtaatgtaatgtgctggtattctcgaatgccatagcccatagtcagccatggcttggaataacgtagtggctgaccgatatgccagtaggcaccttatctagtacttacagaactacaaaaagtttgtactatacatatatggacaa

SEQ ID NO: 68433 - DNA, 51 bp, Zea mays
  Clone ID: LIB3076-017-Q1-K1-A4
cttacgatgatgccaatctgacgagacggtaccaactgatctgccatgcat

SEQ ID NO: 68434 - DNA, 447 bp, Zea mays
  Clone ID: LIB3076-017-Q1-K1-A7
gctggatgaccaggaagaagaggaagcggttcaagcaccgccgtgcgagcaccagcttctgctgggagcgcttccgtgctgatgctgttctgtgatacggcgctatcctcgccgagcttattcctcgacttccaacctattcaccaccgctgtcagaacccttcttgtgacaaaaagttaagcgagcgtcttcttgaccttgcaagactttttgtccggagataatctcctacgaattaccctcttgcatcttgcgactacctctcctcgtctcgcgcctgtcgatccttccatccctctcgtccccgtctatccctcttgagcttggaacactctcgcagctagtagtagctatatattattggtttcctttcacctactttcgcatgaactactctgctatttgctgtaataaagctaagttttccggtgcattgttcttttgca

SEQ ID NO: 68435 - DNA, 349 bp, Zea mays
  Clone ID: LIB3076-015-Q1-K1-G2
cggacgcgtgggctcatcaccagacgtttttccatggttgaaaccgtgatccaaggccagatcagcaacaagaaagtgatactctttatcaatcagtcaagctgaatattttcaaaattctcagaccaaacagcgataagcattctactgctggacagtcaccctaattgtctgtcctgcagaatagtttctgggagtgtagtattgttaagtccgatttctccgagttatactagacatatggcttgagttgcgtcaccaatatgcttatgccatacgactatcacagtttacttttaatttcagagaacataatttccatcaatttcaataggttcatttttaatga

SEQ ID NO: 68436 - DNA, 115 bp, Zea mays
  Clone ID: LIB3076-017-Q1-K1-A8
acggcccgtaccggcagctccagctagagtgccactcacacacacgttacactgcgttgtgcgcaaggctccgactttgatgcgcgtacccgtcacggtccatggtcttcgtcgt

SEQ ID NO: 68437 - DNA, 448 bp, Zea mays
  Clone ID: LIB3076-015-Q1-K1-E5
ggccgtaccgtacggcgccgggcggcacagcggtgtcctcatccgtggcgcaagtgtatgtaagatcgtcgccgggcgactctgcagtctgcgacggcgccttatcatcacacacggaaccagattgcgggcagccatagacgaagagagaaagaaaggtcaacagggcactgcttgcctgctgcgtagtgactagtgtgcctcaaccaaaaggatccatggctcccggagacgactctaaccccgccgcctactatatccacacggtgcagcacctgatagagaggtgcatgacgttcgggatgagcatggaggagtgcatggaggcgctggctaagcacgccgacgtactgcccgtcgtcacctccacagtgtggaaggagctggagaatgagaacaaggagttcttcgacaagtaccaagagtggatatcggagaagcgaaacgc

SEQ ID NO: 68438 - DNA, 335 bp, Zea mays
  Clone ID: LIB3076-015-Q1-K1-E6
actcgtccgaccacgcgtccgaaaaccctagagctccctttccagtcgcgctagcgacacaaaggtcaggtctcttttaaagcgctggctggccacagctgaactcatccctcgagttttcgttgcgaacctgaatccccgtgtgacgctgctatacattcaagaccactaccgcacatttgcggctctcataaccccatccgttcctaggtaaccaccacgttttcacttgatcaacttccacgaccgcatggattcacaccaacacatcaatcatttcgatcgcaagacttctctgaggcaaaatctgtcaaccaatactaccaccgtctttt

SEQ ID NO: 68439 - DNA, 437 bp, Zea mays
  Clone ID: LIB3076-015-Q1-K1-E7
cggacgcgtgggcaagtacagcctttgactaaccagacgtcgcttgagttggattctcctggcaatggcaccttggctctggtaacagatgccaaaaagtccacatctggagctggagatgatggcagcaacagcacctcaccctccactcatgtggacaagaagacggacggcggagatggtcccaaagaagacgtggatgtgtccactaaaataatgaataaggcaattagtgaagatgaagttgttccagagtgataaggagatccaagatctcgtgtcagcttctggtgtgacctgtaagtttgtaggacttggtttatctcctagacctggagatgcaatgcaagcaggctatcttggtgcaccctttttttgtataactagtaactggcacgtgccctacgctggtagatttttttttgcaatataagtag

SEQ ID NO: 68440 - DNA, 447 bp, Zea mays
  Clone ID: LIB3076-015-Q1-K1-E9
cagactcgtgggtcaagatcgcgctcaccatcatccgcgactggctcaaggctgaccccgggaaataccgcacgatgaagcagaggcttgactgcgtgtctgatgacaccaccacggttgtcaagaggctctaccaaatgcatgagaccgacgcccgcctgttccctgccattaacgtcaacgattccgtcaccaagagcacgcttgacaacctgtatgggtgccgtcactcactatctgatggactgatgatggccactgacgttatgatcgccggtatggctgctgcggtctgcggatacggcgacgactgcaagggtcgcgctgctgggctgaagcatgctgacgcccgtgtcattgagaccgagatcgaccccatctgtaccctacatgctctgatggacggtctcaaggtacttgcctcggaggacactgtctccgaagctg

SEQ ID NO: 68441 - DNA, 452 bp, Zea mays
  Clone ID: LIB3076-015-Q1-K1-F1
cggacgcgtgggcaagtacagcctttgactaaccatacgtcgcttgagttggattctcctgcaaatggcaccttggctctggtaacagatgccaaaaagtccacatctggagctggagatgatggcagcaacagcacctcaccctccactcatgtggacaagaagacggacggcggagatggtcccaaagaagacgtggatgtgtccactaaaataatgaataaggcaattagtgaagatgaagttgttccagagtgataaggagatccaagatctcgtgtcagcttctggtgtgacctgtaagtttgtaggacttggtttatctcctagacctggagatgcaatgcaagcaagctatcttgttgcaccctttttttgtataactagtaactggcacgtgccctacgcttgtagatttttttttgcaatataagtagaaaaaatcgcaatat

SEQ ID NO: 68442 - DNA, 239 bp, Zea mays
  Clone ID: LIB3076-015-Q1-K1-F10
cacccattgcttacctattaattcgaagatttaactgaactcgactctcacatgacttaccttaattttgcccagaactatcatcgagctgaacacgaatcagttactatccatatccacttctattatattctcactcgtcgacatatccctactagttgcagatgttattgctgatcatccaccaattgtccgctccaatgctaacatgatccaacatgaacctctatgacttcaaa

SEQ ID NO: 68443 - DNA, 451 bp, Zea mays
  Clone ID: LIB3076-015-Q1-K1-F11
cggacgcgtgggcggacgcgtggggttttgcaaccagtattctgttccaaaggacaaactggagcatttcaaaaatattactgcacaggacatagtttgttcgcagaaatcttctgaggtgctgctgaaggaagaggatgttgcagtaagcaatgttaagatagatcttactcgtggaaaagataacccccttgaaagcatcaagttctttaaggattttgggtgcgacgagaagttccccatcacagatgatagggttagccacttgctacctgcatacaacgaggatagaattgtgagggtctatgccaagaagcctgagttggttgatgtggtgtcagaagcctttgagaatctccagatgagaatgtatggtgagaaaactcaagtgcatgagacgcccaagagaaagaggattagatccaactaggcagttggattttgtctaatc

SEQ ID NO: 68444 - DNA, 450 bp, Zea mays
  Clone ID: LIB3076-015-Q1-K1-F2
ctcaccgctgcgttcttccgctcgcccccttacaacgaaacctagagagtcccgggcgtgacatggcggacggcgcgagctcggcgtctggtctggtggagaagctcgcggagctctcaacgggcggcgccgggcagaatcctccgccggcgggtgaagtcggagaggagttgcagctctcgaagaacgcgaagaagagagaggagaagaggaagaagctggaagaggagcggaggctcaaggaggaagagaagaagaacaaggcggcggctgctgctgctagtggaaagcctcagaaggcatctgctgctgacgatgatggcatggatcccactcaatactacgagaataggctcaagactcttgattcactcaaggccgcaggtgtaaacccctatccacataagtttccggttggcatctctgtagtggaatacattgagaagtaca

SEQ ID NO: 68445 - DNA, 451 bp, Zea mays
  Clone ID: LIB3076-015-Q1-K1-F3
gctcgcttggacatttgaaagacaaggtactaagttggaatggcggtggaagctgcagccgtcaccaaacacgcagcagactatatctgagatcctggattttcttatggatgcaaatatacgcttaagtgtatgtccctttgcttcacctcttcactttttcagcctacctgtgattctgaaacaggtttgccaatcgctaagctctgcttatgttgatgaccaagggatgaattggttcttgaggcgcagatgaatataaacttgatttccctgaattattcctaccaaagctactgaaccacttcagcacgtttcttacttggccctaaatttacggaattctctatattttcctcactttaggaagaagttgtgaggaaaacacaatcctttgacaagttgaaacaagaagctgagaaatgcttgcaacaaagtgagagatttaaca

SEQ ID NO: 68446 - DNA, 437 bp, Zea mays
  Clone ID: LIB3076-015-Q1-K1-F4
cccacgcgtccggccgcgaggagccagccagccatggtcgtcccagtcccgccgccgcctgtcctcgcttcccacgtggccgtccgggccgcggcctccgccatatcccacggccgccgggtcctccttaacggcgaccacccgccgcaggtcgcggccctcgggcgcggcgactgggtcaagctcatctgcggcgccagctttgaggatgcagctgatgtcaggaatctctcccttgtctacactcttgctggagtggattgcattgattgtgcagcagatgcatctgtggtgggagcagtgaatgaaggtattgaagtagcagcatcaattgtaccaacagttcaaaggccttggctgatgattagtgttaatgatgattgcagagatcttcatttccgtaaagctgagtttgatcctgatgattgcccactgga

SEQ ID NO: 68447 - DNA, 432 bp, Zea mays
  Clone ID: LIB3076-015-Q1-K1-F5
cagacgcttgggcaagtacagcctttgactataccttacgtcgcttgagttggattctcctgcaaagggcaccttggctctggtaacagatgccaaaaagtccacatctggagctggagatgatggcaacaacatcaccttaccctccactcatgtggacaagaagactgactgcggagatggtcccaaagaagacgtggatgtgtccactaaaataatgaataatgcacttagtgaagatgaagttgttccagagtgataaagacatccaagatctcatgtcaacttatggtgtgacctgtaagtttgtaggacttggattatcttctagacctggagatgcaatgcacgcaagctatcttgttgcacccttattttgtataactagaaactggcacgtgccctacacttgtacataattctttgcattat

SEQ ID NO: 68448 - DNA, 436 bp, Zea mays
  unsure at all n locations
  Clone ID: LIB3076-015-Q1-K1-F6
ctcaccgctgcgttcttccgctcgccccctcacaacgaaacctagagagtcccgcgcgtgacatggcggacggcgcgagctcggcgtctggtctggtggagaagctcgcggagctctcaacgggcggcgccgggcagaatcctccgccggcgggtgaagtccgagaggagttgcagctctcgaagaacgcgaagaagagagaggagaagaggaagaagctggaagaggagcggaggctcaaggaggaagagaagaagaacaaggctgcggctgctgctgctagtggaaagcctcagaaggcatctgctgctgacgatgatggcatggatcccactcaatactacgagaataggctcaagactctngattcactcaaggccgcaggtgtaaacccctatccacataagtttccgggtggcatctctgtagtggaata

SEQ ID NO: 68449 - DNA, 261 bp, Zea mays
  Clone ID: LIB3076-015-Q1-K1-F9
caggcactgcgtccctgctgatttgtggtttgaattgggctcggatctctgttggggaccggtaaatatgacttggatgaaccttgatcttgacacaccgcagttgctatctgatccactgcaatgatcttctcaatcgtcgacagatgaatacttgtgacaaatgagatggatgatcatgcacagggagaccgaatcaatgacaacatgtgcctgtatgagcctctatgtagtgaaacatgccaaggcgcatcgacagtg

SEQ ID NO: 68450 - DNA, 246 bp, Zea mays
  Clone ID: LIB3076-015-Q1-K1-G1
ttcctctccaaaagtcacctatctaatgtttctatctatctctttattacacatttcataaatacctttcttctatcgatagttcattcctatcccttaagcttttctcccattccatattgcacgattatatcattctctcactcattatccacaaaatcctacaatcatgagatattcccatcccatcttatttgtaattacctttatctatcttcatccccactcgatgctatcttatctcct

SEQ ID NO: 68451 - DNA, 446 bp, Zea mays
  Clone ID: LIB3076-015-Q1-K1-G10
ggggtcttcctgagggcgacacacggcagcccaaggctcaccgctgcaacgagggcgccgaggacgtcgtccaggcttgctttgaagggaacccattcaagacagttccaggcccatttaagctcttctggcaatgcatgctctcaaaacctggggaggaaccaaccgagccctatacctacctgcagctagatcctacgagaagggtggaagtgaatctggagcaaacaggaagtgaaccttgaacgagcatgcctagtttaccatctagtgccgatgtgtcttcacctttcgagcagactttttcctcctagggatcacatcatgtgagcacaaagctgcatatgtttggatgtttatataatctacctaataaaccatgatccgtagagctgcctgtccaggctgccaactccttgaaagttgctgatgctggtgtaagaatt

SEQ ID NO: 68452 - DNA, 451 bp, Zea mays
  Clone ID: LIB3076-015-Q1-K1-G11
cccacgcgtccgcgagctctactccatcccctcgatctcgaagcgcagcagcaggagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagctgctgtccggcgtcaccatcgcccacggcggcgtcctccccaacatcaacccggtg

SEQ ID NO: 68453 - DNA, 316 bp, Zea mays
  Clone ID: LIB3076-015-Q1-K1-E3
acgcggacgcgtgggccagtacaggctgtgactatccatacctcacgtgtatgggagactgctgcgaatggcaccttggctctggtcacagactcctcataagacacatctggagactgagatgatggctacaacaacagctaaagactggactcaagtggactagaatacctgctgctgataacgtcccaaagaaaacctggatgagcccactataatcatgactactgctaacactgcagactaatatatccacacagtgctaaagctaatcaagatgtgcatgacgctcgtgatgagcactgaagagtgcatg

SEQ ID NO: 68454 - DNA, 296 bp, Zea mays
  Clone ID: LIB3076-021-Q1-K1-A7
caaacacttgcgccgccactgtctaacgtttcaggccgacatggtctggggttcgggcgtgtgcgcgaagcgcatcgtggtggactcgcgccaccgcatgctgggccggctatcctcgatcatagccaaggagctgctcactgggcacaaagtggtcgtcgcccgctgcgagtgagatctgcatgtcgaccggactagtccgtgacaagatgaagtgcctccgctgtcgcgaaagcggacgaacaccatgccttgccacaggcgcatccacttccgcgccactggcaagatgctgt

SEQ ID NO: 68455 - DNA, 56 bp, Zea mays
  Clone ID: LIB3076-021-Q1-K1-A8
cccacgcgtctgttcaagtgtacgggcactcgtgcgacgattcgtccgcgagcaca

SEQ ID NO: 68456 - DNA, 356 bp, Zea mays
  Clone ID: LIB3076-021-Q1-K1-B1
cggacgcgtgggctcactggcggattagatgttcaaatgttcctaagaaatgtaggaaggggacagcaggatcattctctcttcggcgactcacgtaactgggagggactaataacttgaaatcaccacacatgcgcaactttggatgtccaggtgcttcatcttcgattccccttaccactggcagttctaggggaccaaatcgacgctatgcttcacgctctgtacctggggttgggaatttgctcctaggtcctcaaattgacgaagctgaagctcatgctgtttcactaggtgctggttctgaaatcactgcgttcatgcttgctcctgggactgaattgccttgtacagtg

SEQ ID NO: 68457 - DNA, 152 bp, Zea mays
  Clone ID: LIB3076-021-Q1-K1-B10
gcttatcatggcgatacagacgcgcactgtcttgattcatactagaacgcgacacgttgggagccagatgctgatatacggcccgccccagcctagcacaatcgcaggccctatgacgcaaacgtgcacgatattagcctagagcagaggta

SEQ ID NO: 68458 - DNA, 187 bp, Zea mays
  Clone ID: LIB3076-021-Q1-K1-B3
tcgagtcggactatgcctgcacgcggtcgaagacgtcagacgacagttcgaagtgtccgcccgggcgaatgccgaacaggtggcggcagtagcggttcgcgaacagcagctcggcttcgtcggcggccagggccgacaccgctgcgtgaaggctttttagcacggtcgcgaagcgctcgtgcgctgt

SEQ ID NO: 68459 - DNA, 64 bp, Zea mays
  Clone ID: LIB3076-021-Q1-K1-B6
ctttgatgttctcagaaactcaagttcagatctgatagtgcatggaaaatcatgaaccctgagg

SEQ ID NO: 68460 - DNA, 444 bp, Zea mays
  unsure at all n locations
  Clone ID: LIB3076-021-Q1-K1-B7
ggagtactgtggcactacaagttacttcatcaagctatttctagacaagaaatatgctttgccataccgtgcacttgatgcagtgcttgcccatttcatgcgttttgttgatgatgagaggatcatgcctgttatatggcatcaatcactgcttgcatttgtggaaagatacaagaacgagttagagaaaaaggataaggagaaacttgcacgtttgttggatcaccagaaacactatttagttactccagaaattcgaagggagcttcgagggagctgcaacaggggtgaaaaagatacaaatttgcatactttgtcacctatctncgtcattaccaagcctatcgaggaagacaaatgggacgtaccacaagtgccaatggagcaagattagccagattcttcaacatcgatttttacacttcattttgttttgaagcaaat

SEQ ID NO: 68461 - DNA, 189 bp, Zea mays
  Clone ID: LIB3076-021-Q1-K1-B8
agtcggtgagcgccggcccgcggtcaagatgctgatagggcattatgaagtgtacgacggggcgaatgcggtacatgcggcatggggagagtctctcatacagacgatcagcttatgtggactcgatcaccgataccttcacgcaaacggtgttaagcacggactggaagcactagagcgcggtcggaa

SEQ ID NO: 68462 - DNA, 261 bp, Zea mays
  Clone ID: LIB3076-021-Q1-K1-B9
gcgctctcgtttcggcttccgaccacgctcctttctaaattaccccaaaacctgacgagctggacgaccgggccgtttctccaggccgacggatccgatgcagactactaggcacagacgggtatccaagcgcgatgctgtacttgtgctcagagatcggacaccctacctatggatcctccgtcattgtttgtgtactaagtcagaatgtgtatgatttagcaatggctaatgcaagctcccctgataatatgtcttaca

SEQ ID NO: 68463 - DNA, 132 bp, Zea mays
  Clone ID: LIB3076-021-Q1-K1-C1
acgaagactctggcggcgaggagcgctgtgcggaccacacacgcgcgcagaaacctgcgcagtacgcacctgactccacgacttgttgtgctacttcgctagtttgctcgatcgccgcgcggagcaccggga

SEQ ID NO: 68464 - DNA, 302 bp, Zea mays
  Clone ID: LIB3076-021-Q1-K1-C11
gcgggcttgctcatgtctattacaaccttcattatcggtttactaaaacattgatccatgcatatatggagcctgccaaatcacggacgcggcattatggtgctgtccaagggatatctgcactggggcccaacgcgattagactcctccttttgcccaaccttgtgacatatatgcaacttatggagccagaactgcaacttgagaagcagaataacgagatgaaaaggaaggaagcttggcgtggatatgagtgccatgctgtgtgctgcaagctaatgcttgcatgatctggttgaaac

SEQ ID NO: 68465 - DNA, 434 bp, Zea mays
  Clone ID: LIB3076-021-Q1-K1-C2
ggagtactgtggcactacaagttacttcatcaagctatttctagacaagggatatgcttggccataccgtgcacttgatgcagtgcttgcccatttcatgcgttttgttgatgatgagaggatcatgcctgttatatggcatcaatcactgcttgcatttgtggaaagatacaagaacgagttagagaaaaaggataaggagaaacttgcacgtttgttggatcaccataaacactatttagttactccagaaattcgaagggagcttcgagggagctgcaacaggggtgaaaaagatacaaatttgcatactttgtcacctatctccgtcattaccaagcctatcgaggaagacaaatgggacgtaccacaagtgccaatggagcaagattagcccgatttttcaacattgatttttacactttatttggttt

SEQ ID NO: 68466 - DNA, 434 bp, Zea mays
  unsure at all n locations
  Clone ID: LIB3076-021-Q1-K1-C3
cccacgcgtccgcccacgcgtccgagggttttgctgctctccgaccccgagctccgaaggccgcagcatcaggcgaggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatanggatctgtg

SEQ ID NO: 68467 - DNA, 418 bp, Zea mays
  Clone ID: LIB3076-021-Q1-K1-C4
tctctctctcccctccaccccctctccctgtgataacatttccttttttttaacagaacgtggagacagagtcgaggctgatgaacctatagcgcagattgaaactgataaggtcactatagatgtcgcaagtcctgaggctggtgttattgaaaagctcattgctagtgaaggcgacacagttactccaggcactaaagttgcaatcatatccaagtctgctcaacctgctgaaacacatgttgctccatcagaggaagcaacttcaaaagaatcatctccaccaaaagttgaagataaaccaaaggtagaggaaaaagccccaaaagtagatccttccaagatgcaagcaccaaagccaactgcaccatcaaaaacatgcccttcagaaccacagctccctccaaaagaacgagag

SEQ ID NO: 68468 - DNA, 238 bp, Zea mays
  Clone ID: LIB3076-021-Q1-K1-C6
acgaagactattgcggcgaggagcgctgtcaggagcacacacgcgcgcagaagcttccgcagtacgcacctgggtccacaagttgttgcgctagtgcgctactatgttcgatagcggagcggagcactgcgacatgaaatgggacatgtgatggagatagctggatcaggagctggaagagtggcggttgcaacacttatggcgactgtgcagccaggtccggaggcagtagtggcac

SEQ ID NO: 68469 - DNA, 385 bp, Zea mays
  Clone ID: LIB3076-021-Q1-K1-A6
cccaaatcccttttccactccgccggacgtcgagagaggcggtgggtgcgggacgcgaaggcgaagccctagccccctccctgccgcggacgccgatggacccacctcgcgccgtcgccgttcttctcatactcctgcccgtgctcgccccggtggcctccggtgtacctttcgtcgtcctacacgggattggcgacgagtgcgggaacgatgggctgtcatccttcaccaagatgcttggggagtggtcaggctccaagggttactgcattgaaattggaagaggagcatgggactcttggttaatgccacttcaagagcaggcaaatacggtttgtaagaaggtcaagaaaatgaaagagctcagtgaaggttacaatatagt

SEQ ID NO: 68470 - DNA, 246 bp, Zea mays
  Clone ID: LIB3076-021-Q1-K1-C7
tctatcactagcgttcattctttcctcactttgatcacataaaccttcggggacacaacctggatacagacttgatgctcttgaacccatatctcctatcgaatctgataaagccactatacatgtaactggaccttaagctggagatctctagttgcacatcgctaatcacggctacacaaacgcttcaggctcttgtgctgccatcatattcatcagcggtcaatccgcaggcacacatgtcgg

SEQ ID NO: 68471 - DNA, 430 bp, Zea mays
  unsure at all n locations
  Clone ID: LIB3076-021-Q1-K1-C8
cccacgcgtgcgcccacgcgtccgacggttttgctgctctccgaccccgagctccgaaggccgcagcatcaggcgaggcccccctcgcgtgtgaccgatatggcgctgccgaatcaggggaccgttgattaccccagcttcaagctcgtcatcgtcagcgatggtggaactggtaaaactacatttgtgaagaggcatctcactggagagtttgagaagaaatatgaaccaaccattggtgtggaagttcatgcgttggatgtcaccactaactgtggtaagatcaggttctactgctgggataccgcagggcaagagaagtttggtggcctcanggatggatactatatccatggccagtgtgcgatcatcatgctcgatggaaccttaaggcttacttacaagaatgttcctacgtggcataaggatc

SEQ ID NO: 68472 - DNA, 375 bp, Zea mays
  Clone ID: LIB3076-021-Q1-K1-D1
acgaaaactctcgcggagaggagcgctgtgaggagcacacacgcgcgcagaaacctgcgcgagtacgcacctgactccacgacttgttgtgctagtgcgctagtttgctcgagcgcggcgcggagcacggggacatgaaatggcacgtgcggcggagatcggtggtttcatggctgcgagagtggcggtggcaacgctcatggcgactgtgcagccagctgcggaggcagccgtggcaccggaggctacgacggcggctacgacgcaggcggtggagacgaccgtgaacgaggcgctgaccgaggatctgagccggacgatcaacggcgctgtgcatgctccgatgaatagtaaggctactagtgaagatacttg

SEQ ID NO: 68473 - DNA, 269 bp, Zea mays
  Clone ID: LIB3076-021-Q1-K1-D12
cgagcaagaagccaggaaccagctcaaatttattctttcaagaaccccaccccactccgccgaatagagagaccgtcttggagagccaccaatggcttgttccactgcatctttagcggcaacgctgctggcagtagcgctgatgttgcaggcctgcgtcacagagaggaggaggctcaccgcgctcgtgcaagagccggccataaccatgaagtaccacaagggcgcgctcctgtcgggccccatcgccatcaacttcatcttgtact

SEQ ID NO: 68474 - DNA, 404 bp, Zea mays
  Clone ID: LIB3076-021-Q1-K1-D3
gagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcgtcaagtcgctcgactcctcgctcgccaccgggaacctccagaagatgtccgagaccatggacaatttcgagcgccagttcgtcaacatggaggtccaagccgagttcatggagggcgccat

SEQ ID NO: 68475 - DNA, 187 bp, Zea mays
  Clone ID: LIB3076-021-Q1-K1-D5
cccacgcgtacggccacacaacaacaccctcatgggtcggtatctaaggggggctgacggcgcgttcagacggctattgtcttctactcagtggtcctggaacgttcgctacacttatgagtcacgcaatgctgacttttgccagcttcagcggtcattcaagagtgttggcccctcaacttatttc

SEQ ID NO: 68476 - DNA, 432 bp, Zea mays
  Clone ID: LIB3076-020-Q1-K1-G7
cccacgcgtccgcctcactggcagcctccaggacaacttctttgccagttttgctctgggttggctgatcaccaacggtgctggtcttgcatcttaccccattgatactgtccgcagaaggatgatgatgacttctggtgaggctgtcaagtacaagagctccttggacgcattccagcagatccttaagaaggaaggccccaagtccctgttcaagggtgctggtgctaacattcttcgtgccattgctggcgctggtgtgctttctggctacgaccagctccagatcctcttcttcggaaagaagtacggctccggcggtgcttaaatggagaaaaatgatgacgaacaagagcagttcgctcccggtccagcccagtcaggatctggtcaagtttttgcctttcatatcgaagaaattaataatttatg

SEQ ID NO: 68477 - DNA, 445 bp, Zea mays
  Clone ID: LIB3076-020-Q1-K1-G8
catgagccaagtgcagaacgcttccaccagttcggatgctaagccagcgacaggcagggggagtatgatacagatacacgcactgagacccgcggaagaagacagcactaccgaatgcgacagtggtctcgacaacgccagcactagcagcttcgagttccacggagtggagaaggcggcggcgacgcagaatccagcagccgggtacttgtccaggcagacttgcatttcctacaagtggaatgacgcatagaaatggatcgtgagccgccagaatgtcagtcagaagaacaacgtcgccaagggcgcgttgcagaaccagacagtaaaccagatgagctccgccgcagccaggggcgccgttgtgcccaaaatctctgctcgtcccgtgcagaaaatgaagagagtgaatccagctttgtctgctccgcgcagcatactggag

SEQ ID NO: 68478 - DNA, 386 bp, Zea mays
  Clone ID: LIB3076-020-Q1-K1-H11
gggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaagtgcagcagatggggaagcagggcctggagctcctgagctcggcccccgcgcggaagctcggtagcagctgtgacgacta

SEQ ID NO: 68479 - DNA, 360 bp, Zea mays
  Clone ID: LIB3076-020-Q1-K1-H12
ggcagctggactcgtttcgtaaatgattgtggtaccgagcttatccgtctccagataagagagcacagggcgaagaatagcatggccgtcgttcgagaattggttggagtattgaagtcaacaaaaaagcaaattcaacttgcagaattcaaggaaaacaagtggaccctaaaagactccaacttgccaataagtcatggcactgatggcagtctactcgatctcaaaggtgacaaccatctgatcaagctttatcggggaaggaaactggaatacgagcgcaaatgttgcagcgctcactctgaggacgtatcagctgttactgctgtaaagttctgtgctgaacatccatatggcaaa

SEQ ID NO: 68480 - DNA, 409 bp, Zea mays
  Clone ID: LIB3076-020-Q1-K1-H3
ctccgccggccgccggcagccgcccgcgatgtcgaaggccgcggcagcgtccctcccggcggcgccgccagaggtggcgcaccttgtggagcagctccagcgccaccacctcgccccggacgcgtccctcctctccagctccgcgcactccgacctcctccaggcgcgcgaggaggtcgcggcggagcgcgcgctgtacctcgaggcactggcggtgtacgcggaggcggtggccatggtggaggagtaccatgcggctgccggcgccggcaagaagctcaactgctccccgcaggtgtacgagtctttggagcaccggttggccgtggcagaggcagcgcaaaggctgaggctcccactgctctctcaggacagggaggtccatgagcacgagatcgaaaagctgagc

SEQ ID NO: 68481 - DNA, 431 bp, Zea mays
  Clone ID: LIB3076-020-Q1-K1-H4
ctccgccggccgccggcagccgcccgcgatgtctaaggccgcggcagcgtcccttccgccgtcgtcgtcagaggtggcgcacggtgtggagcagctccagcgccaccacctcgccccggacgcgtccctcctctccagctccgcgcactccgacctcctccaggcgcgcgaggaggtcgcggcggagcgcgcgctgtacctcgaggcactggcggtgtacgcggaggcggtggccatggtggaggagtaccatgcggctgccggcgccggcaagaagctcaactgctccccgcaggtgtacgagactttggagcaccggatgaccgtggccataagcagcgcacaagctgaggctcccactgctctctcaggactgggaggttcatgagcacgaaatcgaaaagcttgacccctatatcatgagttcattc

SEQ ID NO: 68482 - DNA, 267 bp, Zea mays
  Clone ID: LIB3076-020-Q1-K1-H5
ctcggccggccgccggcagccgcccgctttgtcaaaggccgcggcagcgtccctccgtcgttcgtcttcagaggtggcgcggccttgagagcatctccagcgccaccatctcgccccggacgcgtccctcctctacatctccgcacactcagaccttctccatgcgcgcgaggaggtcgcggcagagcgcgctctgcacctagaggcactggcggtgtacgcaaaggctgtggacatggtggaggaacaccatgcggttgccggccc

SEQ ID NO: 68483 - DNA, 420 bp, Zea mays
  Clone ID: LIB3076-020-Q1-K1-H7
cctcaaggagggaatgggaggtggtggagggatgcacgatccctttgacatattccagtgattctttggtggtggaagcccttttggaggtggtggcagcagtaggggcagaaggcagcgaaggggagaggatgtggttcatcctctgaaggtttctctggaggatttgtacaatggcacatcgaagaagctctctctgtcccgcagtgttctctgctccaagtgcaatggtaagggttcaaagtctggagcttcatcgaggtgtgctggttgccaaggttctggctttaaggtccaaatccggcagttggggcctggaatgatccagcaaatgcagcatccttgcaacgagtgcaagggttctggagagacaatcagcgacaaggatagatgcccacagtgcaagggtgataaagttgt

SEQ ID NO: 68484 - DNA, 446 bp, Zea mays
  Clone ID: LIB3076-020-Q1-K1-H8
cccactcgtccgagatgcttatgcagagctacagtcccgtaccacctgaacttgcaaggcgatgaggcatcaaaatttaagccaggctcaattcctgatagacctccaaggcgaaatgatacagtctttgcaaatcattgaagtaatctacctgagaagagactgaagatctttgaactattatgagctcaacttctacccgatggagggacctagtttagtatttatgagagggcatatattgtatcagatcttcattatggagattgatcaattgtggttcacatttcattgatctgaagaggtgctgttaatttcttatcattgccttttgtgttcccgttatgtggtttaatgtttgattttatagttccatcttgcttgtgttcagaataatatggtttaatggttaaccaatatgcattaaacttctgactagcttatgt

SEQ ID NO: 68485 - DNA, 418 bp, Zea mays
  Clone ID: LIB3076-020-Q1-K1-H9
ctcgaattcgaattgcagccggtgccaccttcctcacatggcggcggcggaagagatgatggcggtgctggacaaggagacgctggcgctgatgggtctgggcaacgccgccgccgcggtggttgccgagtgcgagaagttcaaggagaacgcgaggccgctcaagcgcgggcgcgacgtgtccaaactcaaccacgcgctcaaggcacacgccgatcccgcccagcgcgccactcttctcgaagcccgaaagaagatgattgaggcaatctacgagtaccaaggcgaggatccgcttcaaccgtggctggactgcatcaagtgggtgcaggagtattttccgaccggcggcgagtgctcagggttggtggtgttgtacgagcagtgcgtgcggaccttattggacgacgagcgcttc

SEQ ID NO: 68486 - DNA, 246 bp, Zea mays
  Clone ID: LIB3076-021-Q1-K1-A1
gtcaatcgcatcctccatgtcaaccgctggccgcaaccagtggctgcacaggctcgagggccacatgtccgctgtgaaggcactcgcgtggtgtccttttcagagcaactagctggcaactggtggtggctatactcatcgatgcatcaagatctgcaacacactcactggagcatgcctgtactatgattacactggatcacaggttcgatcctttatactgtacacacatgatagagagctttt

SEQ ID NO: 68487 - DNA, 442 bp, Zea mays
  Clone ID: LIB3076-021-Q1-K1-A10
cggacgcgtgggcggacgcgtggggtgaatagtgagatgcagagaggacgccaaattacggcgcttgctaatgatctcagcacactggagaggacactagggcagtctgggctgaaggagcgggagatgctggcattatcgcacaagcaaaggcagctcaagggtcagctgcgagcattgtgtggctatgactcattgaatgatgtgttggattatggggataagctgcttttggcaccaccgctgatgcatggggagtggctcccacggacggcggtgtttgtgctcgtagatctcatggttgttatggtaggtcgcccgaaagggatatttaaggagtgcgggaagagaaataattcaagactccggctcatccatgatgaacttgtgaagcttggcattggggatggtgtgatggaggcagatttggaacacttaacaa

SEQ ID NO: 68488 - DNA, 228 bp, Zea mays
  Clone ID: LIB3076-021-Q1-K1-A11
gcgtgtacgcgtgggcggacgcgtggggagattagcgatttgcatagaggacgccaaattagggcgcttgctaatgatctcagcacactggataggacactagggcagactgggctgaaggagcgggagatgctggcattatcgcacaagctaaggcatttcaagggttaactgcgagcattgtgtggctattgactcattatatgatgtgttaggtttatggggata

SEQ ID NO: 68489 - DNA, 398 bp, Zea mays
  unsure at all n locations
  Clone ID: LIB3076-021-Q1-K1-A12
attgaggggaaatgcaatgtccacagcttccgtagctatacaaagcttgattctgtcaatgctgaggatttcttctgccgcttcgagtataaatcagctactggcagctttgtaccagatcgtatagcagtgttttgcaagtgcgagatgccatacaatccagatgaccttatgatccaatgcgaagaatgttctgactggtttcaccctgcttgcattgggatgacaatcaaagaagcaaagaaactcgagcattttttctgccagacctgtacagctganaatggtaagatggttgagaattcacatgaagctacagcgcaatcagaagaaaagctggtggagtcaaaaaagcggcgaaagtgatggccgtgctgattaaatttatgaaatctatg

SEQ ID NO: 68490 - DNA, 376 bp, Zea mays
  Clone ID: LIB3076-021-Q1-K1-A3
cccacgcgtccgtccacgcgtgcggccacgcgtgcgaccacgcgtccgggagcacatttgtaagttccatcaaacccgaggagtcacggacatacagcaggccgcagtccacgtctgagtacgaatggctaatgtgatgtgttgatcaactacagcaaaatggctgagacccacactgaatggatgagattattggtattgtttggctgggtaatctcagatgtggttagttgatggatgcctttttggagtactccttttgtttcctttctagttaagcaggcaggtagcactactcgtatccagagtttcacggagcggatgcggagggggcatattttgggcagcagacctcagttctgacatggaatgatgc

SEQ ID NO: 68491 - DNA, 252 bp, Zea mays
  Clone ID: LIB3076-021-Q1-K1-A4
gaaatgtcatgtctgcgttcaaatatcagtctacgtgcggaacgacgggggcaatagctggaggattcactccaccatcagtgcaccacgccaccatccctgcctcaatcaacgtctcatcattacggacgcctataaatgcctaggtgcgtgcgggcactaccactaccatacagggcatgactctcaacccggacaaggataggctacatacggtaacgatggcgcctgtggacatgatgagcatgtgcg

SEQ ID NO: 68492 - DNA, 437 bp, Zea mays
  Clone ID: LIB3076-020-Q1-K1-G6
ccaaaccagacaagcaaggaatcccccgatggctcatcgcgttctcctcctcctctctgtcgcgtcggccgccgcggttgccgccgccgtcgacgcggaggacccgctgatccggcaggtggttcccggtggagatgacaacgatctggagctgaacgcggagtcccacttcctgagcttcgtgcagcggttcggcaagtcctacaaggacgccgacgagcacgcgtaccggctgtccgttttcaaggccaacctgcgccgcgcgcgccggcaccagctgctggacccgtcggcggagcacggcgtcactaagttctccgacctcacgccggcagagttccgccggacctacctcggccttcgcaagtcccggcgcgctctcctcagagaactcggggagtcggcgcacgaggcgcccgtgctccccaccgatggtc

SEQ ID NO: 68493 - DNA, 310 bp, Zea mays
  Clone ID: LIB3076-020-Q1-K1-F2
gacgcacgcgtccgccggggcttccgtctcctcccatccgctatcttttcacgaactctacataccgtctagcagccggattttaaacagtcttgggaaccataaatcgctactcaagcccctcctgtccagaatggtgatgctcaggcccaggccttgaacgtggcccctgctgacaagtctgggccatgccctcagaaaaccatacatattcgtacatctgtaacattccaccagcccaagaccctgaataaggccatctacccgaagtacccaagaatcagcactactgcaagaatcaagcttgatc

SEQ ID NO: 68494 - DNA, 398 bp, Zea mays
  Clone ID: LIB3076-020-Q1-K1-F3
atcggcctcaactccgacctgaaagtgcccaagtttgagttcctgtcgaacgcgaagccgtggctgttcgattaccccaagccagtgacccagcagaccacagccacgtcagtcaaggtgccggcggccatcctgtcgacctatgccaagtccaaatccagggcaaggaaggacgcagagagcaaggccaaggcgaaagcagaggactcttccagtgcttctacttcgatgcaggtggacggcgcttctgctgctggtgctgctgcagagaaggccccggagccagagcctacgttccagatcctgacgaacccggcccgggtcgttccagcccaggagaagttcataaagttcctggaagacagcaggtacaagccggtgaaggctgccccctcggg

SEQ ID NO: 68495 - DNA, 444 bp, Zea mays
  Clone ID: LIB3076-020-Q1-K1-F4
gaactgcttcagcctcaatatcttaaatgtgtcatacaataatttggctggtgctgtccgtactgacaacaacttcacacggttttcacatgacagctttttaggtaatcctggactctgtggatattggcttggttcttcatgtcgttccactggccaccgagacaaaccgccaatctcaaaggctgccataattggtgttgctgtgggtggacttgttatcctcctgatgatcttagtagctgtatgcaggccacaccattcacctgcttttaaagatgccactgtaagcaagccagtgagcaatggtccacccaagctggtgatccttcatatgaacatggctcttcatgtctttgatgatataatgaggatgactgagaacttgagtgagaaatacatcattggatacggggcatcaagtacaagttataaatgtgttct

SEQ ID NO: 68496 - DNA, 412 bp, Zea mays
  Clone ID: LIB3076-020-Q1-K1-F5
gaactgcttgagcctgaatatctcaaatgtgtcatacaataatttggctggtgctgtgcgtactgacaacaacttcacacggatttcacatgacaactttttaggcaatcctggactctgtggatatcggcttggttctacatgcgattccactgaccatcgatacataccgtccatctaaaaggctgacataattggtatcactgtgcgtgaacttgttatgctcctgatgatcttagtagctgtctgcttgtcacacaattcacctgttgataaagatgacactgtgagcaagccagtgatcaacggtccatgcaagctcgtgatccttcatatgaacatggctcttcatgtcttcgacgatataatgaggatgactgagaacttcagtgagaaatgcatcattggatac

SEQ ID NO: 68497 - DNA, 404 bp, Zea mays
  Clone ID: LIB3076-020-Q1-K1-F6
gaagtgcttgcgcctgaatatcgcacatgtttaatccaataacttggctggtgctgggggtactgacaacagcttaagacggatttcacatgacaacttcataggccatcgtggactctgcggatatcggctcggctctacatgcgagtccactgagaatcgctacataccgtccatctaaaacgctgacataattgtcatcactgtgcgtgaaatggtgatgctcctgatgatcttagtctctgtctgcttgtcagacaactcactggttgacaatgacgacagtgtgaacaacccagagatcaacggtccatgcatgatcgtgatccttcatatgaacatggctcttcacgacttcgacgatataatgaggacgactgagaacttcagtgagaaatgcatca

SEQ ID NO: 68498 - DNA, 373 bp, Zea mays
  Clone ID: LIB3076-020-Q1-K1-F7
gaaggtcaagtccctacgagaccaacaattatttgtacgtccacaaaaatattctgcagagaatttgagaacaaagattcaagatgtccatgccattctctgccaacgggtggcaatggcgaaagacaacgtccacatgttgtaagctatatgtaattgtaacttaggtacaaagagtcgtccctgtgccgtgctgtcagggaaaatagtctggtggttgcgctgttttactctacaagatgtcttatatgatgtacaagatacagacacttctgggtgtagtgaccttgttcccacctcaccttttaaagtttgtggcgctgagtcaatatggatgtaagtcaattgattgaagaaacattttcgactatgc

SEQ ID NO: 68499 - DNA, 386 bp, Zea mays
  Clone ID: LIB3076-020-Q1-K1-F8
gaaggtcatgaccctacatgtccaacatttttcagaccgtactcagactgattctgggggtactttcaaaacctacacggggatgtcacatgccattctctgtacgcgagttgtcaattccgaaagacaacgttcacatgtacatagctatacgctgttcgcacttacgtacccacagtctaaaatgttccctgctgtcagggaaaagagtgtggtcgttgcactgttctactgttcaagatgtctgatatcatgtacaagatacagacacttctgagtgtagcgaccttgttcccacctgagctcttaaagctagacacgctgagtaactatggatggaactcaattgattgaatactcatttatgactatgcgaagactgaaaa

SEQ ID NO: 68500 - DNA, 336 bp, Zea mays
  Clone ID: LIB3076-020-Q1-K1-G1
cacaaccatcatctgctgtctctaagcatgttttcacaccactcgccctactccctcgaggcgggctctatcccgcgctaggaccgcgccatgaccgttctattccccgaccgtcacctgttccaggtccagtacgctcgtccaggacgcccacaaggctcaacgctcgtcgcgcgcatacgcggcacggacaccgaccaactcggagtactgaacaagtgcacacacaagctccaggaatacatgttcgtgcgcaagatcgactgcctagacactcacatagctctggtacgcgcacagccgaaagcggacgcgcgcgtgctcattaaccgcgcg

SEQ ID NO: 68501 - DNA, 383 bp, Zea mays
  Clone ID: LIB3076-020-Q1-K1-G10
cgcgtccggggggctctcattgcgtacgctaagcggttcatccccgggctgtcgcgcaccggccggcgggtctggggcggctgcggcactgccgctgcgccgtcttcgtgcgatgtggaggagcagaaggcgcttctcgagaccgtcattgccaaccttccagaggaaaccatcaagagcaccgtccacaccggcacggtcgtgggcgccaccacggcgcgcgtcctcttcggtctcctgcgtactgcgagcatcctgcatgcgtcggacgcgtcacgggacatgcttgagcggagcatcgccgtgcggatgcccgacgcggtcgtcgatgacctgctcatcccgagctactcgtaccttgtggagacgctctacgacgtgga

SEQ ID NO: 68502 - DNA, 385 bp, Zea mays
  unsure at all n locations
  Clone ID: LIB3076-020-Q1-K1-G11
cggacgcgtgggtttcgagatctccgggtggagcaagcgagcaaaggcagcagccatgtcgctccgcgtgctgaaccctaacgccgaggtgctcaacaagtcggcagcgctgcacatgaacatcaacgccgccaagggcctccaggacgtgctcaagaccaacctcggccccaagggcaccatcaagatgcttgtgggtggagctggtgacctgaagctgacgaaggatgggaacaccctcttgaaggaaatgcaaattcagaacccaactgcaatcatgattgcgaggaccgctgtggcacaggatgacacaagtggtgatggcacaacctncacttgtgctattatcggggagctaatgaagcagtctgagcggtgcatcgat

SEQ ID NO: 68503 - DNA, 371 bp, Zea mays
  Clone ID: LIB3076-020-Q1-K1-G12
ggaacgaccgcactcgagcactcatgcgcccacgcctacagaacaagggtctgaagctttaacagcacctcaagaacagtgtatctcgcagcattccacacttggctaccagcgcctgtccatgtcttcacgaggctgaagcacacttttcccgattcatacagattaggattcaagcggagaccaccagaatgatagcgaacagaaggtggttcatgggggtaatcatgacgaaagaaaatatcgaagaaaaaacgattgtcatggtaaggtgttccatgtgccccaacgatgcaagcccttagaagatccatgctttcctcataaactctcacatgaataccatctggtacgtcattttgcaagatgtt

SEQ ID NO: 68504 - DNA, 417 bp, Zea mays
  Clone ID: LIB3076-020-Q1-K1-G2
ctcccaacaccacctcgcctgcgatctccgtagcctccgtcgcgtcgagcatcgatcatgtcggcctactgcggaaagtacaaggatgagctcatcaagaatgctgcctacattggcacccctggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaagagggaggcgtcctccctggcatcaaagttgacaagggcaccattgaggttgttggcactgataaggagaccaccacc

SEQ ID NO: 68505 - DNA, 422 bp, Zea mays
  Clone ID: LIB3076-020-Q1-K1-G3
cggacgcgtgggcggacgcgtgggcggacgcgtgggttccccgcgtcaatcctgccgcctgctgctcgcgcgcttactgtagccgcagctttctccacccttggcgatggaggccgcgatcgctcacgctccatctgctccggtcctgcgccgctcgcgcagcctcaaccccacgcccgccgtccggccgcacccaaaatcctggcagggggtgctttcggcgaggcacccgtcgaacgccgtcaggtgcgagccgtcccagcgcccagaggcgcgcccgcgcctgcgcgcggcgcagccggctggcgctgacgcggcggccgggaggaagcggctggcggtgttcgtgtccggagggggatcaaacttgcgggcgatccatgaggccgcgctgggcggcgccgtgcacggagatgtcgtcg

SEQ ID NO: 68506 - DNA, 440 bp, Zea mays
  Clone ID: LIB3076-020-Q1-K1-G4
cggacgcgtgggttttcattccaggcgtcgaaaagagggagggagagagagagagagagagagaggagttgcaagttggtgagatggatctgttggagcggaatattaagacggagacgcgcaaggaacaggatcgtaaggaggaggtggaggcgtaggcggaggagaggaagacccaggagccgccgtagcaaggccagggcctcagactgtcactcgccaacggcagtggcaggtctggaatgttgccgatgtcaaacatgtcagctaatccttcacagcttacaattttctatggcggatcagtatgtgtgtatgactcagtgccaccggaaaaggctcaagcaatcatgcttatagctgcagctgcagcggcagcggcagctaccaaaagcagtgctgtccctactgttaagcctacaatggtgcctgcagtcact

SEQ ID NO: 68507 - DNA, 415 bp, Zea mays
  Clone ID: LIB3076-020-Q1-K1-G5
cggacgcgtgggttttcattgcaggcgtctaaaagagggagggagagagagagagagagggagaggtgttgcaagttggtgagatggatctgttggagcggtgtattatgactgagacgcgcatggaacaggatcgtaaggaggaggtggaggcgtaggcggattagaggaagacccaggagcctccgcatcaaggacatggcctcaaactgtcactcgctaacggcactggctatgtctggaatgttgccgatgtcaaacatgtcagctaatgcttcacagcttacaattttctatggcggatcagtatgtgtgtatgactcagtgccaacggaaaaggctcaagcaatgatgcttatagctgcaactgcaacggcagcggcagttaccaaaatcagtgctgtccctactgtta

SEQ ID NO: 68508 - DNA, 392 bp, Zea mays
  Clone ID: LIB3076-020-Q1-K1-F12
ggtttggtcatgtctatcacattcttcaatatcggttaactaaaacattgatggatgcagttcttgatcctgccaaatcactgacacaacattatggtgctgtccaagggatatctgcactggggcccagcgcgattagactcctccttttgcccaaccttgtgacatatatgcaacttctggagccggaactgcagcttgagaagcagaaaaacgagatgaaaaggaaggaagcttggcgtgtttatggtgccttgctgtgtgctgcaagcaaatgcttgtatgatcggttgaaactatttcctggtttgctttctccgtcgatgcggcctcttttacagagcaacaaaagggtcttaaccaacaacccaaataagcgaaaatctagcaca

SEQ ID NO: 68509 - DNA, 438 bp, Zea mays
  unsure at all n locations
  Clone ID: LIB3076-020-Q1-K1-C8
cttgacagtaacatgtccagttgagtttttagtgaaagcgacatttttttggtattggggggttatggatttgtaatgctattgagtcttaaatctctgcagtcatggacgattttctttgctcatcctgtgataattttgcaacccattctgcatgcttatatgcagggtacagtcgatgactcagttctctgaaagcagtgatgtttacagctttggagtttttcttttggagcttattactggcagggaagcagcttccttgatacctacagagtccagagaatatttggcacactgggtaatttctactgacatgtagctgtaagttatctagaaaggaaagttatggagttctgcttaatctccagcaaaatatcattctggtgtttagtgtacctaactgtgaaatcaggccacacatttncaaaacttgaa

SEQ ID NO: 68510 - DNA, 218 bp, Zea mays
  Clone ID: LIB3076-020-Q1-K1-C9
cctcaacataagcacccaagaaatttgctattgcataatgccctgtctaaaccggcgaataaaaccagaaagctgtatttactgtcgattctgccttgtatgagtacctatattggggcttgaaagaaagatgaaaacgtgaactgaatcttaacgtccctgtatcctcctccttctgctatagagcccatctcgtcatgctgtcaaagggcaactac

SEQ ID NO: 68511 - DNA, 383 bp, Zea mays
  Clone ID: LIB3076-020-Q1-K1-D1
gcctgcgtgcccggtgcccgtgcggccgttactaacgacactgactagcaaagcaaagccgacggttccgagcgagacgacgagaccgcgattgctagctagctagttcgggcagcgagcggggtgagacggctatggcgtgctgctccgccgtcctgcaccatccgctgggcttctcactcaccccgtgctccgcctcccgagccccaccgcgcatccagcgcgtgggcgtggcaactccctcggtcgtcttcgcccgccctctttctcgcgccaggatctcaccgcgctgcacctactccggtggcgccagcgctgcccctggtcctggggagctacccgtggcggcgctccgacgggtccttgaaatgccgggtgcgcac

SEQ ID NO: 68512 - DNA, 365 bp, Zea mays
  Clone ID: LIB3076-020-Q1-K1-D11
cccacgcgtccgcgccgtcgcctccgcctccgctgccgccgcgcaggtcagggtcatgtggatcttcgagtacaacgggagcgccgtggtggcgatggtggggaagaactgcttcgcgatcgccagcgaccgccgcctcggcgtgcagctgcagacgatcgccaccgacttccgacgggtgttcaaggtccacgacaagctctacatcgggctctcggggctcgccaccgacgcccagacgctgtatcagcggctggtgttcaggcacaagttgtaccagctgatggaggagagggacatgaagcccgaaacctttgccagcctttgtttagcccttctctatgagaaaaggtttggaccatact

SEQ ID NO: 68513 - DNA, 187 bp, Zea mays
  Clone ID: LIB3076-020-Q1-K1-D3
gcgtacgaccgggcgttccagacccactcctgggattttttgcaaatctccatagagaacattcactgcaagatttaatagctgatgcgcgcaacctacatcacttatggcacccagatggaccagactattactatcaaactaaacgcgcctgcgagcacgccagatggacgactagaacatgctc

SEQ ID NO: 68514 - DNA, 426 bp, Zea mays
  Clone ID: LIB3076-020-Q1-K1-D4
gcgaggtggcgcggcggctccggaagcgggcggcggctacggggaagcgcctcagcttcatgaacgagtacctccccgaggagcgcgacccggtgaggtgttggctcaccgtcgccgcagtcgcattcgtctcgctcctagttttaggttttgggagtggcaatgaaactccagtagagcttccaaagaaacttatcatcggccccccaagtgctgatagaatccaacttcctgatggacggcatctggcttatcaagaacaaggagtttcagctaacagagcaagattttcactgatttatcctcattcttttctttcatcaaggctagcaggaatccctggaattagtgcatctcttttggaagaatttggagtacgacttgtgacttatgatcttcctggttttggtgagagccatccacacg

SEQ ID NO: 68515 - DNA, 413 bp, Zea mays
  Clone ID: LIB3076-020-Q1-K1-D5
gcgaggtggcgcggcggctccggaagcgttcggcggctacggggaagcgcctcagcttgatgaacgagtacctccccgaggagcgcgacccggtgaggtgttggctcaccgtcgccgcagtcgcattcgtctcgctcctagttttaggttttgggagtggcaatgaaactccagtagagcttccaaagaaacttatcatcggccccccaagtgctgatagaatccaacttcctgatggacggcatctggcttatcaagaacaaggagtttcagctaacagagcaagattttcactgatttatcctcattcttttctttcatcaaggctagcaggaatccctggaattagtgcatctcttttggaagaatttggagtacgacttgggacttatgatcttcctggttttggtgag

SEQ ID NO: 68516 - DNA, 306 bp, Zea mays
  Clone ID: LIB3076-020-Q1-K1-D6
accaggcgtcaccgcgtatgtataacttttcggccgcttctgtcaagctcttaatggcggtgatctagcacctgccagtggaccgagacccgttcagatcttgcctcaccggctcgctctagctatactgacccttgctaatatcaggttctggaagtggcattaaatcaccattgaaaatggcctaaacagacgattcagcactgcatggactgactctatacttatgcatcttcaactagcatacgtcttactaaaattctctcttgtgaccaacactcactaatactgaatcactcttcttca

SEQ ID NO: 68517 - DNA, 440 bp, Zea mays
  Clone ID: LIB3076-020-Q1-K1-D7
attagagttctttttgccactcgattgtattgacgaagatgaccaaaatgccttactggggtctatattaactctgatgaagcggtgtcttcgtagcctaaagctagttgatgacaatgatttgagtggggtttctcttcaccttagtaatgtgctaaaacttgagaatgaagaatccaaaacagatgcacagtttgatggttcccttcgcgaatcacctgaggatgatagacatggaggatcccacaagtttgataatgagaaccagaaagttttggatatcacagagggacaattgttgactgatgactactctcaagacaatggtacttctgttggcagaccaaatggtagtggtgcttctgattcttcattgcttcacaaaaccaacaaaccccctgaaagaagacgtgggaaagctgaaaagactatcagtttag

SEQ ID NO: 68518 - DNA, 310 bp, Zea mays
  Clone ID: LIB3076-020-Q1-K1-D8
aggggacttctcggtgtctctcgaacgtttcgacgactacgaccaacctgccttacttgatgttttattaactctcagggggccgtgacttcttaacctaatgctcgatgatcacaatgatttgattctggtctctcttaaccttagtcatgagctaaaacttgagattgactaattccatacagatacacattttgatagcacccttcgtgaatcacctgaggatgatctacatggacgatcccacatgttttataatgacaaccatatagtattcgatatcacagagggacacttctagactgatgac

SEQ ID NO: 68519 - DNA, 381 bp, Zea mays
  Clone ID: LIB3076-020-Q1-K1-E10
gtatagaggctgctcaaggtggtttgttcctggaagagatgcaacgaaaatggaatgacggtaacaaggcattgaaaatgattagagacatcctgatgtatatggacaggacatatattcccactaataaaaaggcacctgtctttgatcatgggatagagctttggagggataccatagttcggtctcctacgattcaggggaggttgtctgacatgctcgtcgaactcatacatatagaaaggaccggtgatgtgataaacagaggcttgatgaggactacaactaaaatgttgatggatctaaggctgtctggttaccaagacgattttgaaaggccatttcttgaagtctctgctagtttctatagtggggagtcac

SEQ ID NO: 68520 - DNA, 435 bp, Zea mays
  Clone ID: LIB3076-020-Q1-K1-E4
ctgataaggaagagctttacctcaatttggtgcttgaatatgtgccagaaactgttcaccgtgttattaaacattacaataagatgaaccaacggatgccattgatttatgttaaactttatatgtatcagatttgtagagctttggcttaccttcacaactgcgtaggagtgtgccacagagatataaagccacaaaatattctggtgaacccacatacccatcagctgaagttgtgtgacttcggcagtgccaaagtcttggtacaaggggaaccaaatatttcatatatttgttctagatactacagagccccagagctcatatttggggctactgagtatacaacagctattgacgtgtggtctgctggttgtgtacttgctgagcttcttctaggtcagccttgttttcctggggacagtggtgtcgatc

SEQ ID NO: 68521 - DNA, 388 bp, Zea mays
  Clone ID: LIB3076-020-Q1-K1-E5
gatgtgcatgctcctgagtgtggcacttgacgactccaacatcatgcctggtgctgggcggattaccaacagcttcagacggctgacacatgataagttcatgggcgaaggtcgactcttgggggaactggtcgtgtctacatgcgagcttgttgagaggcgccacatacggtccatctaaagcgctagcataacggtgagcattgtgtgtcaagtgccgatgttcgtgctgatcgcagtctctgacttcttgtgagacatcgcacagctggagaacgactacagtgtggccaacgccgagatcaacaggatatgcaaggtcgtgatccttcagtcgatcatggttgggtacgacgttaactatataatgaggacgattgagaacttc

SEQ ID NO: 68522 - DNA, 381 bp, Zea mays
  Clone ID: LIB3076-020-Q1-K1-E6
ggtgttcatgctcctgtgggtggcgctgcacgacgccaacatcatcccggctgcccggcggatgacggagcgccccggagggctgacacatgtgcagcgcatgggcgtagggcggctcctggtggtactggccgtgacgacagtcgagcttgtcgagaggcgcctgatacgctccatccacagcggtagctgcccgatgagcatcgtgtggcaagtgccgaagttcgtgctgatggcaggctccgacttcttctgcgacatcgcgcagctggagtccttctacagcgaggcccgcgccgagatgcgcagcatgtgctcggccgtgtacttgctggcgctgccgctggggttctacgtcaactagctggtggtgacgcttgt

SEQ ID NO: 68523 - DNA, 400 bp, Zea mays
  Clone ID: LIB3076-020-Q1-K1-E7
catgagacaacatacaattcaatcatgaattgtgacgtggatatcaggaaggacctggggggtaacattgtgctcagtggtggttccactatgttcccgggtatcgctgatcgtatgagcaaggagatcacttcccttgcaccaagcagcatgaagatcaaggtcgttgcaccgcctgagaggaagtacagtgtctggatacgagggtcgatcctagcctcgctcagcactttccaacagatgtggatatcgaaggaggagtacgacgagtctggcccggcaattgttcaccggaagtgcttatagggtttcacacgttcctcgtcgctacctagtctcaaattatgtcccctacatttctcgagatatgtgtggcacatttgcatgatacgtctgattg

SEQ ID NO: 68524 - DNA, 444 bp, Zea mays
  Clone ID: LIB3076-020-Q1-K1-E8
ctcggcgtcttcacaaacgccggcgcaatctctcgcccgagcccgacagatcttcagggggccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgtcagctcttccaccctgagcagctcatcagtggcaaggaagatgcc

SEQ ID NO: 68525 - DNA, 374 bp, Zea mays
  Clone ID: LIB3076-020-Q1-K1-F11
cagagacatcagagagcgggccttcttgtttgtctgagctgaagaggaggagggggagggggagaagcagcggcggagccggaggagggagagcgaagatgcgccgcgtcgcgctgttgctcgtcgccgccgtgtgcgcgctggcggcgccggctgccgcggtcgtcactgacggtcttctcccgaacggcaacttcgaggatggcccgcccaagtcggcgctggtgaacggcacggtggtgtcgggcgcccacgccatcccgcggtgggagacgtccggcttcgtggagtacatcgagtcggggcacaagcaaggggacatgctgctggtggtgccgcaaggcgcgcacgcggtgcggctgggcaacgaggcg

SEQ ID NO: 68526 - DNA, 413 bp, Zea mays
  Clone ID: LIB3076-020-Q1-K1-C7
tttgctttttttttctccctcagaccagttggagaaagacgcgatccaacaaatttgggggcttgtatgcctgccaattctgaacacgtaccaactcaacccttgttcatcgatcttgcagcactgcaggatgtacagggctaagagagctgcttcgctcagggcgaagcgccggcgccttggcaagtacgagctcggacgcaccatcggggaagggacatttgccaaggtccggatcgccaagaacatggacactggggatcatgttgccatcaagatcctcgacaaggccaaggttcacaagaacaaactagttgagcagattaggagggaaatctgtacgatgaagctaatacagcatcccaatgttgttcgcctgtacgaggtgatgggaagtaaagcaaggatttaca

SEQ ID NO: 68527 - DNA, 291 bp, Zea mays
  Clone ID: LIB3076-020-Q1-K1-B1
tccgagggatcactcttcgtactctgacatgtttgaagaggcgatcgttgccctaaagcagatgatttcttcaagctgcgggggcatcatcaagtacgtcgatggcaaccatgacacgtagctacccaccaaattacttaagcacctcactgcgcaccttaagaagctagatgacgccctcaaactgactaaggtgaagaactccttaaagctgccggtcaccgacgccaatcccaaagccgacaagtccaaggcacccaaggtcgcgcccaatcccaatccctcttcgaa

SEQ ID NO: 68528 - DNA, 363 bp, Zea mays
  Clone ID: LIB3076-020-Q1-K1-B10
ggtggcgcggcgatggtccttactaacggggaggccaacggcgagggactggttggagacgctcacgtgctccctgcttgcgcggtgggcgagaaggagggcgacgcggtcaaagcgtatgccgcgaacgcctccagcccgatggcgacaatcagcttcgggggcacggtcgtcggcgtcaagccggcacccgtggtggcctccttctcggcgcgtggacccaacgggctcgtcccggagattctcaagccggacttcatcgcaccgggcgtcaacatcctcgccgcgtggacgggcgccacgggtccgaccggcctggagggcgatacccgccgcacggagttcaacatcctgtccgggacg

SEQ ID NO: 68529 - DNA, 357 bp, Zea mays
  Clone ID: LIB3076-020-Q1-K1-B11
catccacgtggcgcgtcgatcgtccttactaacggttaggccttctgcgaaggactggttggagagactcagggcctatttgcttgcgcgctgggctagaatgatggcgacgctctcaaagcatatgccccgaacgcctccatcccgatggccacaatcatcttctgcagcacggtcgtcggcgtcaatccggcacccgtgatggcctccttctcggcgcgtggacccaacgctctcgtcccggacattctcaagcctgacttcatcgcaccggtcgtcaacatccttgccgcgtggactggcgccacggttccgaccggcctgtatggcgatacccgccgcacggagttcaacatc

SEQ ID NO: 68530 - DNA, 411 bp, Zea mays
  Clone ID: LIB3076-020-Q1-K1-B12
cggactcgtgggcggactcgttttctacgttgtggagatattgattctgctgtgaagattgttgaagtgtattcaagctcgaggtccccacccgctgagttgtatgcgacacttgctgagggagctatgattgggtacactccaagaggaatgcaacttgctcaagaaactatagagaagatgacttcaagaaattttttcttgaatgccaagatgggaactgatctcctacttgcagctgcccgtgaaacggctggtggatatacgactgccaattatgtctgggatctcctgcaaagccgtaaaatcactccaacacttactgctgttgaagcataccacaagggtctgacagcgctagagattccttctgacgatccacgacttctcaatgttacccatgttttggac

SEQ ID NO: 68531 - DNA, 230 bp, Zea mays
  Clone ID: LIB3076-020-Q1-K1-B3
gaacgcccccaatttcccggactgttgacccctcgacaccgctctgtcttcctgacggcttctaaaagttcaccgagatcgcgtggcccaatcccaagcccatcgcggaggacgccaagggcgtcgggaagactcaccacttccgcctgggcaaccttatctgctactgctccgacatctacgaactgctgctcataccccagctcatgctcaacgatacgcctgcgcat

SEQ ID NO: 68532 - DNA, 415 bp, Zea mays
  Clone ID: LIB3076-020-Q1-K1-B4
acttggtgagctccgctctcctcttaagaagtcgttagtggattcttgtggcaaggactggggtcagtctttatatgcttcatggcgccactctccgatggctacgataagtttatgtttacttgctcaggcatacaatcacgcaagctgtgttattcagtcactgggagaagaagacataaatgtgaattttttggttcaattagataaattgatccgtctcttagagactccagtatttgcttacttgcgtttacaggtaacttggtctgataatccgttcctgcaaatttatctttctgtttctcaggcacatttgaattccgaaacttggagagttctacctggcttttttaatttgatttctagtgctacattaatggcatgataagcctggaccaatctttgtctcatg

SEQ ID NO: 68533 - DNA, 392 bp, Zea mays
  Clone ID: LIB3076-020-Q1-K1-B5
tcgaccacgcgttcggcgagcgcccccttttatttttttattgtattttttttttatggggaggaaaaaaaaaaaatataaaaaaaaaaaaaaaaaaaaaaaaaaataaaaaaaaaaaataaaaaaaaaaaaaaaaaaaaaaataaaaaaaaaaaaaaaaaaaaaaagggtgggagattaaaaaaaacaaagttaattttctggttcaattaaataaatagatcctttatattagacactaaattaaatgcttacttgcgtttacaaaaaacttggtatgataaaaaccttctgcaaatcaatcttatatgtttttaaaaaacatttgaattccgaaacttggagagttctaaatggcttttttaatttgatttctaaaactacattaatgg

SEQ ID NO: 68534 - DNA, 399 bp, Zea mays
  Clone ID: LIB3076-020-Q1-K1-B6
ctaggcccagctccagcgcccccaatctttcaacttccactctagtagggttctgcgcgccgttttctcgtcgtcgcaatggagttctggggtgaagaagtgaagccaggagccacggtttcttgcaaagttggtgatggtttggttatccacctttcacaggctgccctaggggaaccaaagaaagcgagtgagaatgccattgtgtctgtcaaaattgatgataagaaactagtgcttggaaccttatcagttgagaagcatcctcaaatctcttgtgatctggtatttgataaagatttttgagttatcacacatttcatagacagctagtgttatcttctgtggctacaagtcacctgttcctctgtttgaatctgattctggtgaagatagttc

SEQ ID NO: 68535 - DNA, 354 bp, Zea mays
  Clone ID: LIB3076-020-Q1-K1-B7
aattcccttccgacccactcttcctaccaaaacatctcccaatctcctcctactttttccttcttcacacctttcttcattcgaggcgcttttaaaaattcaccaagaaatcctttccccatcccaaacaaattatcataaaaaatcaacttcctcaataaacctttccactttcccctttccaaacttatctgctacttcttccactgtaaccaaccttttatcttcaccaatttattcccaacgacactcttacccaacacctttttcacttttaaaaccatacaatttaattggctattcctcttataatttcatactacatatcttaaacactttactatttcatcactt

SEQ ID NO: 68536 - DNA, 427 bp, Zea mays
  Clone ID: LIB3076-020-Q1-K1-B8
gcgaggtggcgcggcggctccggaagcggtcggcggctacggggaagcgcctcagctggatgaacgagtacctccccgaggagcgcgacccggtgaggtgttggctcaccgtcgccgcagtcgcattcgtctcgctcctagttttaggttttgggagtggcaatgaaactccagtagagcttccaaagaaacttatcatcggccccccaagtgctgatagaatccaacttcctgatggacggcatctggcttatcaagaacaaggagtttcagctaacagagcaagattttcactgatttatcctcattcttttctttcatcaaggctagcaggaatccctggaattagtgcatctcttttggaagaatttggagtacgacttgtgacttatgatcttcctggttttggtgagagccatccacacgt

SEQ ID NO: 68537 - DNA, 356 bp, Zea mays
  Clone ID: LIB3076-020-Q1-K1-B9
tatccatgctgatgcagaaactaaaaaacccctcaatccttgatcacaactatcaaacaccccaaatacttgaatcagaagggaaaaatactgcccacatccttgaatctgaaggagctatcttggatctagcaaaccctgccaagggtgccgctgaagcaattcttgccaagtcagaatctactgctcgtggaatgagattcttttcacatgccatgacaactgaaagcatttccaatgcttctagcctgaaacttgcatagcaatacatctaagcattttcaaatcttgcaccaaagacaaaatacaatgcttatttcaagatataagtccccaaaattcccaacatttttttt

SEQ ID NO: 68538 - DNA, 386 bp, Zea mays
  unsure at all n locations
  Clone ID: LIB3076-020-Q1-K1-C1
gcggcgagaaggcgcccaatttcgtgtacaggggccgcctcgacgccggccgccgcgcgatcgccgtcaagaagttcaccaagatggcgtggcccgatcccaagcagttcgcggaggaggccaagggcgtcgggaagctgcgccactgccgcctggccaacctcatcggctactgctgcgacggggacgagcggctgctcgtcgccgagttcatgcccaacgacacgctcgccaagcacctcttccactgggaaaaccagacaattgaatgggctatgcgtctgagagttgcatactacatcgctgaagcactggagtattgcagcactgagggaaggcctttgtaccacgacctatatgcatatagggtcctctntgatgagaat

SEQ ID NO: 68539 - DNA, 155 bp, Zea mays
  Clone ID: LIB3076-020-Q1-K1-C10
gacgacaactatgcgctgctggccgcgttgccggattctgggctttctcagcccgacaggcgcacaggtcctatgcttgcttgcatgtggcgcaaggcgatgctcggcgcggtgatcggcggcaagccgtcgctggaacgcgtcgcggcgaacgt

SEQ ID NO: 68540 - DNA, 254 bp, Zea mays
  Clone ID: LIB3076-020-Q1-K1-C11
ctcaaccaatccttccttagaacttattgatcttagttttcttcctttaatctttatgcttacatcaagtgaaatgttcaaacaatacttgctacctcaacagaatcacccaaaaaatttcctatagcataaagccctttctaaaccctctaagaaaactataacgctgtatttacttcccattcttccttttattaatacctaaattcagtcttcaaacaaatacgaaaaactgaacttaatctcaaccttcc

SEQ ID NO: 68541 - DNA, 432 bp, Zea mays
  Clone ID: LIB3076-020-Q1-K1-C12
cggacgcgtttgaaagaagaatttccgcttgtctcagcaatctaactctcatggacagcagtcaaaaattggatctggtgagggtgattgtgtcgctaccccagcacccccatccattgaagcttcacctgcacttcctgtcgattgcgatgatggtgagccttcactcaacttgaaatctgcatcattgtcatcttcagctggcagcaaggggctagatgagttacctcccgcatttaaagaagcaaatcaaaccgtggatggctcagaagctgttgcggccaagtcagatgctcctgaaattggttgtcaggtacctggttcctctccattacatgacaaaggtagcgaatcctcggggtcgccagtgaaagacactcctgaggctggaatcagattgccaggatcagataactcaactattgcattttt

SEQ ID NO: 68542 - DNA, 409 bp, Zea mays
  Clone ID: LIB3076-020-Q1-K1-C2
gaaaaaaatgacggtcgaccaggaagagtggctggtccagtaataccatttgagaacgcagctgcagttgatccatacggccaacgtaaggtctcaaggaatccagtacttccttcaaccacgtctaacatgtcagcctatgcctaccaccggaagtcagacaactcagacagagagctccaacaggagctggaaaaggaccgcatgcagtaccagccagcacagcggttcatggacgccaaggtagtatcacagatgtcccctgacttgaggtcttactactacataccaaaaggtgtcccaaaggctgatcccgcagatagaaccgctctgcattctagcatgattcatgggatcgcccctttcagtggcattgcagctgttggaggtggctacaacaaggtcaatg

SEQ ID NO: 68543 - DNA, 391 bp, Zea mays
  Clone ID: LIB3076-020-Q1-K1-C3
cggtccgtattcccggtcgaccacgcgttcgccacgcgtagtcgttcgcgcaggcgtaccctttgcgaacgcacgtgcagctgatcccgggagccaacgtaaggtctcacggaatgcagtacttcctacaaccacgtttaacatgtgagcctatgcctaccaccaggagtcacacatctcagacagagagcttcaacaggagctggtgaaagaccgaatgcagtaccagccagcacagctgtttatggacgcccacgctgtatcacagatgttccctgacttgaagacttactactacataccatatggtgtcccaaaggctgatcccgcatatagaaccgctctgcattctatcatgattcatgggatcgcccctttcactggctttgca

SEQ ID NO: 68544 - DNA, 211 bp, Zea mays
  Clone ID: LIB3076-019-Q1-K1-H10
ttccacggctcgacccactctttcgctgacacatactccgtctctcctgctccttgtgcaacattatacatcggggatcctagagactgacatctagttcgcatgaaatacgaatgctcctgaacaaacattcctattgctacctgagctaacgcaacacttttgacttatacacatagtttctgaccctgcctttgtaatccttagaata

SEQ ID NO: 68545 - DNA, 398 bp, Zea mays
  Clone ID: LIB3076-019-Q1-K1-H11
gcgcccgacgccaggttcctccacatctgcttcaacgagaccatccacggcgtggagttcagggactacccggagccacgcaacacgtcgggcatcctcgtcgccgacatgtcctccaacttctgctccaagcccgtcgacgtatcccgcttcggcgtcatctacgccggcgcacagaagaacgtcgggccctgcggcgtcaccatcgccatcgtgcgcaaggacctcatcggcgccgctcaggccatcacgcccgtcatgctcgacttcaagacgcacgccgacaacgcctgcctctacaacaccccgacctgcttcgccatctacgtttgcggacccgacttcgaggacctgctcgcgcagggcggactcgcccgggtcgagaagaagaacgcgcg

SEQ ID NO: 68546 - DNA, 415 bp, Zea mays
  Clone ID: LIB3076-019-Q1-K1-H12
gcgtcgcttaataaggatcgtgaacttgcgcgtggacgctgtggtactgtttacaaggcggagctcagagatggccagccagtggccatcaagaagctgacagtttcaagtatggtcaagtcagagcatgacttcaagcagcacgtcaagcttctaggcaaggtgcggcaccataacattgtcaccctcaaaggcttctactggacttcctcactgcagctacttatatatgaattcattcctgctgggagtttgcatcagcacctacatgagtgctcatacgagagctcgctttcatgggtggagaggtttgacataatcgctggcgtggtccgcgcacttgtgcacttgcatcgctacggtataatccactacaatctgaagtccagcaatgtcttgctagacacgaatggtg

SEQ ID NO: 68547 - DNA, 409 bp, Zea mays
  Clone ID: LIB3076-019-Q1-K1-H3
caatcctcagaaagagagagggagagagatggcggcgagcgcgctgctgacggggtcggcgtgggtgcgcatgcgcctcctcccggacgcgcctgcgcgccccttccgccgcctctacctccgccgggcgctctccgcccgcgcctccgccgtcaccggcggcgccgagggcaactccggccccgtccgcgtccgcttcgcgccgtcgcccaccggcaacctccacgtcggcggcgcccgcaccgcgctcttcaactacctcttcgcgcgctccaagggaggacgcttcgtgctccgcgtcgaggataccgacctcgagcgctctaccaggaagtccgaggaggccgtcctcgccgacctcgcttggctcggcctcgaatgggacgaaggtcctgacgtctgtggggag

SEQ ID NO: 68548 - DNA, 389 bp, Zea mays
  Clone ID: LIB3076-019-Q1-K1-H4
ccgacgcgtgcgcccacgcgtccgcgcattccttccatctgccaagacctcctcagacgcgagaggcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtctgcagcggtgcccccgtctacctcgcggccgtactggagtacctcgccgctgaggtcctggagctcgccggcaacgctggcaaagacaacaagaagacgcgcatcgtcccgcgccacgtgctgctggcgatccgcaacg

SEQ ID NO: 68549 - DNA, 54 bp, Zea mays
  Clone ID: LIB3076-019-Q1-K1-H5
acggcgtctaatagcgatagactacgcattcattgatactgtgaatacttatac

SEQ ID NO: 68550 - DNA, 403 bp, Zea mays
  Clone ID: LIB3076-019-Q1-K1-H8
acccacgcgtccgctggctcgtggccggcgctatttacggttctccgccacaagttcaatgtgcgggccatgcggatttgcaaggacgaccaggcgcaggtcgtgcgcggcacctacaagggccgtgagggcaaagtggtgcaagtgtaccgccgtcgctgagtcatccacgttgagcggatcacccgcgagaaggtgaacggctccaccgtgaacgtgggcattcacccttccaaggtcatggctacaaagctgaagcttgacaaggaccgcaaggcgctccttgaccgcaaggcccggtgccgtgccgtcgacaaggctaaggtcaagtttactgccgactacgtacgcgacgctgctggtggcgccgccgtcactggcgcgtattttcatgagatcgact

SEQ ID NO: 68551 - DNA, 441 bp, Zea mays
  Clone ID: LIB3076-019-Q1-K1-H9
taccggttctgagatgcacgcttgacccacgcattcgctgacgcgtgggcggactcgtgggctcctagtacatcatcatctagaggagatgctacagtccgacaacttgctcgtttgaaaagcaaggggtccagaaaaatcatttctagtgctgcctctgccaatggaacacttttggcctattcagatggtgtgagaccctgcctctttgcgctaaggcataagggtggaaagaagtatacccttgacaaattagagctaccaaaaggattgccctgttctcagagtatggcgtttactgttgattcgtccaatttgatacttgcgggacgtaatggaaaaatatacatcattgacattgcaacaagagaaatttcaaatgtatttcaccctacaagaaaggcagatggagcaaaaatctcaagagaatcacctataacg

SEQ ID NO: 68552 - DNA, 293 bp, Zea mays
  Clone ID: LIB3076-020-Q1-K1-A1
cggacgcgtgggcgacccacgcgttcgtggtcgcgtggtcggacgcgtggggcatggaggagacgttcgggctgatgcttcgcaggaacgagccgctctaccttgttcctagggccgtctagctagctagttactgtgccgccgccgtctgctatccaagaatgcatgagtcttagacgtgtggcagtaataattgcgtggggtgtagtaaaataataagcacgtttgttgagttgtaatggattcacattatgtgcattcgagacaggtcgaaggaattgtatctctatagt

SEQ ID NO: 68553 - DNA, 361 bp, Zea mays
  Clone ID: LIB3076-020-Q1-K1-A10
cccacgcgtccgcgtgggccacggacgggggcaagtacaaggtcaactacaagcacgcgccgttcgcgtccgacttctccgggctggtcatcgtcggctcccgcgccgacgatccggtgctccgggaccaggaggacctcctcgggctcgtgacggccgactactacgccgccgtcatgacgccgcgggagcgcgcggccatgcgcgccttcagggcgcgccggatgacgtacacggtgtgctacgacgccgtgcggtacgcggacgggccgttccccgagtgcgacaactcggacgaggagagggagtccttctcggcctggggcgagtccaagaccgtcgtcgtgaggccccgcgcccg

SEQ ID NO: 68554 - DNA, 405 bp, Zea mays
  Clone ID: LIB3076-020-Q1-K1-A11
cccacgcgtccgcggacgcgtgggcaaagtcagatattgttgttaagatttgtctccgggaaggttgtaaatcttttgaagaagcccgagcagcaggattcaccgaagagagtgggacgctgggtgatatatgggagactgtatcaaacagtgatcttgttttgctactgatatctgattctgctcaggctgataactacgagaaaattttctcgcacatgaaaccaaacagtattcttggtttgtcacatggatttctccttggacatttgcaatctctgggttttgatttccctaaaagcatcagtgtgattgctgtatgccccaagggaatgggcccatcagtcagaagactttatgttcagggcaaagagatcaatggtgctggtatcaatgctagctttg

SEQ ID NO: 68555 - DNA, 378 bp, Zea mays
  Clone ID: LIB3076-020-Q1-K1-A2
cggacgcgtgggtgtcgccgccactccacctccacctcccacccactcctctcaccgcacgggtaaacccgcctccctcgctcctcacccgctccctgtccatccacccatcgcctcgccgccgctctgctgccgtttgctccagctgcggccgaccggggccatggctggcatcgacctcaacaccgtggaggaggaggacgaggaggaggcggaggcgctgcctttgcccggacccggtggccgtggcgccgtgtgcctggagctgtggcacgcgtgcgcgggccccgtcccgccgctgccgcggaagggcagcgccgtcgtgtacctgccgcaaggccacctcgagcacatcggcggcgacgcggcgcgaggagc

SEQ ID NO: 68556 - DNA, 411 bp, Zea mays
  Clone ID: LIB3076-020-Q1-K1-A3
gagaaagtcagctgctaagccacctcctaagaagcggatggacaagcttgacactgtctggggctgcccattctgcatccacgggagtagtgttgagtgccgaattgacatgaagaatctgattggcgaagcatcttggagaatctgtcaggaaaacttcagcacaactgttaatgcactcactgagcctattgatatatatagtgaatggattgatgagtgtgagcgtgtcaacactgttgaaggcgacgatgatgcgtgagcttgccccatgcgatgaaactgttacctacaatcgtaatgtaatgtgctggtattctcgaatgccatagcccatagtcagccatggcttggaataacgtagtggctgaccgatatgccagtaggcaccttatctagtacttacagaac

SEQ ID NO: 68557 - DNA, 426 bp, Zea mays
  Clone ID: LIB3076-020-Q1-K1-A4
gaaatgtcatgtctgtgttcaattatcatccaaggaggggagcgacggcaacaatagctggaggagacgcgccaccaccagtgcaccacgccaccacccccgccccaatcaacgccgcagcagtagggacgcctataaatgcctaggtgcgtgcgggcactaccactaccagtcagggcaagactcgcagcccggacaaggtaaggcgacgtacggcagcgatggcgccggtggtcatgatgagcatgtgcgtcgtcgtgtcgctggtggcggtgcagctgcaggccacgagcagcgacggcgccacggtcacaccgtccgtggtgctgccgccgatgacggtgccccgtgtgcgcggccggttggaggccggtcgtaagctgcatgccgtcgacgccgtcgggatgggcattgactccgtggtgc

SEQ ID NO: 68558 - DNA, 326 bp, Zea mays
  Clone ID: LIB3076-020-Q1-K1-A5
gagacgccatgtttgtgttcaaccttcatttaaggaggtgagcgactgctacaatggcgggatgtgaccctcctgcagcggtgctccacgcgaccaccgccgtcccaatatacgccagtatagtaggtactcctataagttcctacttgcgtgaaaacactaccactaccagtcatggcatgactcagagtccggacatgtgtaggcaacatactgaagagatggctcctgtcgtcattattagcatctacgacgatgcgtcactgttggcgatgcaattaaagggcacgataagatactgctccactgtcacactattcgtggag

SEQ ID NO: 68559 - DNA, 427 bp, Zea mays
  Clone ID: LIB3076-020-Q1-K1-A6
gaaatgtcatgtctgtgttcaattatcatccaaggaggggagcgacggcaacaatagcgggaggagacgcgccaccaccagtgcaccacgccaccacccccgccccaatcaacgccgcagcagtagggacgcctataaatgcctaggtgcgtgcgggcactaccactaccagtcagggcaagactcgcagcccggacaaggtaaggcgacgtacggcagcgatggcgccggtggtcatgatgagcatgtgcgtcgtcgtgtcgctggtggcggtgcagctgcaggccacgagcagcgacggcgccacggccacaccgtccgtggtgctgccgccgatgacggtgccccgtgtgcgcggccggttggaggccggtcgtaagctgcaggccgtcgacgccgtcgggatgggcatggactccgtggtgcg

SEQ ID NO: 68560 - DNA, 403 bp, Zea mays
  Clone ID: LIB3076-020-Q1-K1-A7
gcgaagccgaagaagcacacggcgaaggagatcgccgcgaagatcgacgcggcgacgacgaaccggggcggcggcaaggtcgggcaggcggatcggctagggcaggacaagggcgggcacgcgaagctggcgtgcccgctctgccgcaccccggcgcccgacatcaagtccatgcagatccaccacgaggcgcgccatcccaagctccctttcgagccggagaagctcgtcaacctgcactcctccaccccctccgccgccgaggccaccacctccaagcccaagcccggggtccgcggcagcctcaagaagtagctggctggcttgcctgcctgactgcctggggtaattcccttcgatttcaatcccatccaccgacccgatctacaatcaatcaaagtac

SEQ ID NO: 68561 - DNA, 383 bp, Zea mays
  Clone ID: LIB3076-019-Q1-K1-G9
cgacgcacgcgtgcgcggacgcttgggggacgagagtgagcagtctgagaacattgaggtagagagaatgaggagtatgtttagggcgaatgaaggggatccaaatcttggacgggaacacatagatttctttggtggaggaaggatgaaggcaacaagaggaggttacaggtagcccaatagatctactgctgttgagggagtttatgcaaagctgagttgctgctcgttggctttatttagagatggcttcagctggtgttgacccttctgggtacaagaacagcatcatcaccagcattggtgccgaaaagttgcaagatcacatgaacgagctaaagattagagatgataaagaagttgaagcaaccataattaatggg

SEQ ID NO: 68562 - DNA, 309 bp, Zea mays
  Clone ID: LIB3076-019-Q1-K1-F4
ctgagccatagctgacccagtgagggtgtggctccggtaccagcctgagtgcgtcatgggctcgggaccatcgctacatcagtgcttctgctatattgcgttgaccgactatatccgcagacgcatgtcatcgtctacttaacctgcagatctatagctgtttctaccttggggagtagcttcataacatctggaataccattgaatgtgacacttcaccgatcgaactcactaatttaccacattcatgggcactcaacctgcatgcaataaatgtatcactactcaagtgactaactactacacatg

SEQ ID NO: 68563 - DNA, 441 bp, Zea mays
  Clone ID: LIB3076-019-Q1-K1-F5
gcccacccggtcgctggggcctccccgtcgtcgccggtcgctcgacattcgccgtgccggtccgcgcttccgatccccagcgcttccccgagtcgctgcgtgctcgcgtttccccgagccaagggtcgaaggtcgattcagcgccgtcctcaccggagcttgtccacgcccccttgtcccttcgcgcccgctccttctccggagaccaccacgctgtccttgagcccgtcttctcgggaaacggcgcttgacgccctgcaagcgggacgaccccgtcccgcatctacggtgaatattcgcctgtgggacgagcccatcccacttctcctcacatccaaccaaacgccagcgagaagaggaccgtcccgtcccgttacggttcgtctctccacccctagttccccaaaccggcgcatcgattcatcgaacccttgccggaga

SEQ ID NO: 68564 - DNA, 450 bp, Zea mays
  Clone ID: LIB3076-019-Q1-K1-F6
gtgcatgcaacctctcagattttatccagggatgacagggaaagtcctatttctcacaggattggcagaaatgattctcgcaatgattatgaaaaccagcattcaaaagatgctggaaagagccagtaccaaattattcatcaggaagattttggttcaccagggcaaaagaaacatgaagatgctatttcacaacagccacagatattgactcctgtccagactactgctcttagcatgcataatgaaaaggtatctgaaatggacagtcagaatgctccttcaagcattggaggtttgagcatgcaatcaggggattcgagtgctaacattatagcagagcaaagcctgggtcaaatacttcagagacatgatccaatttctcatattcctgggccacaaacgcttccgatcaccacacaaccacagaatgttacgtcttcattcgca

SEQ ID NO: 68565 - DNA, 232 bp, Zea mays
  Clone ID: LIB3076-019-Q1-K1-F7
acgatgcatggaaactctcgcacatcacacattgactactaggcacgccctatctatgacagggctatccgaaatgactatcgcgatattaatgcttactaccaggaccgacaagctttacagagtcagtacgatctgaatgacgatcgcaatgccaactcacgacgtgcacgttacacagcacgaacactagttcacatcagccacgaaactaaactcacttccagactac

SEQ ID NO: 68566 - DNA, 337 bp, Zea mays
  Clone ID: LIB3076-019-Q1-K1-F8
accaattcccaattccacccacgcgtcacgccacccgtccatttctacattgagagcttaccttctttgactgtgtatttatatatatgtatatgggttattccattacaaaatagatccaatacataatctaaaaattcccacattaaaacacaaacccgaactacattgaaatctaaccgattttatactaaaaaccggcttaacggcatcctaaaacataagtgttacagtgatacaaatacccaactaaccagattacacatcttaccaggcctgttttcaactactagcctttttatcttcttgcagactctaaacatcatgaatcattaac

SEQ ID NO: 68567 - DNA, 241 bp, Zea mays
  Clone ID: LIB3076-019-Q1-K1-F9
tcgcccacaccttcgcccactttttcgccctttcgtcctctgctggcttctgggccccctggggttcttcttcgggttcttgagggtctcctttcttcggttatctgatcgagctgatcgagatggctgcttcatacctttagtaccgctgcttcctcgtctggctcacctgctacacactacgaccactacgtccacaacgccttcagcacctacgcttaagtcctagatcataatatca

SEQ ID NO: 68568 - DNA, 417 bp, Zea mays
  unsure at all n locations
  Clone ID: LIB3076-019-Q1-K1-G1
cacgaccaccaccgccggccgggaagcaagctcaaaccctaatcgccgtccgccggcgacgccagcacgatggcccgctacgaccgcgccatcaccgttttctcccccgacggccacctcttccaggtggagtacgctctcgaggccgtccgcaagggcaacgccgccgtgggcgtccgcggcacggacaccgtcgtcctcggcgtcgagaagaagtccacacccaagctccaggactccaggtccgtgcgcaagatcgcgtgcctagacactcacatagctctggcgtgcgcggngctgaaggcggacgcgcgcgtgctcatcaaccgcgcgcgggtcgagtgccagagccaccgactcaccgtcgaggaccccgtcaccgtcgagtacatcacccgctacatcgctgggctgcag

SEQ ID NO: 68569 - DNA, 427 bp, Zea mays
  Clone ID: LIB3076-019-Q1-K1-G10
tggcgaggagaactgtgatccagatcctaaatttatcaggagcacttcggtcaaggcagatctttttaggtctagcagaaccccagaggacttcgccacatggcaacgcattataaggttggatgccatccgatcaaacagtgaatggattatgttctccggcaaccaggctgaagttcccaaggagagagcattgcagtctgcagcatctgttgggttgaaagattatgatcacttagagcccagtatgatttatcacgcggctcgattagttgggttgcttgaagcatatgcggtgtatgatccagagattggctactgccaaggtatgagtgatctgttgtcacctatcattgcggtaatggaagaggacgatgaggcattttggtgttttgtgggtttcatgaggaaagcaaggcacaacttc

SEQ ID NO: 68570 - DNA, 429 bp, Zea mays
  Clone ID: LIB3076-019-Q1-K1-G11
cccacgcgtgcgagggcagctaataaggtaaggggcgacgaaaatggctggaacgaccgggaccaaggacgacagtggctacggcgacgagcgccggcgcgagctgcaggcgttcgacgacacgaagctgggggtgaaaggcctggtggactccggcgtcaagtccatcccgtccatcttccaccacccgccggaagccctgagcgacataatttctccggcgccgcctctgccgtcgtcgtcgccctgcggcgccgacatcccggaggtggacctctcggtgacgcggcgcgaggacctagtcgagcaggtgaggcacgcggccgggacggtgggcttcttctggctggtgaaccacggcgtggcggaagagctgatgggcggcatgctccgtcgtgtgcgccagttcaacgagggccccgtggaggc

SEQ ID NO: 68571 - DNA, 429 bp, Zea mays
  Clone ID: LIB3076-019-Q1-K1-G12
cggacgcgtgggcgagacgccgtggtaccggaagccgttgcccgtcctggcgccgctcaacctcaaggagccaaccccggacgcgcgccgcgccacctctgacaaggaagagcccgaggtgctgaacgcgttccacctcatctctttctcggagggcttcgacctgtccccgctcttcgaccagggccgtggcggcggcgtagggaggtctagcgcgggcggcatccgtttcgtgacgcgcgaggccgtcagcagcgtggtctcccgtctggagtcgctggtcaccggccgcggagccaacatgcgcgtgacaaagagcggctcgcggagcgttcgtttggaggccgtgtcgcgcgggcgctcgggggcgcggctggcagtggccgcggagatcttcagcgtggcgccgtcggtgctcctggtggacgt

SEQ ID NO: 68572 - DNA, 379 bp, Zea mays
  Clone ID: LIB3076-019-Q1-K1-G3
cggacgcgtgggatgcagttgcggtgtgtgattccagcgcaacagcaaatcacctgtacatgacggttgatgggactgagttcttgaaaacagaaaatgtgtttgatttgcagttcattcctgactctagggagttcaaacatcctgctcgagacgccgatacagaagcacctccgagttacaaggaacctgattttgagactcgtgctttgcaacatagcagagttaagctcacctgggatgatgatgaacctgaacgtaagaaagtcttgaagctaaagttcaatgatgatcagctagatgagcttaacatgtatttaacaagtgatgacagcgcgtcagataatgaaagtgtagacgattctgaggatgaatctct

SEQ ID NO: 68573 - DNA, 431 bp, Zea mays
  unsure at all n locations
  Clone ID: LIB3076-019-Q1-K1-G4
cccacgcgtccgtgggaagctatcacaaacatgctacctcatggcattggactcctgctacaatgtattttgcaaaaagtatgaaaaacatgaggggaagcagttttcaatttctgatgcagattatgttgtgttccattctccatacaacaagcttgtacagaaaagcttcggtcgtttgtactacaatgatttcttgagaaactgcagcacggttgatggagagtcaagggaaaaattggcaccctatgcaggcttgtcatctgaagaaagctaccagagtcgcgaccttgaaaaggcatctcagcaagtcgcaaagaatctgtacgagtccaaggttcagccaacaacattgatcccaaaacaagttgggaatatgtatacagcgtcactctacgcagctcttgcatcggntgtccacagtagacatg

SEQ ID NO: 68574 - DNA, 442 bp, Zea mays
  Clone ID: LIB3076-019-Q1-K1-G5
taccgattcggaattcgaggcacgcgtcacgcgtaccacgacctgcggccgggaagcaagctcataccctaatcgccgtgcaccggcaacgccggcgcgatggcacgctacgaccgggccatcaccgtgtgcttgaccgacggccacctcttacagctggagtacgctatcgaggccgtccggaagggcaacgccggcgagcgcgtcacgtgcacggacaccgtcggccctagcggtgataagaagttcacacccaagctccaggactccaagtccgtgcgcaagatcgcgtgcctagacactcacatagctctggcgtgcgcggagctgaaagcggacgcgcgcgttctcatcaaccgtgcgcgggtcgagtgccagagccaccgactcaccgtcgaggaccccgtcaccgtcgagtacatcacccgatacatcgctgggc

SEQ ID NO: 68575 - DNA, 328 bp, Zea mays
  Clone ID: LIB3076-019-Q1-K1-G7
ctgacgcataatccacaaccgtaacgatttctacaacacggacgtacacataagcagaggcacctttaactaggcccagggcataaccaacatcaccttacactacatagaatactacagccaacgtatgaattctaccaccacatgttgctcatatactactaacatctacaattacaccgtacctaccatatgcatatactctactctgcaacaccagctcatgattaactagttcgattctgcccctaactttcagaaaaccataaagaaatgctcatacatctactagcttaaaaaattaaagacttatttaacaatctataac

SEQ ID NO: 68576 - DNA, 424 bp, Zea mays
  Clone ID: LIB3076-019-Q1-K1-D9
agaagaacaaacagaagaagaggcagaaggggaagtcgaagaagaaccagcaacagagtgtctgcccagaatccatctgcgcggcaggttcctggtctcgggccgaaaggcgttagcaccactggtggccagtctccagtagacgatctcagcgaacatgaggccgggatcatggactacagcatgggtagccaggaagccaactgtggaagcagcttcctgcgcgagtctgttgctaagatgcacttctcgaccgccgaagcttcctgagaggcgtgcctcagttctgtaaatatgatggacgggatgtgtataaataaacccagcatgctgttttttttttcgtcgtcatcgtgtgcttgcgtttgagagcttgcctagtgttttggaacaataatttttggacagactatgtgttctgtat

SEQ ID NO: 68577 - DNA, 298 bp, Zea mays
  Clone ID: LIB3076-019-Q1-K1-E1
ctgaaatcttcacttctaccaatctgtatatccgactaacatgtaaactttctgaaacggtactatttcatatggatggacgtcaaatcgacgaatcatgctctacatgacaggaccacaaccactgctgtctcaaattgaacatttcttatacactgcaatccatcttgctgttacatttgtagttcaccccgcactgattttcgcatacctgtgttaagctggttacttatcaacacatcatgactttcactctatcttacacgatcgatactacatcgaagttccatataatatc

SEQ ID NO: 68578 - DNA, 415 bp, Zea mays
  Clone ID: LIB3076-019-Q1-K1-E10
gttatagagttcctggctggtggcacctcgttcgtgactgagatacgcggggactcgcgagcgagcaggcagaatggagcgccacgccgagaagccgctcctcgtgctgccctcctgcctcctcctccttgtcctcatcctcgccccgctcgtctccgccgtgcccacgccaagaagcctgcgcctggggagccaccagcagcagcacccgccggctctgaagctcagttcctctcaggagacgacggcgatcgcggcggcgatgatgaacacgggcaggccgacggcgagggtggacgtggaggtgaacgactaccagccgtccggccccaacaaccgtcacgacccacccaagggtcctggaagaacttgaacggtgctcagctggacgacgtacgcgccccaataatccttc

SEQ ID NO: 68579 - DNA, 425 bp, Zea mays
  Clone ID: LIB3076-019-Q1-K1-E11
caaatccccctgtcccgctaggattccccccaaaccctcccccaaaaccgcagagcggagaagagcgcaagatgttcggcttcgggcaccacggccaccacggccagaacccgccggcgcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagcggc

SEQ ID NO: 68580 - DNA, 347 bp, Zea mays
  Clone ID: LIB3076-019-Q1-K1-E12
tcgctgacgcgtctgcggacttatgattgcctgcaaaccctgccccatctcgggagatcggagataagcgcaagatgttacactttatgcaccactgccatcatggtctgaaccctgcggcgcacggtggcgtgcaccagcccaccttcaagatcttctgcaaggacgacgatgggtactgccttaccgtgctctacagccacacggtgctggaccctgacgaccggtgcgactagcaccaatactggttcatggacatgcgctttagcacctatgtcaaggactaggagggcaaccctgcgttcgccctggtctacaaggccactgggctaggcttcaagcactcc

SEQ ID NO: 68581 - DNA, 417 bp, Zea mays
  Clone ID: LIB3076-019-Q1-K1-E2
cggactcgtgggttcgcacgccgccccgtgccgtcctactcccagatctcgaggtctcggggccggcaccattcccccccgctccgatacacgccgagcgcaccgattgcaaatcagtcgtctccgatgctcctagcactcgccccgaccgcggcgtggagaggagaggagatcccctctgacgctgtacgagacagggcttcaagaccgacctctggcgcggaggacccataagctcggcggcggccgccgcgacatgaatggctcgaccatcccttcagtcgcgatcatgccctcgccggtcttcctctggcagcttaaggttgtgttgccacttctatgtggcttatgttagtgcaagataggttgggactcagttatgagaatgagcgttgatctcagagacctatttcttta

SEQ ID NO: 68582 - DNA, 181 bp, Zea mays
  Clone ID: LIB3076-019-Q1-K1-E3
ttgaaatctgcactgcgcgctattaggtttgggtacaagctcttaagctcacgggcccgggacatttaccattcgatatgctaaaaatctacataaaatattgcaccacagagctccgccactactgctgcatccaaccaatgctgctctgactatagtacatcatatcgccgatgtactt

SEQ ID NO: 68583 - DNA, 435 bp, Zea mays
  unsure at all n locations
  Clone ID: LIB3076-019-Q1-K1-E4
cccaagccagtgccgcggaccgcgagggttttaagagaaggcggcggctccgttcactggggtgggtcctgatctcgcctcctacttcccgagccacacacgctgccgccgtgagccgccgcccacaaggctaagcaccaaccatggccttcggagctctcgtcacgtcgaggctggccaggtccggccgcacccttgcatctgccgttgcccagggtcccgttgcccagcggatagcacctgctctgttctccaggtttggagcagtagctcgtcttctcagcacaaagccagccgcaacagatgtcataagtatcgatctaggcacaacgaattcctgcgtctccgtcatggaaggaaagacaccacgggtgattgaaaacgcagaaggcgcgaggacaacaccctncattgttgccaagaatcagaatggtg

SEQ ID NO: 68584 - DNA, 323 bp, Zea mays
  Clone ID: LIB3076-019-Q1-K1-E5
cacaaatctgcgctgcgcgcaagaagggatgggtaaaagcagttaagcttgcgcgcgcgggacagattccagtcttggtgcttagaatctacgtagaatgtagttccgcagggctccgccactaccgctgtgtccaaccactgctggtgttacttcgctgcttctactcgacgatgtactggatcgacggccggcagcgatgttccgacaccttcaatgcgtttgcgcaagtgctacggatctgtacatgcacgcgtttttgttcgatcgctacggtcacgaagtactgtctttttccgagacatactgtgcgtattgagctc

SEQ ID NO: 68585 - DNA, 230 bp, Zea mays
  Clone ID: LIB3076-019-Q1-K1-E6
acgcacacgcgtccgcccacacgttcgcacttatcgtgcgcccacgcgtactgactagagatcgtatgctttccggccgactacattgctagccaaacacgctgtcggccatagccctctccaagaaaagtaagcaataactacgactgtctgagttcacactacattgaagctgtccaaaagctggcgcagcctttcatttatcactgaccacggaagcattgaccatg

SEQ ID NO: 68586 - DNA, 340 bp, Zea mays
  Clone ID: LIB3076-019-Q1-K1-E7
cccactcctgcgtcgcttacttcctctattactacaaaagctccacctacatcataccgtgccatatcatatcatacacgctcttcaactacataccatatgctacagcaacatcactccatgtacaaatcataaaaacaacgccattctaactctccagcttcgatttgaccatcgacaagcgctaccgcaccttttactctactcgatcacaatactccttatcccctacttcaaggcatcaccatttgaagctgaccaagcgctatgacatcggtgcggacaaactgtctattgccattactcaaaccatcctaacaccctacctgtccgaacaaat

SEQ ID NO: 68587 - DNA, 166 bp, Zea mays
  Clone ID: LIB3076-019-Q1-K1-E8
tcgacacctactaccactcgacttagattaagtacatgtacaccccttagccgctactgtccgaccaatatgctacaactattgaaggctaccaaagctattcctctgaagaaggaccacatcgatgcccaggccacacaacgctccaagtactcataatttccgg

SEQ ID NO: 68588 - DNA, 423 bp, Zea mays
  unsure at all n locations
  Clone ID: LIB3076-019-Q1-K1-E9
gggagaacttggctgtctgccctgtctgcaagtacctcgtcttcttcctggagagaaagggcagaagacaatacaaagatgtccaagatggcggaggagaaggcggcggcagtgggcggactcggaggagccggggcggcggacgcggcgcagcagcagcagctggcagcaggggaggccgcggcggcgcgggtgcggcccgtggagacgctgcttcgcgcggcaccgctggggctctgcgtggccgccatgaccgtcatgctccgtaaccagcagagcaacgagtacggcgccgtcgcctactccgacctgngaggcttcaagtacctcgtctacgccaacggcctctgcgctgcctactcgctggtatccgcgttctacactgccgtgccgaggcctgccaccgtgtcgcgctcctggctc

SEQ ID NO: 68589 - DNA, 389 bp, Zea mays
  unsure at all n locations
  Clone ID: LIB3076-019-Q1-K1-F1
accattgcccattgccattccttcctttctccacagagaaatccgatccgcggagatttgaccgagccagatcatatcacacacgtaatcccatcccattccgcccgcaacagcagcaccaccggtgggaagaagaagatgaagaaggccacttcgctctccgagctgggcttcgacgccggcgacgcgtcgtcgggcttcttccgccctgtgtccggcgactcgtcgacgccgacgtcgcagcaccaccggcggaggctgaccaaggtgtcggtcatcggcgcgggcaacgtggggatggccatcgcgcagaccatcctnacgcgcgacctggccgacgagatcgcgctggtggacgcggtcccggacaagctccgcggggagatgct

SEQ ID NO: 68590 - DNA, 430 bp, Zea mays
  unsure at all n locations
  Clone ID: LIB3076-019-Q1-K1-F10
cggacgcgtgggcggacgcgtgggcggacgcgtgggcaaaaactcttaatccgtgttggagtgcctacaatattgcagacaggagagctcctccagtctatgttaatctttttactggtcaagcaacaacacaatttccaagtatgactgagactgtaagaggagggatactagcagacgcaatgggtcttggcaaaactgtgatgaccattgctctgatactttccaatcctaggggggagttctctaactgtataaaaggagacacaaggtatctaggagatcgtgcgaccagaggatacacttcaacatcctctgttagaggaggtacccttgttgtttgccctatgtcattattgggccaatggaaggatgagttggaagcacattcggcaccaggagctctntctgtgtttgtgcattatgctgg

SEQ ID NO: 68591 - DNA, 428 bp, Zea mays
  Clone ID: LIB3076-019-Q1-K1-F11
cagacgcctctgccgacttatgatccgactcataccctaaaactatcaagcacacttggagtagctacaagtatgttagactatcagaactactgcaacctatgttcataactcctactgctcaagcaacaacacactattccaacttgactaatactgcaagaccaacgatactaactgactcactgtctgttaccacaactgggatctcgattgctctaatactttccactagtaccagcaatggttctaactcattcacttgagacccaaggtcatatacgagatacggcaatcataggatacacctgatcatactgtcactgagctcgtacatctagcactctgtcgtatatgattattcggccaatctaatgacgatcaacacgcacatccaggacaagtagctctttttgacttagagcatt

SEQ ID NO: 68592 - DNA, 432 bp, Zea mays
  Clone ID: LIB3076-019-Q1-K1-F12
cgtgaacatgtccatcgaggcgtcggcgacgttcacggtgatggagccggacacgatgcggcgggtgttcgcgggcgagctgggccccgaccgcggcgacatgtacatctacagccggcacttcaacccgacggtgctggcgctggggcggcagatggcggcgctggagggcacggaggcgggctactgcacggcgtccgggatgtccgccatctcgtccgtgctgatgcagctggtgggcgccggcggccacgtggtggcgtcgcggtgcctgtacagcgggacacacgcgctgctggcccggttcctgccgcgcgccttcggggtgcgcgccaccttcgtggacgccgacgactaggccgtcgtgcgcgccgcggtggtccccggcgagacgcgggtggtgtacgtggagaccatgtccaacccgacgct

SEQ ID NO: 68593 - DNA, 118 bp, Zea mays
  Clone ID: LIB3076-019-Q1-K1-D8
atgagatcataccatctaccaatctctttatcctcccaaaaatcaacatctcggaaacggcaccatataacaaggctcagatacacaccgaacacacctactcgcaatcacacgatca

SEQ ID NO: 68594 - DNA, 361 bp, Zea mays
  Clone ID: LIB3076-019-Q1-K1-F2
acggagctagggtttcctcccagccgttatcgcttcacgtccgctacataccggcgaggagacgaaaggagggagttttgagaagcataaatggctcctaaagccgctcctgtcaagaagggtgatgccaaagcccaggccttgaaagtggccaaggctgtgaaatctggggcaggcaagaagaagaccaagaagattcgcacatctgtaacatttcaccagcccaagaccctgaacaaggccagggacccgaagtacccaagaatcagcactactggaagaaacaagcttgatcagtaccaaattctcaagtacccattcaccacagaatctgcaatgaagaaaattgaagatacaacac

SEQ ID NO: 68595 - DNA, 327 bp, Zea mays
  Clone ID: LIB3076-019-Q1-K1-C11
ccgacaccttacctaacttttatccaatttcaactcctatatacagcgagatccttgggttatgtttctacgacatgccccctacgaaaaatatccatacacccaaattacatcccaactctactacttgattgacttccaacacgtacctgtccttaaccaatgaattccaccactaagaaactaaaacctctatctcatgaaaacaccagacttcttatcgaacataacactgacatcaacctacctataatgaccataaaatcccacttaaacattcaccctctttctatcttgaacatcacgaccacaacttaccggactacg

SEQ ID NO: 68596 - DNA, 158 bp, Zea mays
  Clone ID: LIB3076-019-Q1-K1-C12
cccacgcgtccgcccactcttccggatctccagcattgccctatctgtggaaaaaaaaaaaaaaataaaaaaaaaaaaaaaaaaaaaaaaaaaaaaaaaaaaaaaaaaaaaaaaaaaaaaaaaaaaaaaaaaaaaaaaaatggcatacgtttaaaagt

SEQ ID NO: 68597 - DNA, 327 bp, Zea mays
  Clone ID: LIB3076-019-Q1-K1-C2
ctggcttctcctccccctcttaccaagtcctcttcgggttagggttacttagggctttgtggaggggcgattgcagccgctgatgtggagtaccgttgcttcgtcggcggacttgcctgggacaccatcaacaagtcgctggagaatgccttcgcctgctaccgcgagatcctcgactccaaggtcatcaccgaccgggatgacggtgaggtctcgcggattcggcttcgctaccttctgctacgagaactccatgctcgactctatcaagaacatgaacggcaaagagctcgacggtcgtaacatcaccgttaaccatgcccagtc

SEQ ID NO: 68598 - DNA, 166 bp, Zea mays
  Clone ID: LIB3076-019-Q1-K1-C3
ctgtactgtcactgtcctaataagtggtacgtgtgcggtgtcgcattgtgactgcttagtcaccgagaggattatttctggtttcgctgcttatgtaatgcttttgaaacgatgaacgaagctacatgctctacagatgctttgagaagtataacagataacctac

SEQ ID NO: 68599 - DNA, 428 bp, Zea mays
  Clone ID: LIB3076-019-Q1-K1-C4
cccacgcgtccgaagaaagcctaagcagataatcatcttcagggatggtgttagcgagggtcagggtagccaagtactgaacgtagaacataatcaaattataaaggcatatcagagtatgggacagggggaccttccgaagttcacagtgatcattgctcaaaagaatcaccacacaaaactcttccaagctgattcaccagagaacgttccacctgggactgttgtggactccggcatagttcatccaagacagtatgatttctacatgtgtgctcatgccggaccaattggtacttcaaggccaacccattaccatgtgttgcttgatgagattggcttctctgcagataatctccagaagctagttctttcactgtcatatgtgtaccagaggagcaccactgcgatttctgtggtggcaccta

SEQ ID NO: 68600 - DNA, 177 bp, Zea mays
  Clone ID: LIB3076-019-Q1-K1-C5
acgcgtcccatgactgtcctaataagcggtacacgtttctaaatacttattgacactactaaggcaccgagaaaattattactgcttttactgcatatgtaatgcttatgaaactatgaatgaatctacatgctctacacctcatcttataagtatactaaataaactacaggccct

SEQ ID NO: 68601 - DNA, 371 bp, Zea mays
  Clone ID: LIB3076-019-Q1-K1-C6
caattcccaattccacccacgcgtcacgcgacccatgctactaaagcctccacatataatctttcacaaccatcactgaagccatggtcacggtgaccatacactgaacgtataacataatcaaactataaacgcatatcatactatgacacacggagaccttccgaagctcacagtcatcatctctcactagaatcaccacacctaactcttccaagcttattcaccacagaacgttccacctgaaactgtatttgactcctgcatacttcataccaaacattattatttctacattgacactcatgccagaccaattggtacttcaaagccaacccattaccatgtgcaacctgatgagattggcttct

SEQ ID NO: 68602 - DNA, 347 bp, Zea mays
  Clone ID: LIB3076-019-Q1-K1-C7
gtactgtcttaccgcccggtgcccgtgcggccgtgacgatcgacactgacgagcaaagcaaaggcaaccgagccgatcgagacgacgagaccgcgattgctagctagctagttcgggcagcgagcggtgtgagacggctatggcgtgctgctccgccgtcctgcaccatccgctgggcttctcactcaccccgtgctccgcctcccgagccccaccgcgcatccagcgcgtgggcgtggcaactccctcggccgccttcgcccgccctctttctcgcgccaggatctcaccgcgctgcacctactacggtggcgccagcgctgcccctggtcctggggagctacccg

SEQ ID NO: 68603 - DNA, 379 bp, Zea mays
  Clone ID: LIB3076-019-Q1-K1-C8
atcagctttgaccgactctttatcactttacagactcccgactaataatctaggacgagttgattttgacacatctaatgcaccaatatttatactccaaataacctacctatgttcataagacttatacagcattcataaacttgcatactttattgaacgtttctattaacacagataattcactatcaagaagaatcaaaactctaatgaatgactatctacatactcagcttatggaactatttcaaagcctatcattctattttcgcaccataactcaatactacaaatctaaaatactcaacatataagatgcttaactacttttacttcatcaacatctcttggtcgacaccgatatctcccttaatcctct

SEQ ID NO: 68604 - DNA, 280 bp, Zea mays
  Clone ID: LIB3076-019-Q1-K1-C9
cacgcttgagccacgccttcgctgtcgcatgagatgagcatcactatgatttcactaatggaatacaatggggtacaatcgtacagtatcttacgagaggtgaagtaggtgataaggttcttattggacatatggtagaaaattgtggaaatctcagtggactaaatgcatcaactgcattgacggatattattgacatcatctatcagacgacaggattgtcaggatgatgactaagttcatctttttgacttgaatgacaaagaatggagcagtgctc

SEQ ID NO: 68605 - DNA, 125 bp, Zea mays
  Clone ID: LIB3076-019-Q1-K1-D1
gcctggtgcccggtgcccgtgcggccgtgacgaacgacactgacgagcaaagcaaagccaacggagccgagcgagacgacgagaccgcgattgctagctagctagttcgggcagcgagccgggtg

SEQ ID NO: 68606 - DNA, 424 bp, Zea mays
  Clone ID: LIB3076-019-Q1-K1-D10
gcgtcgaactggcgcaaccgaccgccgccgcggctgcggtgaccaccgctgagcaggcgcaggatctcatcgacgccgctaggtacgacgacttggaggacgtcgtcgccctgttctccgctggtgtctcgctggactccacagattcgcaaggccgcacagctcttcacatggcttctgccaatggtcaccttgctgtggtggaatacttgattcaaaatggagcgaatgttaacgccaccaacatggagaagaacacaccactccactgggcatgccttaatggacgtatagaggtaatcagggctttgatctcagcgggggctagcgtgagtgctctgaacagccacgagaaaacgccaatggacgaagcggtgaccacaggcaagatggacgtgatcgacgcgatcggtgcggcagtagc

SEQ ID NO: 68607 - DNA, 358 bp, Zea mays
  Clone ID: LIB3076-019-Q1-K1-D12
tcggcaatatttacctgtgatttacctcttgtttcttggccacatctacccagctgctccggattactaatacaactatgcacacatatgcctgcttttatcgctccttattttcctattctggataatctcctctcttgtctacactgtcttcatcactctgcacactgttggaacctaccgatctcatgctctgactgtaaagagttcgcgggaaccgttggatctttccgtcatctggccactgatcgtctgatatgttcgtgatctccccgaccccctgtttctactggtacacggagaaaccgacatatgatatacctgttctctcgcgacactcggaaacacacgtgttatc

SEQ ID NO: 68608 - DNA, 419 bp, Zea mays
  Clone ID: LIB3076-019-Q1-K1-D2
gcctgcgtgcccggtgcccgtgcggccgtgacgaacgacactgacgagcaaagcaaagggaacggggccgagcgagacgacgagaccgcgattgctagctagctagttcgggcagcgagcggcgtgagacggctatggcgtgctgctccggcgtcctgcaccatccgctgggcttctcactgaccccgtgctacagactaccgagccccaccgcgcatacagcgcgtgggcgtgggaacttcctcggacgacttgcgccgtcctctttctcgcgccaggatctcaccgagctgtacctactcccgtggcgccagcgctgaccctggtcctggggagctacccgcggctgcgctgcgacgggtgcttgagatgccgggtgcgcaccatgcgcccggctgctacgacgcgctgagcgcacg

SEQ ID NO: 68609 - DNA, 398 bp, Zea mays
  unsure at all n locations
  Clone ID: LIB3076-019-Q1-K1-D3
gccacgcgtccgaggcgcgcgcctgttacggcttccaaatcgccatagagaacatccagtcgcagatgtactcgctgctgctcgagacctacatccgcgatggcaccgagaaggaccggctcttccgcgccatcgaaaccgtccgcgccgtacgccgcaaggacgactgggccatgcgctggatcgacggctgtgagcgctttgccgagcgcctcgttgccttcgcctgcgtcgagggcatcttcttctcgggctccttctgtgccatctgctggctgatgaaacgcggcctcatgccgggcctcactttctctaatgagctcatctcccgggacgagggcctncactgccacttcgcctgcctgctttatgacctncttcagcgcaagctcgatgag

SEQ ID NO: 68610 - DNA, 195 bp, Zea mays
  Clone ID: LIB3076-019-Q1-K1-D4
gccagcctttcctgtccctctccttcgattgctttcaaatctgcatcttcaacattcggtcacggatgtaatcgcttctgctagagacctacatctgatacagtacctataattaccggctgttctagactgtcccaacgatgatcaccgtatgcactacggattactgacccatgctcttgatctaccgctcaa

SEQ ID NO: 68611 - DNA, 410 bp, Zea mays
  Clone ID: LIB3076-019-Q1-K1-C10
cggacgcgtgggcggacgcgtgggcaataccaacgtagctctactgtgacatccagtcgtgatggtcgctacgaaggtgcaccttcaaaagtcgtggatgcgccaaaattggatgcggaatctctttctgtatcgcctttgagagccgcaccgctctcgaatcaagaaaggcttgtgctaaggaagcaagcccttcaaatgaagaaaagacctgactttccatagggaggaacaatgccatcaccggagttgcaaaaaccataaaaacgcacttcaagaagcaccctcttgctatcgtgaacatcaagaacagagcggacgggactccgattcagcagctgatatcggaactcgaggaggcgacaggatcggtgctagtgtcacgagaaaccaacaaagtgatcttgtac

SEQ ID NO: 68612 - DNA, 343 bp, Zea mays
  Clone ID: LIB3076-019-Q1-K1-D5
gcctgcgtgcccggtgcccgtgcggccgtgacgatcgacactgacgagcaaagcaaaggcaacagagccgagcgagacgacgagaccgcgattgctagctagctagttcgggcagcgagcggtgtgagacggctatggcgtgctgctccgtcgtcctgcaccatccgctgggcttctcactcacccagtgctccgactgccgagccccaccgcgcattcagcgcgtgggcgtggcaactacctcggtcggctccgcccgccctctttctcgcgccaggatctcaccgcgctgcacctactccggtggcgccagcgctgcccctggtcctggggagctacccgt

SEQ ID NO: 68613 - DNA, 440 bp, Zea mays
  Clone ID: LIB3076-019-Q1-K1-D6
aacagtttggaccgtttatgtattcctctacgggcgcctgtatcttgtcctaagtggcggtgatgaagcattagccactggaaagaggtttatacacaacgagcctctccaggttgctctagcttcacagtcttttgtgcagcttgggttcttgatggcgctgcctatgatgatggaaattggtctagagagaggattcagaactgcattgagtgactttgtacttatgcagctccagttagcatctgtgttcttcacattctctcttgggaccaaaactcactactacggaaccacactgctacatggaggagctgaatatagagctacagggcgtggatttgtggtgttccatgccaagtttgctgagaattatcgattgtattcgcgaagccattttgtgaagggcattgaactgatgattttgcttattgtgtatg

SEQ ID NO: 68614 - DNA, 361 bp, Zea mays
  Clone ID: LIB3076-019-Q1-K1-D7
atgaaatcctaacatctaccaatctctatatccgcgttacatgttcaagctatgaaaggggactaaagaatatggatggatgtcacttggtatactcatgctgtgtatgacaggatctgaagcaatgcaggctgatcttgaacatgtgtcatacattgcactccatattgctatcaatagtctagtttaccccgcactgatttacgtcatacatgtgtcaagctgcttacttatcaaaacatcatgacttttactctagctcacaatctggatactacatctcagttctagataagatcacatgtccattgatgatattgacatattatctactacggcgttcataagccaagcaataatc

SEQ ID NO: 68615 - DNA, 230 bp, Zea mays
  Clone ID: LIB3076-021-Q1-K1-H4
tgactgcctactcaacttcataatcaaagctgttaaggactttgcttccttcagcgatgacctgggatgcgggcttgtctccctgggtgcctggatatgaacgctaccttccacgtatctgcatatggggtaatctcccaatggatgctgtgccactaggggtaaacttaaggtgaattggaaccttggtgcgggtatcgcaaattaaaacctgaaccctgccgtgaaaa

SEQ ID NO: 68616 - DNA, 456 bp, Zea mays
  Clone ID: LIB3076-021-Q1-K1-H6
aatacctgctccttcttggtggggatggtggtgttcctcgggatcagcactgtcataacgtcctccagcagtctccagacccagggacagaggggtgacgtccagcagaagcaggtcctgcaccttctcattgccctcaccgctcaggatggcagcctggacagcagcaccataggcgacagcctcatcggggttgatgttcttgcacagctccttgccgttgaagaagtcctggagcagttgctgcaccctggggatcctagtggagccaccaacaagtacaacgtcatggacggtgctcttgtccatcttggcatccctcaggcacttctcaacaggctccatgcacttcctgaacaggtccatgttgagctcctcaaacctggcacgggtgatggtggagtagaagtcgatgccctcatacagcgagtcaatctcaatcgtggtctgggcagt

SEQ ID NO: 68617 - DNA, 333 bp, Zea mays
  Clone ID: LIB3076-021-Q1-K1-H7
gcgcgccgccggccgccggcagccgcccgcgatgtcgaaggccgcggcagcgtccctcccgcggtcgccgcgggaggtggctcaccttgtggagcagctccagcgccaccacctcgtctcggacgcgtccctactctccagctccgcgcactccgacctcctccaggcgcgcgaggaggtcgcggcggagcgcgcgctgtacctcgaggcactggcggtgtacgcggaagcggtggccatggtggaggagtaccatgcggctgccggcgccggcaagaagctcaacttgctcccgcaagtgtacgagtctttggagcaccaggtggccgtggc

SEQ ID NO: 68618 - DNA, 127 bp, Zea mays
  Clone ID: LIB3076-021-Q1-K1-H8
attctgacatatttaactcgtttgtcttttttcccttgctagttatgaatagaaacacaggaaatagagtaattttcattcaacatcaaatttttcttgagtaatatctattaatcttatccattct

SEQ ID NO: 68619 - DNA, 181 bp, Zea mays
  Clone ID: LIB3076-022-Q1-K1-A1
gtcgcgggtttctcacacggcactcgagttgctaaccctgagtctacacaggctcgaggggcccatctccagctgacccgggccgaataacgtgtgctgtgcagacgaccttgttagccacttgagaacgcgccaccggatccgacccatcctgctctggagcacacagtgtaccacatgg

SEQ ID NO: 68620 - DNA, 325 bp, Zea mays
  Clone ID: LIB3076-022-Q1-K1-A10
ctgatagaatgattgatgacaatgaacgttagataactaaactcctgaaggaggacaggggcctttactagtcggtagatgctagaccaacagttagcatctatgatcatcaaagtcaatgacctgtataggatacaatgagtgttgaattggctgatcaacagattttgcttctcgtaaggcatcatgcacatcgagaagaggaattggctcaatcacagaggcatatcttagcactactactagaaattgaatagctcgagcgtgaaaatctgtttcatgatcaacaggaatcaatgtttaaaaccttgcttcgcaatatgga

SEQ ID NO: 68621 - DNA, 285 bp, Zea mays
  Clone ID: LIB3076-022-Q1-K1-A2
gcaaacccagaaaggcactaggacagacagaaaacaggagcgaggggtgcgtggcagacggtgcggagacagaagcctcactcctgcacactatgagtcttgttccagttcgagcgctttcttggatcgtgaggctactactcgtgctgtttgcagttgcatagaactgcatcggccgaagtgtacagcacggtttgttggccttgcccatgcgctacggtagggtactgagacgagcagcttggagacagcaatggatgcactcattgacgctgctatcgctgt

SEQ ID NO: 68622 - DNA, 425 bp, Zea mays
  Clone ID: LIB3076-022-Q1-K1-A3
gtcgatggcatcccccatgtcaaccgctggccgcaaccagtggctgcacaggctcgaggaccacatgtccgctgtgaaggcactcgcgtggtgtcctttccagagcaacttgctggcaactggtggtggcggcagtgatagatgcatcaagttctggaacacacacactggagcatgtctgaactctgttaacactggatcacaggtctgtgcccttctatggaacaaaaatgagagagagctgctgagctcacacggattcacacagaaccaactaaccttgtggaagtacccatcaatggtaaagatggctgaactcagtggccatacctctcgtgtccttttcatggctcaaagccctgatggttgcacagtagcatcagccgctgcggatgagacccttcgcttcttgaacgtattttgag

SEQ ID NO: 68623 - DNA, 374 bp, Zea mays
  Clone ID: LIB3076-022-Q1-K1-A4
gtcgatggcatccggcatgtcaaccgctggccgcaaccagtggctgcacaggctcgaggaccacatgtgcgctgtgaatgcactcgcgtggtgtcctttccagagcaacttgctggcaactggtggtggcggcagtgatagatgcatcaagttctggaacacacacactggagcatgtctgaactctgttaacactggatcacaggtctgtgcccttctatggaacaaacatgagagagagctgctgagctcacacggattcacacagaaccaactaaccttgtggaagtacccatcaatggtaaagatggctgaactcattggccatacctctcgtgtccttttcatggctcatagccctgatggttgcacag

SEQ ID NO: 68624 - DNA, 296 bp, Zea mays
  Clone ID: LIB3076-022-Q1-K1-A5
gtcgatggcattccccatgtcaaccgctggccgcaacttttggctgcacaggctcgagggggacatgtgcgctgtgaatgcactcgcgtggtgtcctttccagagcaacttgctggcaactggtggtggcggcagtgatagatgcatcaagttctggaacacacacactggatcatgtctgaactctgttaacactggatcacaggactgtgcccttttatggaacaaatatgagagagagctgctgagcttacacggattcacacataaccaactaaccttgtggaagtacccat

SEQ ID NO: 68625 - DNA, 417 bp, Zea mays
  unsure at all n locations
  Clone ID: LIB3076-022-Q1-K1-A6
cccacgcgtccggaggagactcctgcggtcgagcaggaggcagccgccgaggaggaggctgctgctgctcctcctgctggtgccgaggagcccgccgcggccgagcctgtcgccgaggcagaggctgctgctcccgaggagctcgccgcggacgagccggaggctcctgctcctgctcctgctggtccccaggagccggccgccgaggcggaggctgctgctcctgaggagcccgagaaggccagcgagtgaggccgtgcgcacgcagcggcggcggccagggcccaggccccaggggatcggcgtgcgcgcgtggcggngtagtctctcgcgcgcgtacatggcagtatgacacgggattttgctgntcagtacgctacgggtactggcgtctctctgngtgtgtgtgtgtgtgtg

SEQ ID NO: 68626 - DNA, 360 bp, Zea mays
  Clone ID: LIB3076-022-Q1-K1-A7
cccacgcgtccggaggagactcctgcggtcgagcaggaggcagccgacgaggaggaggctgatgctgctcctgctgctggtgccgaggagcccgccgcggccgagcctgtcgccgaggcagaggctgctgctcccgaggagctcgccgcggacgagccggaggctcctgctcctgctcctgctggtccccacgagccggccgccgaggcggaggctgctgctcctgaggagcccgagaatgccagcgagtgaggccgtgcgcacgcagcagctgcagccagagcccaggccccaggggatcggcgagcgcgcgtggcgctgtagtctctcgcgcacgtacatggcaatatgacacgggat

SEQ ID NO: 68627 - DNA, 265 bp, Zea mays
  Clone ID: LIB3076-022-Q1-K1-A8
cccacgcgtccggaggagactcctgcggatgagcaggaggcagccgccgaggaggaggctgctgctgctcctcctgctggtgccgaggagcccgccgcggccgagcctgtcgccgaggcagaggctgctgctcccgaggagctcgccgcggacgagccggaggctcctgctcctgctcctgctggtccccaggagccggccgccgaggcggatgctgctgctcctgaggagcccgagaaggccagcgagtgaggccgtgcgcacg

SEQ ID NO: 68628 - DNA, 61 bp, Zea mays
  Clone ID: LIB3076-022-Q1-K1-A9
tcgctgatataatgactgaagacatttttctttttacaactaaactccttaaggagaacag

SEQ ID NO: 68629 - DNA, 317 bp, Zea mays
  Clone ID: LIB3076-022-Q1-K1-B1
cggacgcgtgggcgctcggccggaggcgttgcacctgcacgcttcagcagccgccaagcctgtcttgtgcggcaagcaccacacagacacccgatggcgctcctggtgctgcgcggctgcgccgtgccgccaggcgtccacgcggacccggcggagctccgactgatgcctccggcgctgacgccgcggcggctcgaggacgtcgtctcttctgcctaatccgagctgttcggagaggtggtgtcgttgtcccaggacagaacgcactactgtaccgctggcggtgccaacgggcacgccatcactgccgtcactga

SEQ ID NO: 68630 - DNA, 56 bp, Zea mays
  Clone ID: LIB3076-022-Q1-K1-B10
gccacgcgtcgcggccaaagacttcggtcctacccagtaagcggccgccgacgcca

SEQ ID NO: 68631 - DNA, 90 bp, Zea mays
  Clone ID: LIB3076-022-Q1-K1-B12
gacacgcgtggcggccatacacttcgggtttttcccagctacggggcgcaaaggcaaacggtcacatttgaggcggcaacggctcaccag

SEQ ID NO: 68632 - DNA, 236 bp, Zea mays
  Clone ID: LIB3076-022-Q1-K1-B2
ctgacgcgtgggcacacgctcagatgcgtttcacatgcttgctggagcagcctccaagcaggtgatgtgcggcaagcacctgacagacacctgatggctctgctggtgctgcgcggctgcgccgtgccggcaggcgttcacgcggacccagcggagctgccgctgatgtgttcggagatgcctccgcgcagggtcgaggaagtagactcttctggctaacctgagccatccggaga

SEQ ID NO: 68633 - DNA, 463 bp, Zea mays
  unsure at all n locations
  Clone ID: LIB3076-021-Q1-K1-H3
gctttgacggcctcctcaactccataatcaaagtggagaaggacgatgcttccttcagcgatgacctgggatgcgacttgtactccctgggtgcctgtatatgatcgctaccttccacgtatctgcatctgtgttaatctcccattgtatgctgtgcagctagtgttaatcttaggtagaattgtagctgtggtgtggttatcgcaattcagagctgaagcctggcggtgaaattccagctaagggaaagaaaattacactgcgtgttcaaaatgcacaagaccttactcgtgatgtcataaagtcagattcagctagcgtaaaagtacctgaacttgagttggaactttcatgtggaacgttgggtggtatggtcacaactgttgaaggtttaattgtgaaaatatgtgaggctctggagagaatacatggatttcaattangcgatagtacactggaatgg

SEQ ID NO: 68634 - DNA, 238 bp, Zea mays
  Clone ID: LIB3076-022-Q1-K1-B3
cggacgcgtgggcactcgcccggaggcgttttacatgcaagctttagcagccgccaagcaggtcttgtgcgtcaagcaccacacagacaccggatggctctcctggtgctgctccgttgtgctgtacctcctggcgtttacgctgacccggcagagcacctattgatgactctggcgctgccacctcggctgctcgaggaagtcctctattgtgcctactccgagatgttcggagagg

SEQ ID NO: 68635 - DNA, 209 bp, Zea mays
  Clone ID: LIB3076-022-Q1-K1-B4
acgacttggcgagcgtctatctcctcttacgatttacctagttgattcttgaggctaggactggggtaagggtgtatttgcttggtggtgtgactctccgatggctacgactagttctatgtgtacttgctcacgcatacaatcactcaagctgtgtaattcattctctgggataagaatacttctatgtgaatattttggtctaattt

SEQ ID NO: 68636 - DNA, 421 bp, Zea mays
  Clone ID: LIB3076-022-Q1-K1-B5
cgtgacttcccctccccttctcccctctccactccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaagagaaattgtacagtctgaccatgatgacccaccacagaagat

SEQ ID NO: 68637 - DNA, 344 bp, Zea mays
  Clone ID: LIB3076-022-Q1-K1-B7
ggagtactgtggcactacaagttactgcattaagctatttctagacaagaaatatgcttggccataccgtgcacttgatgcagtgcttgaccatttcatgcgttttgaagatgatgagaggatcatgcctgttatatggcatcaatcactgcttgcatttgtggaaagatacaagaactagttatagaaaaaggataaggagaaacttgcacgtttgttggatcaccagaaacactatttagttactccagaaattcgaagggagcttcaagggagctgcaacaggggtgaaaaagatacaaatttgcatacttagtcacctatttacgtgattaccaagccta

SEQ ID NO: 68638 - DNA, 339 bp, Zea mays
  unsure at all n locations
  Clone ID: LIB3076-021-Q1-K1-F5
cgagattcccaaaccgctccgccgccgccgctcgtcagcctccgttctaaccgccgcgcgggcgacatgccggccaaagagctgccggggttctactacgacccagagaagaatcgctacttccccatcaggggccccatcccgggcgctgccgnccgccgcggcacgccagcgccacctccggctgtggacacaacggggtgcagcaggaaaagggctaggctgncggagctgctcaacgccagggagatgtaccgcggcngagtcatgttctccaataaagcccgcagggtcacgttcaagcagcagtgccactacgcgcaggcgtatcagcccatg

SEQ ID NO: 68639 - DNA, 119 bp, Zea mays
  Clone ID: LIB3076-021-Q1-K1-F7
tccatcttaaagcagcgtgaaggctaccgatggtagagagcgcccttctggggacctcggggatgctttcattctcgatcttcctgatccaaatgggcctggtttcactcacatctacc

SEQ ID NO: 68640 - DNA, 434 bp, Zea mays
  Clone ID: LIB3076-021-Q1-K1-G1
caattccttctaccactcaaagcaacctccagtcttccaacaatcctgaaaagccagcagcgtaaagcagatcctgccaaggcaaccgctaatggtgttccaaatggtactggtcacactcacagttacagtggaaactgtaccaagccaacaaagttcagcacttgacgcctgatggaactaatagggcgcccttgctaggtggagttccttctgctggttacctagacacgacatattatgggtatgacagcacaggggcacaatttgcatggtatgatggctctgctaatgcaaatggacagcaaagaacaaccacaactaatcgttttccatcctcgtcattcagtggtaatggttcatctgcaatatatcagaacaagagctccaccacgcagcaaatgggtatgcagaatagaagacctacaactaca

SEQ ID NO: 68641 - DNA, 201 bp, Zea mays
  Clone ID: LIB3076-021-Q1-K1-G10
gagcgattgcggcggcggaagtaagaggcgatggggcactccaacgtgtggaactcggaccccaaggactactggcccggatcccgcgtctgccgggtctgtgcgaacccttatggactgatcaagaagtaccggcttatgttctctaagcacatgctttcggagcaacgcctaggacattggcttcatcaagtaccgctt

SEQ ID NO: 68642 - DNA, 296 bp, Zea mays
  Clone ID: LIB3076-021-Q1-K1-G11
gagccacttcggcggccgcagtaagaagctttgggtcactctgacgtgtgtaactcgaagcccgaggactactgaccctgatcctgcgtatgccgtgactgtgctaacacacatggacagatcactatgatcgggctcacgtgctgaaggctgcgctttggtaacaacaccatagacattatcattatcaaaaaccgcttattgcatgtcaacatgctaactgaattcctacttgcagactgcggtgtaaaggctaggggatatacgacatgacagtatgtatgagatctcctgca

SEQ ID NO: 68643 - DNA, 148 bp, Zea mays
  Clone ID: LIB3076-021-Q1-K1-G12
gagagacgtcgaccttagagctaagtacttttgggttacatcgacatggcgatcactcggcctcaggtcgctttctcctggctcggggtgttcctcctccttctggttccagacggactgactacgacgttctcgctgactaacatct

SEQ ID NO: 68644 - DNA, 477 bp, Zea mays
  Clone ID: LIB3076-021-Q1-K1-G2
cagatatctgcctgcaccagatcgacatcccttaatagttatgtgtagcctacggtagaaagaattgtgactttcagagacaatgaagacccttctcttgtggaacttctgtttcagtttggtcgttatctactcatttcgtgctcaaggcctggaacccaaatttccaatctacaagggatatggagcaatgacacttcaccaccatgggatgcagcaccccatccaaatataaatctacaaatgaattattggcctgcgcttccttgtaatcttagcgagtgccaagaaccactgtttgactttattggttccctctcaatcaatggagctaagactgcaaaagtgaattatgacgctagtggttgggtcagtcatcaagtcacagacttatgggcaaaaacatcaccagatgctggtgatcctgtatgggctctatggccaatgggtgggccttggcttgcaactcatctctgg

SEQ ID NO: 68645 - DNA, 437 bp, Zea mays
  Clone ID: LIB3076-021-Q1-K1-G3
caattccttctaccactcaaagcaacctccagtcttccaacaatcctgaaaagccagcagctaaagcagatcctgccaaggcaaccgctaatggtgttccaaatggtactggtcacactcacagttacagtggaactgtaccaagccaacaaagttcagcactgacgcctgatggaacttatagggcgcccttgctaggtggagttccttctgctggttacctagacacgacatattatgggtatgacagcacaggggcacaatttgcatggtatgatggctctgcttatgcaaatggacagcaaagaacaaccacaactaatcgttttccatcctcgtcattcagtggtaatggttcatctgcaatatatcagaacaagagctccaccacgcagcagatgggtatgcagaatagaagacctacaactacatcagca

SEQ ID NO: 68646 - DNA, 462 bp, Zea mays
  unsure at all n locations
  Clone ID: LIB3076-021-Q1-K1-G4
cggacgcgtgggcggcaaacctttgggcactcatcatggacgcaggaactggtttctgttctcaggtttatgagctctcaccagttttcctccacaaggactggataatggagcagtgggagaaaagctactacataacagcaattgctggatcatccaacgggagctcattggttgtcatgtccaaaggaactccttacacccaacaatcatacaaggttagcgagtcgttcccttacaagtggatcaataagaagtggaaagaagggttccatgtgacatccatggccaccgctgggaatcgctggggcgtagtcatgtcaaggaattcatggttctctactcaggttgtagagttggatctcctgtaccccagcgagggcatccaccggcgctgggagagcggctacaggataacttncacggcagccaccaacgaccaaagccgtttcatactgagca

SEQ ID NO: 68647 - DNA, 393 bp, Zea mays
  Clone ID: LIB3076-021-Q1-K1-G5
caattccttctaccactcaaagcaacctccagtcttccaacaatcctgaaaagccagcaggtaaagcagatcctgccaaggcaaccgctaatggtgttccaaatggtactggtcacactcacagttacagtggaactgtaccaagccaacaaagttcagcactgacgcctgatggaacttatagggcgcccttgctaggtggagttccttctgctggttacctagacacgacatattatgggtatgacagcacaggggcacaatttgcatggtatgaaggctctgcttatgcaaatggacagcaaagaacaaccacaactaatcgttttccatcctcgtcattcagtggtaatgggtcatctgcaatatatcagaacaagagctccaccacgc

SEQ ID NO: 68648 - DNA, 329 bp, Zea mays
  Clone ID: LIB3076-021-Q1-K1-G6
cgtgcgcgtgaacactgtttgactgcagttttctgaacgctaccttcggggaactttggcgctgatatagagccgaaagagtcagaagagcactactctgatgctcaggaagctgtcctctcacaggctctgtcacggaaatccgcacagcactccaaaaccgatgcacgccatcacaaccatccggtgctgagccctccaggatgcatgatgaacataccttgctggcctgtctgatgacaccaacctgtacgcactgcatgctaatcatgttaccatcttgcccaaggacattcacgtggaaacgataatcccactacacacaggct

SEQ ID NO: 68649 - DNA, 320 bp, Zea mays
  Clone ID: LIB3076-021-Q1-K1-G7
cagacgcttgtaccactgaaagcaacggttcagactttcaacactggtgaaaagccagtagctaaagcagatcgctgtcatggcgaccgctaatggtgatgcaaagggtactggtgccactcacggttacagtggaactgttccaagccgacggagcttacgactgacgcccgatggaacttatatggagccgttgctaggaggcgtgacttctgctcgttacctaaaaaccacatattatggagatgaccagctcaggggcacaatgtgcatgggatgatggatctgtttatgcaaatgggcaatctagaacaaccaca

SEQ ID NO: 68650 - DNA, 375 bp, Zea mays
  Clone ID: LIB3076-021-Q1-K1-G8
attccgtatactgactctgaatctggaaagggctgagattgagtgtgagccatgctctgcggaggaagttgatcatacagacaatgaccccaacgtggtctactactggggccttatccctaaaagaatcattcatgtcgacactatctacctgaacggagatttcatggtagacctcaccaatgatgtgtacggcacggtcaactgcgcccattcagatgtcacattatctgtggctgggctgacacagctgcctaagagcatgtgcaggcaggtctatctaccggcagtacatgcaccactgtatgatgggctacgagggctcacatcaacgccatatcgagcgcacgatcgttagatcatactaccacgacc

SEQ ID NO: 68651 - DNA, 394 bp, Zea mays
  Clone ID: LIB3076-021-Q1-K1-H11
cttgtttcggctaatacgacgacaattgaggcatatgagaagaagacaactccacattggatatatgatcttggccggaagaggaattttgctcaggtttttggaaatgacagaaaatattggttcatccctgcatattcagaagaggatctgagaagaattccagctctacagggtcttgattatcctgtcagtgagaccagattttgatggccaggaattgtaatggggcaattctaacagtgtcctcgtcagatacctcagtattggacatctactcatacaactgtcagcattgctgattgccctatgcaaggcatctagtgaaatgtgcacaagatgattgtagtaatagtaaccatgagttattcatctggtgcacttcatgtatgtg

SEQ ID NO: 68652 - DNA, 323 bp, Zea mays
  Clone ID: LIB3076-021-Q1-K1-H12
cttgtttcggctaatacgacgacaattgaggcatatgagaagaagacaactccacattggatatatgatcttggccggaagaggaattttgctcaggtttttggaaatgacagaaaatattggttcatccctgcatattcagaagaggatctgagaagaattccagctctacagggtcttgattatcctgtcagtgagaccagattttgatggccaggaattgtaatggggcaattctaacagtgtcctcgtcagatacctcagtattggacatctactcatacaactgtcaacattgctgattgccctatgcaaggcatcta

SEQ ID NO: 68653 - DNA, 443 bp, Zea mays
  unsure at all n locations
  Clone ID: LIB3076-021-Q1-K1-F4
cggacgcgtgggcactggtggagtgaagtagcctcaccgctaccgccctggaactgttgccctccgtgagatccgcaagtatcagaagagcactgagctgctgatcaggaagctgcccttccagaggctcgtcagggaaattgcacaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaaatcctgnggttattgttaatctggtgccatttgtaggacatatgattaggggtatgttttgtggatcgcaagtttctcttct

SEQ ID NO: 68654 - DNA, 275 bp, Zea mays
  Clone ID: LIB3076-021-Q1-K1-D7
cttctcactaatattttctatcttaagttcaccttttaatctcatgtacctacgggcgctctagtgctagtatcgaggatatagaacacaatctcaaatttaataaagcgctctataacgccaacattcactcgcatcggcatctacgccgagaacgccatgctcaagcgcaccgagcacattaactacctccgtcttacctctcgcctagacaccctcttaacccgccttttacacgcatgcctagattcacgtcatcgtcaaatccattcaat

SEQ ID NO: 68655 - DNA, 371 bp, Zea mays
  Clone ID: LIB3076-021-Q1-K1-D8
gagaagctgatgaatcacatcttcgacctcaagttcacctacaagtcgctgcaacggcaggcgcgcaagtgcgagaaggaggacaaggagcagaagctcaaggtcaagaaggcgatcgagaagggcaacatggacggcgcccgcatctacgccgagaacgccatgcgcaagcgcaccgagcacatgaactacctacgcctcgcctctcgcctcgacgccgtcgtggcccgtctcgacacgcaggccaagatgcatgtcatcggcaagtccatgcagtccatcgtcaagtcgctcgactcctagctcgacaccgggaacctacagaagatgtccgagaccatggagcaattcgagcgccagttcgtcaacat

SEQ ID NO: 68656 - DNA, 387 bp, Zea mays
  Clone ID: LIB3076-021-Q1-K1-E1
ggtgctacacggtctgggtgcaatgtatcacactatttcgttggctgtctatgaaatctgacaaacattgtgcagacacaacagatcaggcgaagctggtggccaacgattggaagaaaatgattgacaacacaatgtgtcgaagggaacttgacacactgtgtaggggtcttctgcaattccttatcgcatataacattgtgtctgaattcaatatgcatgatatcatgagtatatttgctatggttcacaaaggttacacgaataacaacattgccaaactgtgcaaggatcttgggcttgcagacaaggccacaggtttaattgactatacgatcggaaatgggcaacatccttaaatttttcatttggtgcaaaattttaatt

SEQ ID NO: 68657 - DNA, 357 bp, Zea mays
  Clone ID: LIB3076-021-Q1-K1-E10
tcgtcttcgacggccgcaacatcgtcgacccggagttgctgagggagatcggcttcatcggctactgcatcggcaagccggtcgacgcctggcttaaggacatgcccgcggtcgcttaattcgtctgaggtgctccattggattggatccggggaaggaagaggaactggttgaccgttcttcattacagtttggtcttttgcaggattcttaaaagttggacggcgctgctagtattccatgtttcgcgtttgcatattggaggacgtctgtcgatgtataaaatcctcgggcgcttgtgctcggcttgaggaaatatccttgtacggttgtaccctggacccgctatagctggtt

SEQ ID NO: 68658 - DNA, 433 bp, Zea mays
  Clone ID: LIB3076-021-Q1-K1-E11
cccacgcgtccgggccggcggcgtcgtcgtcgtccggcgcgggcgcggcggacgcggccggtcccacagacgtgaacaaggcgctcaaggacgaccagttcagcgagttcaagcagctgctgcacgacacgcgcgtggacacgcagatcaacgcgcagctgacggacagctacaacgggctgaccatcatggcgcccaccaacgccgccttcgacaagatgaaggccggcgtgctcaacgggctgtcgccgcaggaccagatccagctcgttctctactgcgtgctgccccgcttctacagcctctccatgctcggcaccctcgacggcaaggtcaacacgcagggctccggccacgacgggccctacaggtacgaacatcagccggtcggcaacaacgtcaacgtgttcacgggcgtcaactggatgctgct

SEQ ID NO: 68659 - DNA, 388 bp, Zea mays
  unsure at all n locations
  Clone ID: LIB3076-021-Q1-K1-E12
cccacgcgtccgcctaggagagctgctggtgggtgtgtgagaaggaatgaagaccttgaggaagaggagactaatttagcaaatgaagatgacgaggatgaggaatatattcttgatgatcttgatgtggaagatgaaattgaaggaagcaatagtggaaagatggtgatgatcaaggcgtgtggatgctcatggtcttcatattgctgagttcgatgatggttgatcatgcataaaagttgtaacctatgtggttgaacttgtgctgttgaacttgatctgtttctntttatgctatttggtttgtgaactcaacttatgtatgaacttattctatatttgaatttctatgtcaagtctgaaaagacgtttcaacattcggttaaac

SEQ ID NO: 68660 - DNA, 381 bp, Zea mays
  Clone ID: LIB3076-021-Q1-K1-E2
ggcgcgcgaagccgtcaggaaatccctggttctcctgaagaacggcaagggctcctacggtccgttgctgcccctcccgaagaaggccggcaagatcctggtcgccggcagccacgccaacgacctgggcaaccagtgcggggggtggacgatcacgtggcaaggaagcagcggcaacaccactgccggcacgacgatcctctccgggatcgaggccaccgtggaccccagcacgcaggtggtgtactcggagagcccggacagcggcgtgctggccgacaagtacgactacgcgatcgtggtggtcggggagccgtcatacgcggagacgttcggcgacaacctgaacctgacgatcccggcgcccgggccgagcgtgat

SEQ ID NO: 68661 - DNA, 275 bp, Zea mays
  Clone ID: LIB3076-021-Q1-K1-E3
ggacgtactccgtccgtccgctacggttctcactatttcctctcgaggctacgagaccgggtactctttgggtcatcccacgatggtacgctactctgggctcggaggaccggagagaaacgctcgccgacatggtgtgcagcgcctatctggacatgaagtgtatgactcttctcgactgcgtcatcggctataacagtgtgcccatattctacatcagtgacatgatcaccacagactacatacctacgatgtgctacaatatcagcgccaat

SEQ ID NO: 68662 - DNA, 455 bp, Zea mays
  Clone ID: LIB3076-021-Q1-K1-E4
agaacaccgtgctccgggcccgcgccgccgagctcggcgaccgcctccggtccgtcaacgaggtgctccgcctcgtcgaggagttcagcggcgtcgccatggacatccaggaggagatgccggcggacgacccgctgctgcgtccctggcagctgccctacccggctgccgccatgcccatcggcgccccgcacatgctccactactgatgattgcctccaccaaccacaccaccatacatctgaggctgtcagctggggctggttggcaacaagacaagaagaattggctgcctctcaacaacattcacatctactacctacctggctgctttgagaattacagggcctctactatctgctgctgtgttaaatctacctcctggtttctccaataattgtcgctggtctgtactcttctcttatgttctgtctgtcagtgtgtatgagatgatg

SEQ ID NO: 68663 - DNA, 436 bp, Zea mays
  Clone ID: LIB3076-021-Q1-K1-E6
gaacgtactccgtccctcccctcccctcccctccccttcccctcgaggctccaggaccggctcctcgcctgctcatccgccgctgctccccttctctgggctcggagaaccggagagaagcgcgcgcggccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcaggaagattacaaccgcctgaagcctctaagctaccgaggtgcagatgttttcgtgcttgcattctcacttgtgagccgagctagctatgagaatatcatgaagaagtg

SEQ ID NO: 68664 - DNA, 419 bp, Zea mays
  Clone ID: LIB3076-021-Q1-K1-E7
cggacgcgtgggtggcggccgcatctggctggcgtcgcgggccaactccaccgactgcaggcgcttcctgcagtggcccatcatcgtggtggggctcgtcctcatggtcgtctccctcatgggcttagccggcgcctgctaccgccagacctggctgctccgcctctacctcttcgccatgttcttcgtcgtcctcgcgctcctcttcttcgtcgtcttcgccttcgccgtcaccgaccgcggcgccggccaggtcgtcatgagccgccgcttccccgagtaccagctctccgactacggcggatggctccgcgaccgcgtcgccgacccgcagtactgggccaccatcagcgcctgcctccgcgacggccacgcctgcgccggcatgaagcgcctcgcgcgggaccccaacacgggca

SEQ ID NO: 68665 - DNA, 445 bp, Zea mays
  Clone ID: LIB3076-021-Q1-K1-E8
aattaagagaattgaatttgactaaaatagtttcattagctcctgaagtattataaatactagtagacgagatatagatcaaagaaaaaattagtagattttgtctcacgtatatgcttaaaaatcctaaatttaaagaaaagggaaaacatgttgattatagaaaaattaggaggaacctagaattagagtcttatgggcaaggacactattgctgatttactaacctctataagaaacgcatacatgaataaaaaaggaactgttcgagtagtatccacaaatattaccgaaaacattgttaaaatacttctacgagagggttttattgaaagtgttcggaaacatcaagaaagtaacaaatatttcttgggtttaactttgcgacatcaaaagagaaagactagaaagggaatatatagaactagaacctttttaaagcgta

SEQ ID NO: 68666 - DNA, 430 bp, Zea mays
  Clone ID: LIB3076-021-Q1-K1-F11
ctcctcgcattttccttgcaaccgattgcctatccccctcccaaccaaagaccgatggcgcccaaggccgagaagaagcccgcggcgaagaagccggtggaggaggagcccgcggccgagaagacgaccgccgggaagaagcccaaggcggagaagcgggtccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaagcccaccatcaccttccgcgagatccagaccttcgtgcgcc

SEQ ID NO: 68667 - DNA, 189 bp, Zea mays
  Clone ID: LIB3076-021-Q1-K1-F12
ctcctcgcattgtccttgcatccgattgtctatctttcttccaaccaaagaccgatggcgcccagggccgttaagaagcgcgtggggatgaagccggtggaggaggagcccgcggtcgatatgacgaccgccgggaagaagcccatggctgataagcgggttctcgttggcatgttcgtcggctaggat

SEQ ID NO: 68668 - DNA, 203 bp, Zea mays
  Clone ID: LIB3076-021-Q1-K1-F2
cccacgcgtccgtccacgcgtccgccgattcgctcgtcgacccaattcggtccactaaggacggtttctggattgacacggaattcacttggggctccatgtacatgcagaatgatataccggcttactacatgcttgttactgcctgacatgtattctacacgtgtacctctatgcccatctgtgctaagtacttgctctac

SEQ ID NO: 68669 - DNA, 450 bp, Zea mays
  Clone ID: LIB3076-021-Q1-K1-F3
caaatatctggctgcaccagattgacatcccttaatagttttgtgaagcctacggtagaaagaattgtaactttcaaagacaatgaagacccttctcttgtggaacttctgtttcagtttggtcgttatctactcatttcgtgctcaaggcctggaacccaaatttccaatctacaagggatatggagcaatgacacttcaccaccatgggatgcagcaccccatccaaatataaatctacaaatgaattattggcctgcgcttccttgtaatcttagcgagtgccaagaaccactgtttgactttattggttccctctcaatcaatggagctaagactgcaaaagtgaattatgaggctagtggttgggtcagtcatcaagtcacagacttatgggcaaaaacatcaccagatgctggtgatcctgtatgggctctatggccaatgggt

SEQ ID NO: 68670 - DNA, 407 bp, Zea mays
  unsure at all n locations
  Clone ID: LIB3076-021-Q1-K1-D6
cggacgcgtgggctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccaaactggtgcttggaagcacgttccccgtgcaatcttcngtgatctagaacccactgtgatcgatgaagtgcgcactggcacgta

SEQ ID NO: 68671 - DNA, 453 bp, Zea mays
  unsure at all n locations
  Clone ID: LIB3076-001-Q1-K1-F3
taaccctcgttcctgtcgcgcagccacgacctccacttccacatcttccccggcggcggcgcggtcagttgaaccatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcctcatctacgacaacctcgaggctgccaagaagttcgagccgaaataccgnctcatcaagaatggtcttgctactaaggttgagaagtcccgcaagcaaatgaaggagcggaagaacagggccaagaagatccgtggtgtc

SEQ ID NO: 68672 - DNA, 194 bp, Zea mays
  Clone ID: LIB3076-001-Q1-K1-G2
cgcgtccggcgcttatatggggactaacgcccatggatgaactaagctgcataactgcgacatatgtatgggtctaaggcacaccacatggggcacattgactaaaatatacgtcttactgtttgaaacataaggaggaagagaagagaagactaggctgtgtgcaaccaaagggctgctaacggctagggcac

SEQ ID NO: 68673 - DNA, 393 bp, Zea mays
  Clone ID: LIB3076-001-Q1-K1-H4
gtacggcaactcgtgaaaagggctgagatggctggcttcaaggccattgcactcacggtggacactccaatacttggccgcagggaagctgacattaagaacaggttcgccttacctccacatctggtgttgaaaaacttccaagcgctggatcttggcacgatggacaagacaaatgattccggccttgcttcctacgttgctggtcaagttgaccgcaccctttcctggaaggacgtcaagtggctgcagacaattacctcgttgccgatcctagtcaaagggatcgtgactgcagaagacactaagcttgcgatcgaatatggcgcctctgggatcatcgtgtcaaccacggcgcgcgccagctagattatgttcctgcgactatcaact

SEQ ID NO: 68674 - DNA, 210 bp, Zea mays
  Clone ID: LIB3076-004-Q1-K1-B8
aaaaaaaaaaaaacacaaaaaaaacaaaaatttaaattaaaaaaaataaaaaaaaaaaaaagggaagggaaaaataaaaaaataggaaggacttaaaaaaaaaaaaaaaaacataaaaaaaataaaggggctgccgttttaaaggacccaattttactttcccttcctttccacttttattctcttttataggtccccctaattcaattt

SEQ ID NO: 68675 - DNA, 311 bp, Zea mays
  unsure at all n locations
  Clone ID: LIB3076-004-Q1-K1-B9
cccacgcgttcggtcgccatggtcgccggcgggttccgcgaagcgacgcctggagcggaccttccacccttcccgcgtgtccgtctcctcgccctcgccctcgccctacccccgcagacgctgcgccctcgcaagccgcttccaggagccggcggccccgcggcggcacgcatggggttccctccagggtcgccttatcggtgccgaggaggcgtcgtgtgccgcttcagctgcaccgggcctnctcccggatgaagcggtagcgtgggagctcttcagcccgctccatcgtgtgcttctcgtcgccaccg

SEQ ID NO: 68676 - DNA, 73 bp, Zea mays
  Clone ID: LIB3076-004-Q1-K1-C7
tatgttcagagtgttatgttgtaatgaacagtgttatgttgtaatgaacgcatgcaagccatgagtgatagct

SEQ ID NO: 68677 - DNA, 87 bp, Zea mays
  Clone ID: LIB3076-004-Q1-K1-D5
tatgttcagagtgttatgttgtcatgaactttgttatgttgtaatgaacgcatgcaagggatgagtgactggtcgacggtggtcggg

SEQ ID NO: 68678 - DNA, 79 bp, Zea mays
  Clone ID: LIB3076-004-Q1-K1-D6
tatgttcagagtgatattttgtaatgaactttgattatctcgtaatgaactcatatattggatcagttatagctgatat

SEQ ID NO: 68679 - DNA, 262 bp, Zea mays
  Clone ID: LIB3076-005-Q1-K1-B11
gaatttccgtctcgacccacgcttgctcccactcgtccgtccactcgtccatcctctttcttttttactatctctagctctcactgtggatctggtctataccaactgcgttcggtcataaaaatctcacttatttgttgtcccctcctctttttttctctgttcttgcttgatttcattatcttattttcttctttaatttatcctgtcattaattttttatcatttctatattatcttctattttcttttcttgttctat

SEQ ID NO: 68680 - DNA, 193 bp, Zea mays
  Clone ID: LIB3076-005-Q1-K1-F7
attccggcgcacgacgagctcactagtacatcaagctctctagactatcctatactttttacacatacataccacgatctcgggaaggtatagtatatactggggccggttaactagccttatctgtacagcacagagacttggaaaacacacatgcttcaacacataatggtgtggcattcattgattcata

SEQ ID NO: 68681 - DNA, 283 bp, Zea mays
  Clone ID: LIB3076-005-Q1-K1-G4
taatgctagccagccaactaagatttgaaattgcatacagagattctgatatatgaagcgtgcgtgattttggaagctatgacggcacttagatgctgtgaggacttctctatggagcgattagagttattgggggactctgttcttaagtatgcagtgagtgcccatcttttcatgacatttcttaataagcatgagggacagttatcgtccagaaggcaagaaacaatatgtaatgccacactttataggcttggtattgaacgcaagatacagggttaca

SEQ ID NO: 68682 - DNA, 433 bp, Zea mays
  Clone ID: LIB3076-005-Q1-K1-G8
taatgctagccagccaactaagaagtgaaattgcatacagagattctgatatatcaagcttcgtgattttggaagctatgacaacacttagatgctgtgaggacttctctatggagcgattagagttattgggggactctgttcttaagtatgcagtgagtgcccatcttttcatgacatttcttaataagcatgagggacagttatcgtccagaaggcaagaaacaatatgtaatgccacactttataggcttggtattgaacgcaggatacagggttacatacgtgatgctgcatttgatcctcgtcgatggcttgctcctggacagctgtccagacgtccttgtccttgtgaatgcccagtaaattctgaagttgtaactgaggatattcataggattgatgacaagtctataattataggcaaggcgtg

SEQ ID NO: 68683 - DNA, 314 bp, Zea mays
  Clone ID: LIB3076-005-Q1-K1-H6
taggctatagctagcctctcggagttcaatgtcagccagtactctacctatgatgacaacgtgccaattgacagggtggcagagcaaatccatgaggaaccatggaagatggcctaccagactggattcagaatcttagttgcatatggtggtgcacctataactaaccatctgagagagttagagagatgcttggaaatcttcgtcataactacttatctcttctataatcttattactagacctcgagtcttaatctacttgtttatgagtttatctcctgatgcaacctgatcaatgctttatactgagta

SEQ ID NO: 68684 - DNA, 91 bp, Zea mays
  Clone ID: LIB3076-006-Q1-K1-B7
cccacgcgtccgcggacgcgtgggcgaaaaaaaaccctccgacttcgatagcaatccatttcttgaaacgatatagctataagctgcagcc

SEQ ID NO: 68685 - DNA, 83 bp, Zea mays
  Clone ID: LIB3076-007-Q1-K1-B6
cccacgcgtacgcgaacacgtctgataaaagagcataatagaaagcgaaaaatttcaggtgcgtgtcacctaaattcagttgg

SEQ ID NO: 68686 - DNA, 305 bp, Zea mays
  Clone ID: LIB3076-007-Q1-K1-F1
gaacatgggagaagagtatttgtttgagaattaacaaggttatagtttcacctcatcaaaaaaggtaattcttcctcaaagggcagtaaaccaaattaaaatgtcactgcgaatccttattttggggtgtggggtggggggacggaggagagaaacatccttctgcaaggcagggtctcctgcacgtaagttcttgataacacaggataaaaagcacatcacgttgacctccaaaagttaaattttgcgttgcctgtagaccccttatgatgcagattccttggcaatcttctctgccttggcga

SEQ ID NO: 68687 - DNA, 206 bp, Zea mays
  Clone ID: LIB3076-009-Q1-K1-G10
cggacgcgtgggcgagattgcgaacaagatgaaggaggagcgagacaggatgttgagggatagagcagcacgtgagcggtagtcgtagcagcaggtattggttcgactggccgactgggtgttgtcgtttacgacatgggccaactggcgtcataaataatggttgttggagattgatatggcaaatatgaaactcgtgtttttgt

SEQ ID NO: 68688 - DNA, 371 bp, Zea mays
  Clone ID: LIB3076-009-Q1-K1-G9
tatggtttcaccttcaagtgtgatgagagatctgaaaaaagacgagagttctattcgaagcttgaggagaagattcatgcaagagagttagaaataagcaatttgcaagccaagtcaaaggaaactgaagaagcagaactcaaaatgctgagaaagagtttgaatttcaaggcaacaccaatgccaagcttttataaggaaccaacccctgccaaggttgaattgaaaaagatccccccaaccagagctaaatcaccaaagcttggtcggtctaaaaacaagtccatatcagagactgaagaaaatactactacggaccaacctgcccgtctgagccttgacgaaaaggtttcttaaaacggtgtgaaaaa

SEQ ID NO: 68689 - DNA, 55 bp, Zea mays
  Clone ID: LIB3076-012-Q1-K1-B7
ggtggcactttttcgggaaaatgtccccggaacccctattggtgaatttttctaa

SEQ ID NO: 68690 - DNA, 381 bp, Zea mays
  Clone ID: LIB3076-014-Q1-K1-A2
acgcgatccaccgcccggagccgcacatcatgctgttccgccgcccgatcaactaccagcagcagcaggaggcggctgccgcgcagatgctggccaagtgagcccctggtggccagggcggcgaccaggaacgtttaaaaccctaaccccctttccatctctagaaggggcgtcgctgttctgttgatcaattcctctatgctgttagttggaaacttcgggtgtagttggtggatttgctggtgtgtgccttgtgttcgtggaaattcctgtgaaggaactgccatgtgttaggctgttaccatgcccattttcttaatactatgtgttgactgtgatcaagaaaaaatagagaaagatagcacaagatcaaggaaagat

SEQ ID NO: 68691 - DNA, 448 bp, Zea mays
  Clone ID: LIB3076-014-Q1-K1-H8
aagcgagcagatcctcctccctttctgcttcctggcctcctctctgcctccccgcgccgatctcgagcacctggggagaccgcgaggcgtgcgcctgatttttctcatcgcagcagccctcaagttccccacctcttttttcttgcagctttcaattaatctgatcatctacagccatctttattttactttcattttgcctttaatctgtttagttccattgcagcttctgcggttgcggttagtattgctgtttcttgctccttgtttcttgttcttttgcttctaaccatggacgcaggaacctactccatctcatcagagaagagccacacggcggcagcggcgcggccccctcttcaggaggccggcactcggccctacatgccgtcgctgagcacaggatcgcgcaacccgtcggccaagtgctacggcgataggttcattc

SEQ ID NO: 68692 - DNA, 454 bp, Zea mays
  unsure at all n locations
  Clone ID: LIB3076-014-Q1-K1-H9
tatctatttaactatagtgagaaaaaaaagttccgaacaaagaatccatggtggtggaatgtcggatcaatataagtggcggagttgggatttgttcttggtgcaaaagcaagagcaaaagatcacctctatccgtatcctagctttggtggtccgcagaacaggtggttaagaatagggagaaacaagggttaggtggcagaggaggcagtgaaatccggccaaatctcgacgcaacttttcttgccgattgttggtgcgtagtaagatcctagttgaatccgtaggacgggcgctaatcggaggaacttgcatcgattcttgcgtgctgacggtaccggcaaggcggcaagataagagttggtgcctgccgattgcagggacagggacggtgtttgtggaattgcctncttggaggangctggtgagagggagaaaggatgacgatgccatg

SEQ ID NO: 68693 - DNA, 330 bp, Zea mays
  Clone ID: LIB3076-015-Q1-K1-C3
agaagagcacggagctgctcatccggaagctgcccttccagcggctggtgcgggagatcgcgcaggacttcaagaccgacctccggttccagtcctccgccgtcgccgcgctgcaggaggccgccgaggcgtacctggtgggtctcttcgaggacaccaacctctgcgccatccatgccaagagggtcaccatcatgcctaaggacatccagctcgcgcgccgcatcaggggcgagagggcctgattgctgctctgtcttcctgtttctgtagtgtctgaactaggggatggaatctatcgcttcttgtccaaaaaaaaaactgatacat

SEQ ID NO: 68694 - DNA, 438 bp, Zea mays
  Clone ID: LIB3076-015-Q1-K1-D9
tagagacatggcatgttcaggtgtttcggtctattgattcaaactctgtcaagggatttgggaaggatccacgagcagcgaccatgaagaatcttgtttgtggaaagaatgtacttattgacatgatcatacatacggcttatgtgcatgctatccggtcagcccaacattctatttatattgagaattactacttaattggttcttcatttaattgggattcaaacacggacttacgggctaacaatttaattccaattgaaattgctctccaaattgcaaataagattaaggcaaatgaaagggtttctgcatacatagtggtacctatgtgacctgagggtaatgcatctggggcttgaacacaacgaattctttactggcaggatgaaaccatgcttatgatgtacgagacaatatactggaccttgagagaag

SEQ ID NO: 68695 - DNA, 380 bp, Zea mays
  Clone ID: LIB3076-015-Q1-K1-G4
cggacgcgtgggctcatcaccagacgtttttccatggttgaaaccgtgatcgggcgacccgaacagcaacaagaaagtgatactctttatcagtcagtcaagctgaatattttcaaaattttcagaccaaacagtgataagcatgctactgctggacagtcgccctaattgtctgtcctgcggaattgtttctgggagtgtgtattgttaagtcggttttctccgagttatacgagacatatggcttgagttgtgtcaccaatatgcttatgccataggactatcagagtttacttttaatttcagagaacataatttccatcaatttcagtaggttcatttttaatgaaaaaaaaaatataattatttattaaattaat

SEQ ID NO: 68696 - DNA, 343 bp, Zea mays
  Clone ID: LIB3076-017-Q1-K1-C7
atggaaatatggcaaattgttctattcctctgccgacccccatcctttttgattcttttcatccgacaaatgttcactgccccaaggcaatccttgcttatatagttcattgcaaactgaaggagcaaaagtacaaaacatacgagaggctctctcatctctacggcgtatgtgaatgccttgttccctctctacctacaccagcaccccccctggactctatggtcttgcatgaactggattgcagcgctggctctcgggacgctgactgttattttttttggctttatggaccaagtagtgtgcgtattttagtgtccattcagcaactacttgcttaacc

SEQ ID NO: 68697 - DNA, 171 bp, Zea mays
  Clone ID: LIB3076-018-Q1-K1-D11
atgttcgaaggcaggccacggcgtgtattgatgcaacttctatttctgtgttgattaaatggcgcggtgtacatgttggggctcctaagttgttcttagaatgctatatcctataactatattcttcttatccacagggtatgctatatctgaagctaaaaacataaagcc

SEQ ID NO: 68698 - DNA, 343 bp, Zea mays
  Clone ID: LIB3076-019-Q1-K1-F3
ggagttcgttgaggagtcacagagaaagtttggtgctactggtgaggcaaaggtttccttccagggttcgtcaggaacgaggcgtgtcgcaatctgaagcctttcgtcggttccgtctagctgcccccctctgattcggccatggagcggcagtccagcatccggctggtcgcgctggagaagctgaggagcttccgggggatggagaagcagaagagcttccgcgggatcatgtccctggagcggctgaacaaggacagcccggtgaaacgcggcgacacgccgctccacctcgcggcgagggccggtagcgtggcccacgtgcagaagatcctcgcggagc

SEQ ID NO: 68699 - DNA, 384 bp, Zea mays
  Clone ID: LIB3076-019-Q1-K1-G2
atgtttatatatatagatataggattattccattacaaaataaatccaagacataatctaaaaattaccacatcaaaacacaaaccggaactacattgaaatctaaccgattttagactaaaaaccggcttatcgggatcctaaaacataggtgttagtgtgttacagagaccgaactagccggttcacacatctggcaaggcctgttttcacctactagccttattttcttattgcagactctaaacatcatgatgcattaaccctagatggaggtccttgggcatgcccatacattttttccccatattcatgccgtcggatgccgtagatgccgcatatagcatcaatgcaactattacatagaggaattaactacacgta

SEQ ID NO: 68700 - DNA, 333 bp, Zea mays
  Clone ID: LIB3076-020-Q1-K1-A8
gagaggccatgtatgcgcacaactaattttatcggcgggaagatacacccacaatcgcgcagattttcccgccaccacgtgtgcaacacgcctccactaccgcaccacaaaaccccgcaccactaagtactcctataaatgcctacgagcgtgcaggcactaacactaccaatcaggacaagactcgaagcccgcacaacgaaacgcgatttacagcagctaaagctcctgtggacattatgatcatgcgcctcctcctgtcaattctcgaagtgcaaccccaagccacgagcagacactgctccacagacacaccttccttggttctctccc

SEQ ID NO: 68701 - DNA, 343 bp, Zea mays
  Clone ID: LIB3076-021-Q1-K1-H2
tatggtttcaccttcaagtgtgatgagagatctgaaaaaagacgagagttctattcgaagcttgaggagaagattcatgcaagagagttagaaataagcaatttgcaagccaagtcaaaggaaactgaagaagcagaactcaaaatgctgagaaagagtttgaatttcaaggcaacaccaatgccaagcttttataaggaaccaacccctgccaaggttgaattgaaaaagatccccccaaccagagctaaatcaccaaagcttggtcggtctaaaaacaagtccatatcagagactgaagaaaatactactacggaccaacctgtccgtctgagccttgacg

SEQ ID NO: 68702 - DNA, 280 bp, Zea mays
  Clone ID: LIB3076-024-Q1-K1-H3
aaaaaaaatacaaacataaatagaatctaattttattttaaaatatactaaaaaatgctcagtggatgtttaatttccctacttactttactcaagcattcgacatgaatagcacactattagggaacctaaattcaacactcttgccgaagcttaacaaccatgtgactggaaaaaccctaacattatcaaagttaatcgtctagaagcacatcaccctttttctaactctcgcaataacgattaaaccctcactgatcgcctttcccaacattatgct

SEQ ID NO: 68703 - DNA, 195 bp, Zea mays
  Clone ID: LIB3076-027-Q1-K1-D6
acccctatttatttatttatctaaatacattcaaatatatatccactcataatacaataacccttataaattcttcaataatatttaaaaactaatactatcaatattcaacatttccatatctcccttattccctttttttcttcattttgccttcctttttttactcacccaaaaactctatttaaattaaaa

SEQ ID NO: 68704 - DNA, 273 bp, Zea mays
  Clone ID: LIB3076-027-Q1-K1-F8
gctaaggtatgccgttccggaaaaattatcatttgaccaaacttgtaggtaccttacaaaaaaactgaacaagagctcaagtccacgacgttatgtgtcaaactctttatacaactacagcatagtttgacatggttactctttttacaaccaatgcatagtggtcgtggtgttgcttggccatggcccttcaccaattgggcccttccccctcataacagttaccaacgcacctttgcgttccatctcctggataaatcgcttcacttttgg

SEQ ID NO: 68705 - DNA, 458 bp, Zea mays
  unsure at all n locations
  Clone ID: LIB3076-029-Q1-K1-F12
taccaaccttccggatccagtgccgcacgcctcactcaccgtccgcgacacccatgacacgcatgaggcggaagcacgccggcgccgccgacgccgacgtctagggttcctatcccttccatatggattccctgccgcggaagcgcaagggcgcgcgcgccgagtgctcgctggccggatgccgccacgatgcgcctggcggccgcaagcgcacctgcccgtagcccaagccgtggcccgagaagaagaagccctcttccgtcgatgagggctccgacttcgttcgcggctgcgtggctatgactgatgcngtgcgggtgcggccgggaaatcacaggccgaaccgaactgctgaatgaaagagaccactcacgctgctgctgtgtcaggtcagcgacgagacttttgctccagctgccggggaccatccaaaaccagccattatagatcaaatcaag

SEQ ID NO: 68706 - DNA, 190 bp, Zea mays
  Clone ID: LIB3076-030-Q1-K1-C3
agttaactatcaagatcgcgcgccccacacacctacaccactaccttcaaatactaaatcacccccttcaacacctaccacacctacacacgcaaccattatctcaatccacaacctacatcagtcaaccatccacatccactataccaacaccgcaaataacctagctgtaattaacttcactgcaaca

SEQ ID NO: 68707 - DNA, 296 bp, Zea mays
  Clone ID: LIB3076-031-Q1-K1-B1
gaggcaacgcgtccggtcagaaggtaccaggtggctctgcagtcaagcctataccatcttcagcaggtcctagtggaagaggaccgcacatgaataggggtggttctgctcctgaagctcaagctcagaatgtcgatccattgattggtcgtaaagtgatgagtcggtggcctgaagacaatagtttctatgaagcaggcatatacgaatatgatgctgaaacgggccttcatgcactggtttatgacatcgataccgcagatgaaacctgggagtgggttgatcttaaaaaagat

SEQ ID NO: 68708 - DNA, 397 bp, Zea mays
  Clone ID: LIB3076-033-Q1-K1-H12
aagaacatgggtattcctccacgtcttgtacatccattccatcccagtctgtccaggcgtaacatgtagtactaccactactaacaatctgacccttttttttctcaacacaacaaccaagtgagtaagtatcacacacaacacgcacgcacgcaccccctgccctcaacatacaccacttgcttgtaggcagagggaacaacacgcaacactcagatcagacgactaatagagagaccgagcgaccaatcagcaacgcttcacgcctgctgctccaggtagctttccatgtccggagcaaggggggaggttgagcaaatggtgaaaatttcaaggaggaccatcatatatatataatataacccttgtcaaaagcgacccctaaaaagaaaggaag

SEQ ID NO: 68709 - DNA, 442 bp, Zea mays
  unsure at all n locations
  Clone ID: LIB3076-035-Q1-K1-F10
ggaataccggggccgacccactcatacatctatcgtgccccttgttttgcatttaattttttaaaaaaaaaaaaaaaaaaaaagggaaagttaaatttaaaaaaaggaaaggaacaaaaaaaaatcataaaaaaaaaaaaataataaaattggccgccccctttaaataatccaaccttacttccccttccatccaactttttatctcttctattattccccctaaattcaattcacttcccgcctttttacaacttccttaacttaaaaaaccctttctttccccaactaaatccccttacaacacatccccctttccccaacttcctttttaactaaaaaccccataccatattctcttccaaaaatttccncatccttaatttttatatttaacccccccttttttcttccccttttatcccctccttttttttttttt

SEQ ID NO: 68710 - DNA, 366 bp, Zea mays
  Clone ID: LIB3076-035-Q1-K1-G1
attgccaagcgcccaatcgatttgtactcccaaaacacaagcgaggcagcccattccagcatgcatcgctaagccattttgcatagcgtttaaagcatctgagcaggacgtgatcaacagaagataaagacaacagctacctatataggaccatgtggttatttcttatttgaacagttcggtaagcatggcaggcagcaaagggggggttcgcaaaagcagcagcaggactcgtagcgatctctgaaggacacggcacttgtcaaggcaatggaaccaaagcgcttgctaaaccatccacgcatgatggtagcaaccgcccggcgcttgctctggctgctggttcatgtccataatatggtatgt

SEQ ID NO: 68711 - DNA, 264 bp, Zea mays
  Clone ID: LIB3076-036-Q1-K1-C7
tgcagctgcaagaagcactgctggtggagcgccttttcgagcgattactgttagagatagagatggggatctgcctaaagtgggtaatggtgccagcaaactcacgcttgagtatggatgtgatcctgtgtcttggtttcgtaagaagatatgagggaatatgtatggtactgaatgatcacatatctaaggagatgaatgagctgaacctaataaggtgtcaacacattccgaaactgtcagtttgtgattggcatgacctac

SEQ ID NO: 68712 - DNA, 231 bp, Zea mays
  Clone ID: LIB3076-038-Q1-K1-H1
cccacgcgtccgcccacgcgtccgttgcaacccctgctatggatgtcacatggatgttgagtgttgctcggtttgcgtggatcatgtagttctatactgagacgggttatggttttttttaaaaaaattggttaaggatgtaacaaacagagaatttgatgtgttatcaggctatgacaaacagatcctacatatacacataataaaaaaaatatatattattcttaatat

SEQ ID NO: 68713 - DNA, 213 bp, Zea mays
  Clone ID: LIB3076-041-Q1-K1-E8
cgatccacattcactccacacgtttcggttgatttaaacagaaccaacaaggttttcactgatgacaatggttactgctacatggtaataacaatcattaaattgaaaacagagacctttaaagcagagcggaataatcccttgaaagtcacgacatgattacattgcaggggaacgaaaccaaaccaaattttacgcacgcgcgcaacgcaa

SEQ ID NO: 68714 - DNA, 287 bp, Zea mays
  Clone ID: LIB3076-045-Q1-K1-A9
cggacgcgtgggattgcaacagattttgatgcattcactcttaacacatacaacacagggatcatcaaaattcatacaggtcacaacaatgtacagctacatctactaactcatgggtgtatatatatatgacagtggtaccagatcaaacatgtacgttgttgtgacctgtatgaattttgatgatggctgtgttgtttgtgttaagagtgaattgcaacagattttgatgcattcaatgcaacttaataccttgaagaaaaaatggcgtaataaggaaaaggccc

SEQ ID NO: 68715 - DNA, 356 bp, Zea mays
  unsure at all n locations
  Clone ID: LIB3076-046-Q1-K1-C4
ggaaaacccgggccgacccacgcgtacgattgatgatgctgttgggacgctggcgggttcaaggtactatgacaaagatgttgtcgggggtgtgatatttggcactggcgcaaacgcancatatgttgagaaggcaaatgctattccaaaatgggagggtgagctgccccattcaggagacatggtcatcaacatggaatggggtaacttcttctcatctcatctccccatcactgaatatgatcaagaattagataaggagagcttaaatccaggagaacagatttacgagaagttaacgtcaggaatgtatttaggtgaaattgtaaggagggtgctccttaaaatatcattgc

SEQ ID NO: 68716 - DNA, 431 bp, Zea mays
  Clone ID: LIB3076-046-Q1-K1-E3
ggaagagcattttctgctggaggtgatgtttctgcttttgtctgatgtatacataaaggtgtttacgtctttacctagtatgtgcaggatctaacattgaaagctggtttcttacatattttgcgtcgtcatctgttacctgacttttagtacatatgctatatgtaagcatatgctagctctgctatgtgtttgattcttaaatcagtcagctagaaatatggtgctgatttcttctgaaatgaatatttgttgaattacacaattgcaagttatacctaaacctcaggtgagcttcatcccttcattgtggttaattgtaattattcacttctgtgctccttgccccttaaggataaataatttaactgtaggtttctcttcttacttgaatttgtcatgggtttaggtgcctgtgtttctttacattg

SEQ ID NO: 68717 - DNA, 327 bp, Zea mays
  Clone ID: LIB3076-047-Q1-K1-A9
tattctggcaattgatgagtcaaatgcaacatgtggaaagaggttatcatctattggttgggacaacacagaagtgaagcgccaggcttacaggcagcttttgctgacaactgctggtcttggtgaatatatttctggcgctattcttttcgaggagaccctttatcaatcaactacagacggcaagaagtttgttgactgcttgaaggatcagaatatcatgcctggcatcaaggttgacaagggtttggttccattgcctggatccaacaatgaatcatggtgccaaggtcttgatggtttggcttcaaggtgtgctgagtacta

SEQ ID NO: 68718 - DNA, 366 bp, Zea mays
  Clone ID: LIB3076-047-Q1-K1-B3
gcagaaaaggttttcactgccaaacaatgcacaagccgaattttacatgccatggtatccttctccgtacaaatcgaaagaaattggcaccaaaattatgtacttgcggggtgtctatctaccattcactcactcactcacgccaagaagaaggatgcagttttggagcagaacgcaacgcaacagctacctacctaccttttgcagttcaccgtggcgcgggcgctacacttggctctccaggtccagctgccggccggaggacccggccaccaccttggcgccggccttgggcgcctgctgcggcggcgggagcacggtgcgcgcgcggcagacggggcaggtggcgcgcgcgcagagccaagc

SEQ ID NO: 68719 - DNA, 181 bp, Zea mays
  Clone ID: LIB3076-048-Q1-E1-F1
ccgaagctacctcataataatataattttgagacagaattcccgtccgaattctatcactgcgagcagaggtgattccttctctccaaaggggaaaaacgggatatatataaatacatcctttggtcggcggtaatataaactacaagtggaatcatatgcaatacaaatgcacgattttt

SEQ ID NO: 68720 - DNA, 299 bp, Zea mays
  Clone ID: LIB3076-049-Q1-K1-A10
tattctggcaattgatgagtcaaatgcaacttgtggaaagaggttatcatctattggttgggacaacacagaagttaaccgacaggcttacaggctgcttttgctgacaactgctggtcttggtgaatatatatctggcgctattcttttctaggagaccctttatcaatcaactacagactgcatgaagtttgttgactgcttgaaggatcagaatatcatgcctggcatcaaggttgacaagggtttggttccattgcctggatccaacattgaatcatggtgccaaggtcttgatg

SEQ ID NO: 68721 - DNA, 361 bp, Zea mays
  Clone ID: LIB3076-049-Q1-K1-A9
tattctggcaattgatgagtcaaatgcaacatgtggaaagaggttatcatctattggtttggacaacacagaagtgaaccgccaggcttacaggcagcttttgctgacaactgctggtcttggtgaatatatttctggcgctattcttttcgaggagaccctttatcaatcaactacagacggcaagaagtttgttgactgcttgaaggatcagaatatcatgcctggcatcaaggttgacaagggtttggttccattgcctggatccaacaatgaatcatggtgccaaggtcttgatggtttggcttcaaggtgtgctgagtactataagcagggggcgcgcttcgcaaagtggaggact

SEQ ID NO: 68722 - DNA, 368 bp, Zea mays
  Clone ID: LIB3076-049-Q1-K1-E10
taaagaatatgaacgtgttagggctggcaaacctccttttatgctagatatgtctcgctatggtttggagccacctccaatgaacaagaggaatgatgttggcgcttggaggcaggctctacggaatgctcagagccagttgcagcatcaaattataaggatagagaatctcgagcttatgctgaaatatggcgtagatgtttggaagctccagaacagacaaatggaatcagttctgtctaggatgcaaaagatggctgtagaatacaatgaaaggatagaaaatgtcaatcgagagaggaagttccaccagcaaaatactggaggacagctgcatgccctgaaaatggaatggcaagagctgtgtc

SEQ ID NO: 68723 - DNA, 429 bp, Zea mays
  unsure at all n locations
  Clone ID: LIB3076-052-Q1-E1-D11
cccacgcgtccgacaccctgccaccaacgacaggtaccttcttcgggcccttctcaccatttcctcatttaagccccgtgtgccttgctcctcggtgtttcctccagatagtagtgtttcctcagtggactagtgtgaagctgtgcttagcgtagcggaagggaggaaggacaaggcaaggcaactgatggcggcgggcggcggaggcggctcggcggcgccgttcgtgtggaagacgtacacgatggtggaggaccccgggacggcaggggtgatcggctggggcagcggcaacaacagcttcgtcgtcgccgaccccttcgtcttctcgcagacgctgctccccgcgcacttcaagcacaacaacttcttcagcttcgtcncgcagctcaacacctatgtcagttanatcacacactcgagctagct

SEQ ID NO: 68724 - DNA, 309 bp, Zea mays
  Clone ID: LIB3076-052-Q1-E1-E1
agtgaaaatgggttgtttttattaatttattatcccacgcgtccgcggacgcgtgggaaaaaaaaaaaaaaaaaaaaaaaaaaaaaaaaaaaaaaaaaaaaaaaaaaaaaaaaaaaaaaaaaaaaaaaaaaaaaaaaaaagggggggcggcccaaaaggaacaaacctaaattacgcgtgcaagcaacgtaaaagcccttcaaaagggtcaccaaaataaaattcacgggccgtcgtttaaaaacgtcgggacgggaaaaacccgggggtaacccaactaaaacgccttggaaaaaaaccccctttccc

SEQ ID NO: 68725 - DNA, 55 bp, Zea mays
  Clone ID: LIB3076-052-Q1-E1-F12
tacgtcggcttgcatgcgacctcatagcgatctatattgtcacctaaattcactt

SEQ ID NO: 68726 - DNA, 359 bp, Zea mays
  Clone ID: LIB3076-053-Q1-E1-A11
ggtggaagagctctagaggactggatccccgggaagcaggaattcggcacgaggggaaagttgaggatgttgatcaggatcaagacaatgaagaaaagaattagaagaagattaaggaggtgtcgcacgagtggtctttggtgaacaaacagaatcccatctggatgaagaagcctgaggagattaccagagaagaatatgctgctttttacagaagccttacacatgactgggaagagcatttggccgtcaagcacttctcagttgacgggcaacttgagttcatggctgtcctcgttgtctccaagagggctccttttgatctctttgatacaacgatacaagcccaaacaacaatt

SEQ ID NO: 68727 - DNA, 468 bp, Zea mays
  Clone ID: LIB3076-053-Q1-E1-B10
tggatcccccggacagcaggaattcggcacgaggggaaatggaaggtcgtatcccttttgtttacagggctatagtcgagtacaagagcggcaaagacgatcacgttttagcaacatgggtcatcgagtcaccctcggcttcttacatgagactccccaccggggattctgatcgcttccaaatatccgatgatcgaatctttgagtcagatacttatgggaagttttccacttcatcatcatcatcatcatcatcttccatgggtgctccttctgctagtactaagattattttatcagccggagttcaatcgtcctgcgtgtctgctccgtttgacctctctccgcacggggccgtcgatacatgaaaccatcgcatacttatgggttaaactagggtctgggaatttcatgtatgttgaacatatatatgtatttctgtggacgttaatcattatggtcgggtac

SEQ ID NO: 68728 - DNA, 313 bp, Zea mays
  Clone ID: LIB3076-053-Q1-E1-D9
ctctagacgactggatcccccgggcagcaggatttctgtacgaggtcactgtcggtgagtgcgcagtggggatcacttgtccgctcagttcagacacgagacggaactttcccagctgattatgttccaacagtatatgggatctttagtgccaatgtagcgatggatggcattagattgaatcatggactaaggtacactgccggacaagcttagcacactacgctacagtcactgagttacaaaggatccgatatgcttctgttgggcttttcgcataactacaaggccaattaacgaaacatctacaaaa

SEQ ID NO: 68729 - DNA, 464 bp, Zea mays
  unsure at all n locations
  Clone ID: LIB3076-053-Q1-E1-F10
gatcccccgagcagcaggaattcggcacgaggcagcactgagtcttgaccgccaaccccgcaaaaaagaaaaaactgaaaaactgatactagatgaaatctgtatcgattcagctttttttttgcactgaaaactgagtaaattgaaaaaaagttgaaccctgttttttagagaagtggtggatgatgtctaatgagaggcacgcttcttccaatcctacatctcctcaagaaaatgatgctatgttccttgatatacttcatgaagctccattatttggtcaccggaaaccaaggagtatagttgggggtgttnttttaattggtttcaataactggccggggttttttaaaacgcaatcttggctgcagcagctccttggatatttcagcctcttgggcatttagtcttaccattgctttgcagttgtgatgttgttcttttaatagtcacatgcatttttc

SEQ ID NO: 68730 - DNA, 467 bp, Zea mays
  unsure at all n locations
  Clone ID: LIB3076-053-Q1-E1-F9
ggatccccggacagcaggaattcggcacgaggtgacttcctccagaactactatgtcaaccctctacttaaccatgcctatactccagaccagtacggctcattccttattgataccttcacaaacttcgtcaagaacctctatgggttgggagctaggaaaattggggttacctcacttccaccgttaggttgcgttccattagcaagaacattgttcggttaccacgagaaaggatgcatctccaggttcaataccgatgctcaacaattcaataaaaagctcaacgccgcagcagccaatctccagaagncagcatccctgggtcgttaaggattggttggtttttttttccgacatattcaaggcactttacgacattgttaaatctccctcgaactatggttttggttaagcaacaaaacggtgttgtggaactgtaacagtatagaaatcgcatttttgtg

SEQ ID NO: 68731 - DNA, 409 bp, Zea mays
  Clone ID: LIB3076-053-Q1-E1-G10
gatcccccgagcagcaggaattcggcacgaggagaatggctatgttaaaggatggtctagtgagccgggataatgagattagggaattaaagatagtcgtatccgatgccgagatgaagattttgggggaaaaagcgcagatcggagctaaggtatcgaaattgttggagaattggaggagaggctgcacgatgaaatcgaggcgttgaaaacagagattgctaagagaggtgattccattaaaattctaaatgaaaacctcgagaccttgaaatccgagagagatgagctcaagatgaaaatcgatttacttggaagaagaaagttgggttactaacagggtggaaattttcaaattgttgaaatggataagcaactgcaccgattacgtgtggaacacggggaatta

SEQ ID NO: 68732 - DNA, 591 bp, Zea mays
  Clone ID: LIB3076-060-P1-N6-A11
ctcaatccagtgatttgccacatctaggattcgagttgccaattatgaggaaatttgttttgcttgtgtacattcgaacaatcttcttggggcctattttttatgggcacctcattattcttatacaaaagaaattgggctcgacgcttgcgataccacacagattcaggggaaaaaaaacaaagacggttcagcaaaacgtatcaaaatgaggctccctgccacaggttcagcaaacaaattccagaggccaaggcatgggtttattggagctatttgacttcctgaaaggagccgcgccttcaaagttgcgttccgttatcatttcagtttgtcgaagagctttggtgcaacacacttgtcaacgcatgaccagtagtcgaagtattggccggtgcagtgcttctgcccacttccgtcgctctcgactctcttgacgcatttctcataatcatacaatgtttttacacattgcggcttgcaacgttcctcaaggtaattcttctgatcaacaggttcagcatccgccatggattcgtgattgcaagagaaatctctagtctcgcccacgcgtccgcggacgcgtgggcg

SEQ ID NO: 68733 - DNA, 482 bp, Zea mays
  Clone ID: LIB3076-060-P1-N6-A3
attgccacaaaaaaaaagcctagagattatactacgttgcaagccaggtccttccaaatctccaagtagctgtaattacagaatacaatacgtccaagctgagcacatagaaacgatactctagactgcaggtaaagggagattgccaatttaatacaggtgatactaggtgatccttgaattccagagctgaaaccacctgggacttggtgctggggtcttttttatgattttatcgcacagttcatcgctggttctccctcctgcgtgcgtagcgggttctgtcattgtacctcggcctgtctgctgccctttgcggcacgggctccaccctcctctgcctttcgggagtcctctgaacaatctcaccgttgacgaagagttcagctccgtagtccttgtattcagcatcaacatacgaatccgggagcacaaagagaacaccagggagcccctcgagcttgttagatgcggacgcgtgg

SEQ ID NO: 68734 - DNA, 615 bp, Zea mays
  unsure at all n locations
  Clone ID: LIB3076-060-P1-N6-A4
ggggggggggngggnnggnngggggggngggggggggggggggggggggggggggggggggggggggggggggggggggggggaggggggggggggggggggggggggggggggggggnngggggggggggggggggggngaggggggggggnggggggggggggggggngggggggggnggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggaggggggggggggggggggggggggggggggggggggggggggggggggagggggggggggggggggggggggggggggagaggggagggggaggggggggggggggggaaggagggggggggggggnggggggggaggagggggggggggggngggggaagggggggggngggggggaggggggggaggggggggggggnaggggngangggggtgaagaaagggagagggggggggggggggagggg

SEQ ID NO: 68735 - DNA, 544 bp, Zea mays
  Clone ID: LIB3076-060-P1-N6-A5
aaggcgtaaaaaaggtttaataactttattacatcatccagacttaagagccttaaacagttttataatcaaaatacagcggaaataacataggccatctcccacaggaagatgactggagcgtcgctagacttaaaactcgtcaaaatcttcgtaaaagtcttcctcatcacctttttgatcacaaaagtcatgcaggttttcctcaaacgaattcgggtcctttaccacacaatcagctttttcctctgttccttgggcctaggggggctgggagcgagcaccggaggggccacggtgatccactgagcaaaggggtcggcaagggccatttcgaggtccttggcagcgctggtcgacctcggacggcggcggggtcaatgaggaccgcccccaggtcttcgggtgggggctcccaggctccggcggcagtgagcagggcacccgcggcggtcggccccagcagggaggaccagagcctgagggccagctcgggattgcagggaaccggcaccacgggcagtcgggcacggagcttcttttt

SEQ ID NO: 68736 - DNA, 518 bp, Zea mays
  Clone ID: LIB3076-060-P1-N6-A6
agcctgcgtgcacaggcgcccatatatgctaggacgaaaaggacgtggacaccccagccgcactggctctacactcgcaatacccagaacaggctcctgggtggagataaaagggtaaaagccaggtttgggaaacaaaatgaaggaagaccaagggaggggggagcttcagaaacctaccgtgttccatggaatcggggtgcgggacctgttctgccaagctagactgactgaaagattaccgagtgggccacgccggcttcctcgaggggctgggccgcggtttcaagcggctttggggggaacccggcccgcaacggggaaacaccggctccgggccctggcggggctaaaaaagcccgcacgccactaattctgtggcttgggttgaaacgggcaaacaagcgactgccgcttgtgaacctgatttgggagggagggtgatgggaaagaatcgccactgggattggccgagaagcagttgcactactggaagcagcagcagcagcagcagcatt

SEQ ID NO: 68737 - DNA, 374 bp, Zea mays
  Clone ID: LIB3076-060-P1-N6-B1
ggaacagcgctgaaataatcacattatttgggctgaattaaaattaacaagctgcccaggacgtaggtgaaacagtttagcatgtaagctaggattgccagaacctgcaggtgcatatgcagtagagcacaacataacatgatacttgggtgcgctaataagggccaagcccatacgcgaggtagactaatctaaaccttacgaaattattaggtggcctggttttatttaaagagcattattctgcgaactgatggcaaaaaattatttgtacaactaataaatacctggctgttgctaaaaatcaaatggctgggaacaatttaaagcatactcatggagaggcatattgcaacctattgatgtcagtaacc

SEQ ID NO: 68738 - DNA, 549 bp, Zea mays
  unsure at all n locations
  Clone ID: LIB3076-060-P1-N6-B10
aggcttngaacgaggacattccattgattacagcagcgaggaattacagcacatggactagaaactagaacgatgcagtacaaccaccacagaaaacagcaccgataaagacaacacagactaactagaccaagaacacaacacgaccgccaccgccaccacgtaattcgccaccgggagaggggcgacctaaccgccgaaaccgtagagggtgcggccctggcgcttgagagcgtagacaacgtccatggcggtcacagtcttgcggcgggcgtgctcggtgtaggtgacggcgtcgcggatgacgttctcgaggaagatcttgagcacgccgcgggtctcctcgtagatgagcccggagatgcgcttgacgccgcccctcctcgccaacctgcggatcgccggcttggtgatgccctggatgttgtcacgcagcnaccttgcggtnggcgcttggcgccgcccttgcccagacccttcccgcccttgccgcggccagacatcgccgagagtttcgccgctgtgactttgaatttggttgaggagaac

SEQ ID NO: 68739 - DNA, 469 bp, Zea mays
  Clone ID: LIB3076-060-P1-N6-B11
tcgcgactagacctcctgcggtcgagcaggagcagccgccgggaggaggctgctgctgctcctcctgctggtgccgaggagcccgcgggccgagcctgtcgccgggcagagctgctgctcccgagagctcgccgcggacgagccggaggctcctgctcctgctcctgctggtccccaggagccggccgccgaggcggaggctgctgctcctgaggagcccgagaaggccagcgagtgaggccgtgcgcacgcagcggcggcggccagggcccacgccccaggggattcgtgtgcgcgcgcgacgtgtgaagtcactcaactcgcgtacatgcgaatatgacactggtgtaacatgtagcacaaccttaacaacactagcaacatttccgtgatggttttgaaggatcaggaatttggaaaatggcataatgcctatttggatcaaacttctaattcaaaggatcaaact

SEQ ID NO: 68740 - DNA, 443 bp, Zea mays
  Clone ID: LIB3076-060-P1-N6-B12
gcaataatccgtctttggcaagcaatttcggtgatgtacatgttctacaatctcgtttttattaccgagcaagaaaaagagagttctggactagcttgaacaaattgcctcgttgaacatgctacaaaaatagtgatttgcctcacagatctagttaaaaacataacctatgatatgtatgcttatccaaccaataaagggcagtagtcatagatatacgtgcagccagcaacctccgtttgatctagattactcctctggctcttcttcagttggaccaccttcagtgacaccaacttcagcggggcgaagaacacgatcatgtaacatgtagccaaccttcacaacagcagcaacagttcctgatggttttgaaggatcaggaatttggaaaatggcatagtgcctatttgggatcaaacttctcattcaaaggatcaaac

SEQ ID NO: 68741 - DNA, 320 bp, Zea mays
  unsure at all n locations
  Clone ID: LIB3076-060-P1-N6-B2
aaaaccaacaacgtttgcatcatgtcaggtacagagtagtagcatacagtgatctcctcaaagaacagagtatttgtaaaaatatggaagggacagcaatgctactagcacagtgctcataatccgtacagcaatcttttagctcgagctctgcctttctgaacgtttcaagtgcagaatccgattcactctgattttgccggagaacaagatcggggcagactcttgctcctggcaggactcctgcttgcagacttgtcacgccggggagaaacaggaggggatctggnatggtgacccacgcgtccgccacgcgtccg

SEQ ID NO: 68742 - DNA, 396 bp, Zea mays
  Clone ID: LIB3076-060-P1-N6-B4
gtgatccttaataacaagattaaaatgattccagcgtcggcctacacttgatagaccatgcaaaagacacagaagtcatgatgaatctcacacgaaatgagatgaatctactactactagagctagcctagagagcattttgttcttcggcaagagagcaatttgacctccggcgagcccgattcaggttggattcgcctgtgcaccaccgaaaagccgccgcctaccctgcatcctgcgccgcgctcgccgcgccatcgtcgagcacctggacgcgatcaggtccgcggcggccggtagcagccgtgtgccctcgaaagcgcgctcctctggtactcgagtacccacgtctccggttccagccgcaccgccgccgcgctctgcctccggtgggcc

SEQ ID NO: 68743 - DNA, 532 bp, Zea mays
  unsure at all n locations
  Clone ID: LIB3076-060-P1-N6-B5
ggggcacagnaacatatcgtaccattagacagaatcgcatggcacatgggaaaactccacaaaaggcaaaaggcgtccaacccagcacggcagataaacaacaggtctctcacagcattacatacaggacagcacagtccaccttaaacttatgcagctggtagctctcccaagattccaagaagcaaatgaccctctatctagctccttgtgtagctgctgcatcttcagtcagtcagtcagcacacttggcacctgaaaggtacacacgggactgtatgatactggtcccgatcaggaaaccaggcgtcaccatcaggccgactttcggcctctccgcgacatcttctaggatgatgtccttcacgacgctctccatgtggatatccgaaaattcacttccctttttcacttgaaacacctttgcctttggatcgaaggagtgcgccaacctgtgcagcaaccatatggactttgctagctttaggaatgcctggtagaaaggtgtccttggatggccgccgctcatgac

SEQ ID NO: 68744 - DNA, 613 bp, Zea mays
  Clone ID: LIB3076-060-P1-N6-B6
cgtaatgctctttctttttatttcatccaaagagaacaccacactccacagctgagttttacatgcaaacggattgtaccaacttacagacaatgtcaatcatgtgatgaccttccaatgtgatcccttgtaacaggaaccaaatgggataatgatgatggacacctaacttctgttgctcccagctgtatatgactacaaaatatcaaactggttcagtgactgtgagcccaatttcaatgccacctatgcacattagcatgtgccttgcctgcactttatcagctacaatggaaactccatttgcagcagtacaggggggctcatagagaaggaactcaagccaaactttgaagtttctggttttaatgtagtactagcaaggttcaacaacacaacagtcaatagctgtcttcatctgtctcaggccttcggaggtaataacgcagacaattgatcaacacctgagatgaggagctgtttagttttgcacctctgtaactcacatggaacttgtccttcgcaaccaaaccttcagtatcaatctcagctgactccacatcaatatttgtgtccgcgatgatcttgattatctcaagaagtaggccaggcc

SEQ ID NO: 68745 - DNA, 605 bp, Zea mays
  Clone ID: LIB3076-060-P1-N6-B7
cacatacaatcgagcattgtttgctgttttgctcggatataagcaaatgatcaaacaaatgtctcaaatattctgccatcagggtctgacattctctaaagttacaatcataaaacggtcctacaactacccaccaaattcacatttcaactacaatgcacatcaaaacgagcaacatgatcgtgctctactgccgtcttttagacctggctgaagagcctcctgtcaaccggctcgatggagctttcgtattgcttggagtcttagcatcctttgggttcgatctagacatagatggctgcccgttctttgtgagagtgaacctgcttattcttgatggaaatctatgcagccgttccgctgtcatctcagcagctgaattatcattctcggtttcacccgataaaccatcatccgatgcattgttctcatatcctgcttcatctatgctcactggtgcagtatccatcacatggtggttaggatctacattcacctcgccgtaactctgacgatccgatagaactctgtcactagacttaagcattcgttcgcctgataatagttggctaggttggtttgctgtagtcttcgtcaagccaggc

SEQ ID NO: 68746 - DNA, 506 bp, Zea mays
  Clone ID: LIB3076-060-P1-N6-B8
ggtaacaaactacctgaaatttattcataattatccatggcatgataaagaaaccagcccaaattgaaatacagcccacggaacaaaattgtcctagcgatgtcctccatctcatttattccaaagccaattaaccacctaaagttgcatgaaaaaagagaaacatacaaatccatggggttccccttcattcttccttgcttggggatacaattgcaggccactttccgaatcttttgctagttcaaggatgacgtggcgatgaccctggcaccaagggtatcgagctgcgcgacggttgctgtcgccttgagcttgcctgcgctccagaacgcgtccaccatcttgcgggcaacctcctcccccattaacttcccttggatgacggccaccactgtggggcccgggccgctaattgtgcagcccagcgctccagcttgcagggccgacgcctttacggccgccatgccaggtatgaggggtgcactggtgggcttcacgatgcc

SEQ ID NO: 68747 - DNA, 516 bp, Zea mays
  Clone ID: LIB3076-060-P1-N6-B9
atatataaacaaggttttttttggccatgaaaacaaccagaaagaggagacgcgaataatcagggacagttaaaaaaaaaagagaagctgcctgaattatgaaaaaacaaaggcgccgtgaaacaagggggtcaaccagggttcaaatttacaaaaaaagacttgaacgcgggggcgcaccgcgggggcaacccggaaatacgaggcggggccgagagggcgaaaaaagtttccaaaaagggggctgaataaaagcggggcgaaaaaagggaaaacactgtttccgggggaaaagggtaaaccgtaaaaaatgccaaaaaaaaaagagggcgggaagaaaaaagggaaaagccgggggggccaaaggggggaccaaaccaaaaaaaaggggggggagctaaatgcccgaattaaacaagaaaaaccgggaggcccattgcaaaaaaaaaaccgccaaacccccggggggagggggttggtgtattgggccccaggggggttttttttttaaccagg

SEQ ID NO: 68748 - DNA, 770 bp, Zea mays
  unsure at all n locations
  Clone ID: LIB3076-060-P1-N6-C10
ggggggggggnggggggggggggggggggggggggggggggggggggnnggggggggggngggggggggggggggggggggggggggngggggggggggnggggggnngggggggggggggggggnggggggggggngggggnggggggggggggggggggggggggggggggggggggngggggggggggnggggnggggggggggggggggggggggggggggggggggnnggggggggggggggggggnnggggggggggtgggggggggtgggggggggggggggggggggnnggggggggggggggggggggtggtgggggggggggggggggnggggggngggggggggggggggggggggggggggggggggggggggggggggggggggggggtgtgnnggngggggggggggggggggggttggtgggggggggggggggngggggngggggggggggggggggggggggggggggggggggggggggggggtgggggggggggggggggggggggggnngggggggggggnnnggggggggtgggggggggggggggggggggggnngggggggggggggnnggggggggggggggggggggggggggggggggggggggggggggggggtgggggtggggggggggtggnggggggggggggggggggggtggggngtggggggtgggggggggggggngnnggggggggnggggtggnggggggggggnngggggggggggggtgtgtttggggtggt

SEQ ID NO: 68749 - DNA, 632 bp, Zea mays
  unsure at all n locations
  Clone ID: LIB3076-060-P1-N6-C12
gctaaaagactcacgttttaattcttaggatcacatgtgatctttacacgaaataatccgggtacaacgaaggaaggtggtagcagtgggagagggcttggttcgggaggccacagtggaaattctctgtatatcaatctagtgttgggccgagagggacttcctataaaagcatgagaaagagaagaaatgtgagttcagctcaggattatgcataacaggatagaatagcaacggaacatataatacattgctcagcacgtctttctcctgtcaagtttgaatggaaggttcagccatttcttccttgggaaccgctcttttgatttcttttcacttgagttatcgctgtcacttccacatccctccatgcagtgatccttcaccttcttttccttctgatgatgtttttctgtaccagttttggccactttcgaaggcgacttggctttattcctgctggaactccgttttagaggtggattgttggtataggaagcatggatctcattcctttccttcagaaggccatcaatcgcttgcatttcttgtgtgtatttgctggtcatttcagtgaacttcgccaaaaccttctatactctgactcaaatntggaaagttcagctcggttt

SEQ ID NO: 68750 - DNA, 560 bp, Zea mays
  Clone ID: LIB3076-060-P1-N6-C4
ggctggggggtttttttttttttttttttacgaattgggtcgtttggcaacacgaatcatcagtcttttaccaagatcgcttcggggacgaagcgggacacgaactaccacacaaaatagacttggaaagccgtttttacactacttcgccacgccggctaggggggagcaaacagcataaagttacaaattgcactcctccatccctccgccggcactggggccgggcgcgaggaacgcctacgcgcgctcgccgcggatgcggcgggcgagctggatgtctttgggcatgatggggacccgcttggcgtggatggcgcaaaggttggtgtcctcgaacagaccgacgagggagggctcggcgggttcctggagggccaggacggggtggctctggaaccgcagatccgtcttgaagtcctgagcgatctcacggaccaggcgctggaagggcaacttccgggtgagcagctccgtgctcttctggtgcttgcggatctcgcgcagcgccacggtgccgggcctgtacctgtggggcttcttcacgccgccggtcgtcg

SEQ ID NO: 68751 - DNA, 602 bp, Zea mays
  Clone ID: LIB3076-060-P1-N6-C6
gccatgcatcacctggtgaatgtaggtgatccggttattattatcataaatagatgatcctagtccaatgccctgaatctcaatgtaggctgagacaaaagagcagacatgctaatacattgctgcgtagttcaacttgactaacaaaatggtatgcgtaaactctatctgtagatgccctcttagcttgtcctcttcaaagcaaacaagcttcgcaaaggtcagaatggcttgataatccaagtcatatatggtatgctttcgaggttgcctcagttcttctgagcttcgtcaacctgcttcttatctgcaatatcactaggcacatctagtccggttggattcttgccagcatagttgaatcttgaggaatatgacccaagcatgcttctgtcaaccaacaccatcgaccgtagctcgcagtttgcaaagtgcttgctaacttcgtctcttatggttggatggcactccttgctgtacatgcttaaggtgtgaaacaagaaaccactgtgactgacaatagctatctctttctcttctcttgtccacaaccagtccatgaacttcatacccctcaatgcgacagcctcatttgggtctct

SEQ ID NO: 68752 - DNA, 297 bp, Zea mays
  unsure at all n locations
  Clone ID: LIB3076-060-P1-N6-D1
tctgcgactagnactagtccgcactgatctgaaactaatagaatagaaggggccataaacaggaagtcttgaccaattcatttggtgtagttgaaataacggaattggaagttgttcggtcaagtataggaaattaatataagaatgaataactttctcaatggtttattttttgtcttttatttatcttaatattcattccattcaggccatttgcaagcaagcactgaaaaagcttctatttctaaacggaaacgcccagcccaatacatcgaaactctttgcccatgggtaatg

SEQ ID NO: 68753 - DNA, 622 bp, Zea mays
  Clone ID: LIB3076-060-P1-N6-D10
ctgcagatcagcaaggccagtgggcaacccccatcagctgatcaataaggacaagtcaatcgatgataggagtaccagttacaagtttcttgtgtccaatcatagatcacagcagcatgcttccggtaattccacaaatatagcacaaggtcagcgcactgcgcactagcttttatggaaattacagggattattctagagaaatggagtagcagtccttggcattagcactgatcaatcacaagatattcttagcctgggggccagttcatttgcctgcctccgaggagatgaacgtggatgtggtaaacagattgacatccacttgggccgtcattgatgacgacgcgatagccatcttcaagtccttcctgcttcgcaacaaccttggcaacatagaggagatagccaagtatttctatgtgcctctcttcagcctttgccaggccagttagtccatccttgactttggggatgatgagaatgtgtgttggagcttgagggtttatgtccctgaaagccagtaccttctcgtcctcataaaccacagtagaaggtatttcctttttgatgatcttgtcaaatatggttggggctgtcatcgagcacggcggcgagcgcc

SEQ ID NO: 68754 - DNA, 633 bp, Zea mays
  unsure at all n locations
  Clone ID: LIB3076-060-P1-N6-D11
gcgcgcgactccaanaagaagaggggagccgctcggcggcgaagctgaagcagagcaagcgcgagacacgccgtgagcagtttctgtctagggggcaaggcaataaggatgccaaatctgcagcttcgccaacaggagcagtttctgggtcgcccatactcgcttccccgcaccctccacttcctcgtcgccgtgctgattccagatcaaggggcagtgatccggaggatagggatgaggctattgctgctggccttgaggcagatggcagtggccttgactccccaggctcagacaagcgccaaagtggtgactgccctcagaggaaggggttctctggcaatggcggtggtcccagcctcagcagtggaagcagtgtatggtccagttcaaggagtgtgagtgatgctgaggaggatacaggcggccctgaggatgagagtgaagtcttcgatgattgggaaatggctgctgatgcgctttatgtcgatgacagttcttgtaaccagagttcaggtcccacaccgacactcccacaagctccgaccactgcagaaccttctcatgcagcgaaaccagaaccgattcaaagcaagacaagggcttgngcaccggatgacatatttcgaccac

SEQ ID NO: 68755 - DNA, 595 bp, Zea mays
  unsure at all n locations
  Clone ID: LIB3076-060-P1-N6-D2
ccaaaaggcaacatattttttccacaaacaaataaacatgacgctgatgtttgaatacatggacattgtacttattcaactacaagcatgcccatcgcttattacaatgctagcaataaagggtacgtcgaaataaatagggtgcccatccagcactgatgactaaaatagtggtggcaaagagatgagtagcggtggggaaaattctcatacatggtctcaatctacaacttccgtaccttataaaacatttggcagccattattgtcttacacaaaatctacagcagttcaccgtgcctcatcttctaggttgcggaacccagtggtaaggtcgtcatacagtttcttaaacttgccgaccaaagcttcttcgccttctgcaggatcctcaaacttttgggatactaggcgataaaatagatcccccaaccgatgctttatgacactgtatgttatcttatggccgtcagtaccagctgcccgctccacagcctgatttgccaatgtgnttgaagtgaataatgttgcgcatcatccaaacagatttgtagaatgggcagaacttatcatatggggtgaatgcattttgtgcc

SEQ ID NO: 68756 - DNA, 610 bp, Zea mays
  Clone ID: LIB3076-060-P1-N6-D3
gcagccttaagatcatagattactcgtttcagttgcatacagcatcagagtctaggaaaacgaacaaagggtcccacaattcaagcctaagggctcaacattgacaaatttattacgagaaagacaatacgacaatctgcttgttcacattgactccagatgcaaaagaccacatgcagcagaatgtatcactccaggatagggtctatttaagcatcagcaaacctgcattccacaagagtaaacgatcaaatttgttaaaattgaccaagcacaatttgtgcaatcaatggttaccccagttcggagagcttgaggtgggcctctttgtagtcatcaaagaaagccttctcatccgcagcatatttctcgacaagagggcggaaaacagggtcactcagcagggctttgtcacttgggagctgaagaaggccctccttatcaccactcagaagttccctacgaaaatagtttgggagaaatggaatagattgatttctagtgtagcagtcagctggccaggaatgacataacaaggtaaacaaattttaagtatttcctaactaaatgcagttgcttttcaatagtaaacgagactaagactcacttg

SEQ ID NO: 68757 - DNA, 595 bp, Zea mays
  Clone ID: LIB3076-060-P1-N6-D4
acgaaaacgcttctcattcgtcaagtatatgacagacagttacaggttgtttctcgaagaacagcctagttgtataactcatgttacatactcttttttttttgtaaaaaaaagatgaacaaatgaacaaagacgcctatcattcagaaaaagctggctccacctccctgcttgtaatgtacacatcttctgatagtgtcagcgcctcctctcagattgtcactggatcaattaaggtttgatcctcttgcattcctcttacagtagaatcgattcagaaatgcctcccctctattgtcattggatcgataaaggtttgatcctcagtcctgcattcctcttatagtagtttcgattcgaaaggttgacgaaagaattctaaagagaccgtctgggttgtctgcatggacccagtgtccagcatcttcaagcacgtgcatttcaactcctccaccctcatctgcagctaattcctccgcagtataaattctttggaggtcttcgagagcccatctatgcaaacttcgttcagcttttagaaaattaatatgaacaccccttggtacattctctacaatcctccataagttagtat

SEQ ID NO: 68758 - DNA, 538 bp, Zea mays
  Clone ID: LIB3076-060-P1-N6-D5
gggggctctgaattttatctggcaagctgaaaggacagacactcactaaacatctgacgtgaaaaaatggtctaaaacctgaagctataaagtcatctgaagggataaaaatgatgactacaagaagaatctccattcaccaaaatctccaaggatccttggagggaggaacatagttttctgtaccggggagaaggcgaaaggatgccacggtcttttgtagaaagggccccatagattcccactgtttgctaagaggggaagcattcagggagtacagggacccatcacgctcagcagtgcaggctacattgggccgaaacaaatttggttctggggcaaattttggtggggatttccgaacaagatactcataataccagtatgggtctccatcaacctctgcaacgtgtgcgtcaaggacagaactctctgtcatgcgctggccagttgtcaccttcatggtagatctatcagataaaatgcaatcagcaacatgtgtttggatcccacgagctcttgtcttttgaaggcaaaa

SEQ ID NO: 68759 - DNA, 595 bp, Zea mays
  Clone ID: LIB3076-060-P1-N6-D7
ataaaaaaccatcccaagcaactataatatatagtggcagcccacaggaacataataaaccgtgacatccaaacacaaaacggactgacaccaaacgcagccaaccacatagggtatgctgcgcggcacgacaataacagtttttagacatcgacaccagaccgactgacaccaaacgaagactgacatcgatgacaccagacaagcaaaataaacttattgaattaatattatcaagtgaagccatgaacagtagagcagcatcgcctcttcattcatcgccatcctcgtcgtcagactcggcgctctggagccactcgacaaacggcttggcattcttgacgacctgggagtcctttccagctgcgacagcagcgttgtaccagtccacaacggtttcctcctccaggatatctccgtcgtacagggctttcaggacaactgggacctccttcagcgcctcggggttgcacttgctgccaaaagcctcgatggcttgaaccagcagggtctgggcaccctcatctggcacagcaactgcaaggtacttcttgttcttcacgacctcctttgcaaatcccttgcccacaccgtc

SEQ ID NO: 68760 - DNA, 626 bp, Zea mays
  unsure at all n locations
  Clone ID: LIB3076-060-P1-N6-D8
gcgcgcgtatccaagaagaagaggggagccgctcggcggcgaagctgaagcagagcaagcgcgagaccgccgtgagcagtttctgtctagggggcaaggcaataaggatgccaaatctgcagcttcgccaacaggagcagtttctgggtcgcccatactcgcttccccgcaccctccacttcctcgtcgccgtgctgattccagatcaaggggcagtgatccggaggatagggatgaggctattgctgctggccttgaggcagatggcagtggccttgactccccaggctcagacaagcgccaaagtggtgactgccctcagaggaaggggttctctggcaatggcggtggtcccagcctcagcagtggaagcagtgtatggtccagttcaaggagtgtgagtgatgctgaggaggatacaggcggccctgaggatgagagtgaagtcttcgatgattgggaaatggctgctgatgcgctttatgtcgatgacagttcttgtaaccagagttcaggtcccacaccgacactcccacaagctccgaccactgcagaaccttctcatgcagcgaaaccagaaccgattcaaagcaagacaagggcttgngcaccggatgacatatttc

SEQ ID NO: 68761 - DNA, 619 bp, Zea mays
  Clone ID: LIB3076-060-P1-N6-D9
gtcaactcaaaataaagttttaagttctatttataagcaagtataagatcaagagagacaataatgtcagtttgatgatcggagacacaacatgttagctacaacctcctttcaccatatcgcgtacaataaataatccaaggacctatatgcgaaccaacatttaccgtaactctcgccatacacactcagatccgatacgcagctagtgaagaaaaagctacccacatcaatttattcgactctgctcacctgacagactcctgtgacccccatctcaatcctgaagctatataccaccatactctacagctgttacgagctaagatcttagaaatccaacaacatgttgcttcagatcttcacgcctaactgcatggtggacatactgcaaacttttctatttacaatcatccttttgacaaatcatatccgaaaatttagattggcttgtaactgttgacgttggatagcctctaaagtcagaatggtctacagtcgaatgtccatatgatctgatgacctccgatttgcatcattatatcagtagagccctcttaagatcagtatcatggactgtagacttcgttagcagttcagtacaacacccttgctgtcg

SEQ ID NO: 68762 - DNA, 604 bp, Zea mays
  Clone ID: LIB3076-060-P1-N6-E10
cataaaaaattttttcgttgctacccattattttctgttcaatataatgtcttatgatattactaggtgagtgcccgtgcgttgcaacggaaccgtataataacatgaagtatgcataaattttgacttcctaagatgctaatatgcccctgtaaaaggagttgaatcaatatagattatgaagatggattgatgttgtacactccaagaatgagttgaatcaagaagacagcctgtgagtgcaacgcctacaattcctggcaccacgcctacagtgtttgtgattccccatcattgacaaaattccaggcaacttgagcaagtgcattttgagcaaccttgaatatttttattgcttcaaccaagggcttgtaaggatggttcacattcaaatcaaaaccaagtgtcacgagcacaacacgttccccgagtaaaattagttccttttgttgttcatatacttccttctgttttattcgttgaactgcagcaggatcctttttgtggatgatctcatatgaaagaagtatgacatccttcagaggtctgggtgtttcttcaacttttcccgccaagaactgcatactgttgcaattgtctcgtc

SEQ ID NO: 68763 - DNA, 422 bp, Zea mays
  Clone ID: LIB3076-060-P1-N6-E12
agattaacaaacatattaacttatcagttatttatcacattacaaatacgtgaaccaacagcaccctaatcctatcgattccccttccttccctccctcgctcctggtaaccaacatggagtagaaggaagacaagtagaatcaacaagacagacaactcaaccttagcctatgcaccaacaggtggttgcggatcagccacttgacggaggggagctcggaactgctgcgtgtctgtctgggcggactggaactggaatttcagctcaaacaacagcttcctccccaatttgcattgccatttctttgcacacaagagtatcaattcaaggatatgcatctttgcctcctcactcagccatgacaagtcaatcacctatggtactagtgctgctgtatattagtacaaagcaaggcaatgg

SEQ ID NO: 68764 - DNA, 666 bp, Zea mays
  unsure at all n locations
  Clone ID: LIB3076-060-P1-N6-E2
gggggggggggggggnngggnggggggnngggggggggggggggggnggggggggggggggggggggggggnnggggggggggggggggnggggggggggggggggggngggggggggggggggggggggggggggggggggggggnggggggggggggggggggggggggggggggggnnggggggggggggggggggggggggggggggggggngggggggngggggggggggggggggggggggggggggggnngggnggggggngggggggggggggggggggggggggggggggggggggggngnnggggggggggggggnggnggggggnggggggggggngggggnngngggggggggnngggggggggggngggggggggggggggggggggggggggggggggggggggggggggggggggggggggggggggggnggggggnggggnggggggggggggggggggggngggggggggnnggggggnngggggggggggggggnnnggggnnnngggggnnnnggggggggggggggggnnggggggngggngggggggngggggggggggggggggggggggggggggggggggggggggngnnggngaggggggggggggggggggggggggaggggggggggggggggggagag

SEQ ID NO: 68765 - DNA, 577 bp, Zea mays
  Clone ID: LIB3076-060-P1-N6-E8
ttttttttttttttttttttttttttttttttttttttttttttttttttttttttttttttttttttttttttttttttttttttttttttttttttttttggcccaaaaaaaggttttttaaatggggaaaaccccttttaaaaaaggggggggggttttttaaaaaaaaaaacccccacaaaaactggttggaaaaaaaaaaaaaactggttttaaaaaaaatttttttttttttgaaaaggaatgttcaaaaggaacccaaataacaaatccggttggggcccccaaaaaccaaaaaaaatgggggtttaaaaacctgtaaaaaaaaaacttagttgccccaaaaaatttttttaaaaaaaaaatgggggctccaaggggacccccctttttaattggaaaggggggctgttcttttaacaaatatttttttggaggggttaaaaacttgaaaaaactaaaaaatttgtttttaaaggggcccccccaaagccaaagtttttaaattttttgggaccgcgtacccccatttgaggggccccaaaaaaaaaaatgttcctctaaacctctaacc

SEQ ID NO: 68766 - DNA, 265 bp, Zea mays
  Clone ID: LIB3076-060-P1-N6-F11
ggcttgcaaatgacacaactgcatgacaaaatagccttctcatctcacaacatgctacagccaatccgggtaggttcacatccaggaattacaaaacttcacttactgctgagtgcggaacaaaacctaacacgaccataattatgacattgcaactagacgaccacccagagttcaggacagtaatacagaaatataaatgactgtttacttcttcttggcgtcaccagccttggtcttcttgacaccacggatcttcttggcc

SEQ ID NO: 68767 - DNA, 522 bp, Zea mays
  Clone ID: LIB3076-060-P1-N6-F12
actggcaaccattcggtaggacgtgtgccttttcattgtgcagtactatggttccaccaaccacatgtaacatcatgaaagtcaggtgacaaagcaacaagtcacaaggcgtgatcctcttagaaaaaggtgtcttgtttagtacttcgcaaattgagcgacaagatctgaatactgttgcagacacgcaaagatttcactttcaatgttttcttgccatcctggccaggagagtatgctttgatgccaataactgcaggcaaagtgtcctgtatcggcccatatagtaatctttcaccaagccaatactccaaaggcctcgagcgtattcttgagcttcttctcactccagactgccgcgcaaggtcaacatctccaaggatttttctttgattcaattttttggtcttgtttctcctttgagctcccttttgccccttggcgctactcataactgtcggttgctccatgttcacgtcaacattatgaggttcattctccggttcgaaatttgcttgggat

SEQ ID NO: 68768 - DNA, 582 bp, Zea mays
  Clone ID: LIB3076-060-P1-N6-F2
ggaacttaaaaacttcatgcaaggatcacattataaaccttggactcctaggtccaaaactttgaaatttctaaactttacaatgccttccatttaccgggcgagcaaagcagactaaactagtatttacagatacgtactccctccgtttcttttaattaggcactggagggaggaagtgttcacagacaagctgcagcctcgatagatcaatagcaaatagttactatctactaatacctagaaagcaacatattaaatggtggcattctgagctctgatttccggggtcatcatcaagtcagggttttccccggattcctcccaaatggagacccaggcaatctgctgccaacaaggtcccgcaactcgaactcgctagggaacctctgctcagcaaggtgtgagaataccaaatgtccattgcagtaaacttcaaaggcaccagagctttgtagaaaggattgagcaaagttgccaaatagccagcatgttgccatggttccgaatctattggcacgaagcgagtagtaccatggaggagcaaccatgccaattctggggaaaattggtcaccagcca

SEQ ID NO: 68769 - DNA, 354 bp, Zea mays
  Clone ID: LIB3076-060-P1-N6-F4
aagacaaatcacagcaaccatttagaaagaactacaaggggacattaaccacataatgagatcttcaaagctcaggtcacagacacacaggttcacattatgttccaaaactctcatccaggcacagagcagttttcaaataacataagacctctatcacataacaattgggagcaaaaactaaagagatgaggaaaaggcggtaccacaaccatcagatgaccgggaagagtctagtcgatctcctggagagaggcgccggtggcggccccaccagcggcggcggcagcgacgtcatcggcagtaaacttgcccttagccttgtcggcggcgcggccccgggccttgcggtcg

SEQ ID NO: 68770 - DNA, 616 bp, Zea mays
  Clone ID: LIB3076-060-P1-N6-F5
gattgcagatctaagaattcaaataatgtgcagcaagagttcagcaacaaatagtatccccgtccttctactggtacagtatcttacttacgaagcaaaacagccagcgccaatcagtcaagctttcaataccgccttgtggatcatcgtctccttgtgtatctggtgacagctcttctcgacaaggtcaagaagctgctcgaggtttgtagcccacgagttaagtgtgccgttgcagtcctgaactactcggaagctcacaactcccatcggcctgtcgatcttcgcagtcagagattttgagttcaccatgtctgaaagatgcttctctgcctcctgcaaactcaggcagagcagatcagcaagcctctttatggtaaccctcgaatagtacttagacacaaccaagatattatgttcaattattctcagcttcaaatcttctgcagctttggcacccaaagctcctcctagcagattcttctcgttttcaaattcgtgcttagagaattcccacaatgctgtccactggatgacctccatggtaaccagctgcttcagcaataacctgaaatttgggatttctgaaaggtttttatcctctagtgtagcattg

SEQ ID NO: 68771 - DNA, 518 bp, Zea mays
  Clone ID: LIB3076-060-P1-N6-F6
actggcaaccattcggtaggacgtgtgccttttcattgtgcagtactatggttccaccaacacatgtaacatcataaagtcaggtgacaaagcaacaagtcacaaggcgtgatcctcttagaaaaaggtgtcttgtttagtacttcgcaaattgagcgacaagatctgaatactgttcagacacgaaagatttcactttcaatgttttcttgccatcctggccaggagagtatgctttgatgccaataactgcaggcaaagtgtcctgtatcggcccatatagtaatctttcaccaagccaatactccaaaggcctcgagcgtattcttgagcttcttctcactccagactgccgcgcaaggtcaacatctccaaggatttttctttgattcaattttttggtcttgtttctcctttgagctcccttttgccccttggcgctactcataactgtcggttgctccatgttcacgtcaacattatgaggttcattctccggttcgaaatttgcttgggat

SEQ ID NO: 68772 - DNA, 354 bp, Zea mays
  Clone ID: LIB3076-060-P1-N6-F7
aaaaccaaaaactgctttcaactgaattcaaaccaaatcgggcatacaatttcatgaaacaacatgagtatatacaattttttctagcatccacataattgaagcataaatcatccgacacaagttttaaacatcaaatatgttaaataaactataacttaaatccaaaagcaagtaaaataggttcaacaaccacaagctgcattggaggacaacattctgaaacttgaaaggggcatgcataatcccaacataaagctccaatccgccatctggttaaatggtgggcgggaccattgacctgatgcttaaactggcggccctcgattccgaactagtccctaaaaatcggac

SEQ ID NO: 68773 - DNA, 441 bp, Zea mays
  Clone ID: LIB3076-060-P1-N6-F8
gtaatgattctttgcgttgaagcttatataacatcaaaatcccacactgaatctgtgctacatgtttagcaacagcaaaacctaagctcaaattacgactcttgtgataaccaaaggacatagccgatcatcccaaacaacatatgtaacagctgggcagctcaaggaccaaaccgcttcttacagtagaaatataacaaaaagtattgatggacctgatcaacagccaatggctaacggtgtaagatacatttcaatgccccggtggaaacctacttcccagctgaatcaggtgagccatccccgtaggaaaccaaacctttcttgcctccacgattagggctaccagacagtgacagagctggggacgcggactgagatttctcatcacttcccacgcgtccgcccacgcgtccgcccacgcgtccgcccacgcgtccg

SEQ ID NO: 68774 - DNA, 631 bp, Zea mays
  unsure at all n locations
  Clone ID: LIB3076-060-P1-N6-F9
tcgcgatctagnacaccacagttccttcaacacaagtatcacgagcacatcttgtgataagatcaaaagncctggaacgcacacactagctaccgagatctgacaacacaaggaaacagtctgctcacagaactgattataattggctagatctaatcactggtagaatcatatgccgccaacaaggatggtccatagcatataggtaaactcatagtcatatctcgctccagccaccgtgcaaaacatactggttcggttcacagaagctgggcaggatactacaccaagaaagacgtgcacagggaattgccggattctcagataatgtggtcctcagaacattgcagatgtagcctcagcgacttccgttacaacttggtcatagtccgacttcagtttatccttcacctctccactgagctcccccttgtttggtttggtcagaaccaagacgcaacaagtcggcctcttagtggttcctgcggtcgcaagatcctcttttgatggaacatatacgtaaggaacattagcttcctcacatagtatcggaacatgtgtaatcacatcaataggagaaatgtttccagcgatcacacacaatcctttgttcccgcggcgaatgctcttg

SEQ ID NO: 68775 - DNA, 521 bp, Zea mays
  Clone ID: LIB3076-060-P1-N6-G10
agacagggcaaaattcacattagaataacagcaggtttttgttggagcacaagctaccatacatgggaggggcaacatagtataataatcaggcctgatacaacagggaactgatccaaaaaatatcctatcgatacaatgtacaatgtccaattatatggcaaataatggtattttcgggtataattacagacatattaagccacaccatagatttatacatttacaatgaagtaccagcaatattagttggaccacagggcagccattaaaggttctgtttagccacacgttacattaagcgtctgggatttatgcctgccaaaacattatcggggctagttcaaaatataactgatccaaaagcagcatacacacatggttcattagaaatccgaacagactattagcgagtattgcttgcacacaaaagcacaaagttcgtttgtccagcggcaatattagcagaagccaagtgctattctcgttggacagaaaaagacatgtcccttcatttccaa

SEQ ID NO: 68776 - DNA, 605 bp, Zea mays
  unsure at all n locations
  Clone ID: LIB3076-060-P1-N6-G2
aacatcctgctcgcttaatcttccccatggggcaaggctaacattgtttgtttacatcgagatcaatgccaaacagtacacctcccataaactaacaggccatcacaatatccttaccgttccaacgtcattagagttcgtagtacttcggccaccgtcacatgtcaggtgatccgttgatccattatacaagctggaaagttgtgtttacagacaagctgcagcctcgatagatcaataccaaatagttactatctactaatacctanaaagcaacatattaaattgtggcattctgagctctgatttccggggtcatcatcaagtcagggttttccccggattcctcccaaatggagacccaggcaatctgctgccaacaaggtcccgcaactcgaactcgctagggaacctctgctcagcaagttttgagaataccaaatctccattgcagtaaacttcaaaggcaccagagctttgtagaaaggattgagcaaagttgccaaatagccagattgttgccatggttccgaatctattggcacgaagcgagtagtaccatggaggagcaaccatgccaattctggggaaaatctggtcaccag

SEQ ID NO: 68777 - DNA, 586 bp, Zea mays
  Clone ID: LIB3076-060-P1-N6-G4
atcttaattgcaagtgatcattgccataatctgaatacaatgtacaggagcaatgagccattgaaggcatcatttatgatcactgagaaaaagattccatttaagtctaataaggggaaaatgctctattacaacgtcacaacaaatctctaaaagtactatcagaacatgttttttgagccaagagctgagggtatgtttgtcgacgagtttcttagcttggcctggacatcagccaaccctatcgattcttcgatttattgacaacaggctagattcccaaggaagaatttatgctacactgtccattgcatctccctttgttcacctggtgggccttggtatctcctgcttgtgagtaacgcaatactcagattttgtagtcatggtgttggtctgtcgtttcatttacttcaatgccagcaaacagcatctcctttagagaagttcatgttcatcagctataacaggccactatgtatcattctcctccaaagacattgcctgtaccttctcgatttgtgtgggccaatttggaccaagcaaatgtggatcagattgcacagcaactgcaaaatttgcaacg

SEQ ID NO: 68778 - DNA, 598 bp, Zea mays
  Clone ID: LIB3076-060-P1-N6-G6
agaactgtaactagttcattgccatttcatatgcatcatgataataagttacagcaggaacaaccaactactcgtgattcgcagtaacccaaactacagaacccacacatctctcatcttctgatcgggcactgatgacagaatatacgatgcttaggccctctccccacggatgcggcgggcaagctggatgtccttgggcatgatggtgacgcgcttggcgtggatggcgcagaggttggtgtcctcgaagagaccgacaaggtaggcctcagccgcctcctgcagcgcggagacagcggagctctggaagcgtaggtcggtcttgaagtcctgcgcgatctcccgcaccaggcgctggaacggcagcttgcggatcagcagctccgtgctcttctggtacttgcggatctcccggagcgcgacggtaccggggcggaagcggtggggcttcttaactccgccggtcgcaggggcagacttgcgggccgccttagtcgccaactgcttcctcggcgccttgccgccggtggacttcctcgccgtctgcttcgtgcgggccatcgagcgagtgaggatggaaggcttctgctaggga

SEQ ID NO: 68779 - DNA, 529 bp, Zea mays
  Clone ID: LIB3076-060-P1-N6-G8
atccatcacatcgggttacttgataataacattgttataaacattgcttcttcatgttccatgcagcaagtttgggggcactaacttcgggaaggcaacctcgtctctctagaggctttgtttcctcataggaggatgttaaaaccatcgataaaactaaaatcccatgttaaaatggaagcacgcagtaatcccaaaaaaaaaaagcgaatgcgacctgcttcgtgaaatgggaccaactcaagtcaaacgtatcatccagatcactactaggcacaaaaccaaaacaaaaggtagaacaaataagtctcggctagggggcgacaaaaatctaagtcggtttcctcatgttgcggcctgccctgatcacttcatccacaagcagcaactgggatgcaatgatgggtccagaattgatgatctggcgcttcacagagtagttgtcgaagatgccttccatctggggatcaatcggatccccagagtgatggttcaaccccacaactaatccacggtcatgctcattctg

SEQ ID NO: 68780 - DNA, 439 bp, Zea mays
  Clone ID: LIB3076-060-P1-N6-H1
atgtggtaaggctaagattgtttgtaaacaaagagattaagtccaaatagggcagggaccacaaacgaactagcatacagataacaaaacaacagcaaccccttaggtggaggaaaaactttgtgcaaaaaaaaagggcaggatacaaaaataatctcaaaccgagggtggaaaaaagggggtaaagccaaacaacattggttggaagagcaatcgaaggggaaactggcctctaagaaaaaaagggaagatgtgaggtggccccatccccaactacgaaaacggggaccaaaatcttggcgggggcctccggggataccccggaaatggggaccagaggcaatctggggtcaacaaggttcccaaatggggggcgtgatagggaacgggggataaaaggggaaagaggattcccggggggaaatgggttaaccttcaa

SEQ ID NO: 68781 - DNA, 552 bp, Zea mays
  unsure at all n locations
  Clone ID: LIB3076-060-P1-N6-H10
cgcataattggcgggtgtccaaggcagcctgcctccgtttatctgcagaccagccttaccaccacctccaatttccaagccggttacaaccaaggaacactaaaacaccatgctaacgcaagcacgataaaacccgcgctattactaggcctaaactactggtaattcccaggagcaaatgcgaggtgcagaccattcataaaaccatgacgcctctcggcaggctccaatcggggtggacggaacaactagtactagtgccactgcgtcgacgctgcatgaacggtgggggtgtgttcagttgaactgggcaccgctgaaagtctggccgaaagaccagccgcggggggcggcgttgttggagagcacggagcggccgtcgctggtggtgacgcggaaggacagggcctgcccgtcaaggagcgtgttgctctgccagttctggccccagttgcgcgacagggcctgccacccggggggagcgctcggccttcacggcaacagcgtgcacgtngctcgggcctcccacgttggtcaccagcacaaggttga

SEQ ID NO: 68782 - DNA, 502 bp, Zea mays
  Clone ID: LIB3076-060-P1-N6-H11
ggcaagcaaagaacacgggtaacagaattccaaccggaacggggtttcgaattaaagcaaattaaccctggtcctgggacattcgactcgaataggacccaaaaaactcacggcaatatcactggccacacaaagcagacatatagctttggaaaaattaggctggggcattgcccagccaccaccatcgccaggaccccaggggaaggactgatcgaaagtcacccctagatcttgttgaaggcaacgatgtcgcagctttggacgtactcgttaactggctcagcgcacaaatagtcctcaatgagagggtcgacagaaacaagaacgtcgactatgggcatcatgatttgcagcttcttgataccatatccgactgggacaagcttggatgccccccaaagcagcccttccatttggacactcctaacagcttcctaaagcttggccatgtcagtctcatcgtcccatggcttcacatcaaggaaaactgatgacttcc

SEQ ID NO: 68783 - DNA, 572 bp, Zea mays
  Clone ID: LIB3076-060-P1-N6-H12
cacggtggtgcgcgcgtacctggcgtccgacgtgacaaaggccgggttcggcgacctggacttcggctggggcaagccggtgtacggcgggcccgccaagggcggcgtgggcgccatccccggggtggccagcttcctcatcccgttcaagaacgccaagggcgaggacggcatcgtcgtgcccatgtgcctgcccggccccgccatggagacgttcgtcaaggagatggacaagctgctgagcgcgcccgcagacgcagaggcagagcagcagaaggatgcgttccccgtcatcaggtccgcgctctgaagtgagctctctgctgaggcagccgcgcgcacggcgccgatcgaaccatcgttttcgcttcgtgctacagcaagcatataggtaatcatcagcgggtcctgagcagctgagcttgtgtaacgtagtgggtgtgggtgttgggtgaaccatagtacgttgacgtgcgtggagctacgttgatgtatacgtatgtaatgcgcgcatttggccggctatatgggttgttgtgacgttgtatgtatattttggtaccttttcatcc

SEQ ID NO: 68784 - DNA, 567 bp, Zea mays
  Clone ID: LIB3076-060-P1-N6-H2
gatattcacagctcttgaggtagagctctcaagaatatattcagagagatttgaacattgagttttgccaccggggactggacacgacttcatggtagaacctaaataaaaggccaagtttctcatacccgaaaacgcagagctaacagctgcgtttcatcacacttgaacattctcgctaaaaggtgatcccatctgacctagtcattagcaactaactcgtcgtttccgttttctaccctctgaaggacaagcttcttctgcggagcgagtccttttgcgatcgccgccgaacttacatccacgaggacagtatcgtcttctttgaaatcgcccttcaggacaccaagggcaatctcgttctccaccatctgctgaatcactctcttgacaggcctcgcaccatagttagggtcaaagccaagagaccccagaagctcaacggcttccgcagtgtactggagatgaatcttctgttgtctcagccggttctgaacccgattcagctggatctccacgatatggttgatctcggttgtatccagtggttggaacacaatgtactca

SEQ ID NO: 68785 - DNA, 291 bp, Zea mays
  unsure at all n locations
  Clone ID: LIB3076-060-P1-N6-H3
gngatggaaaaggatgtgaattgaatgaaggaagctacgtataattttacactgtatcctgttgtcaggctattctcctgctgcctcttttaatatacagctacacggaataacagtgcgtgctccaacgacgcttttttcccctgcgttttagtacatctcttttctcttttttttggaggtttttttttctcacctaagagatgttagtacaccatcactcggagcagacccgcctgaggctgcgtgtactggaggccttcatccagcaggaactgctccacagctatg

SEQ ID NO: 68786 - DNA, 221 bp, Zea mays
  Clone ID: LIB3076-060-P1-N6-H4
gggggggggggggggtttttttgtgtttgtgggggggggggggggggggggggggggggggggggggggggttggggggggggggggggggggtggggggggggggggggggggggggggggggggggggtgggggggggggggggtgggggttgggggggggggggggggggggggggggggggggttgggggggggtgggggggggtggtggggggggg

SEQ ID NO: 68787 - DNA, 323 bp, Zea mays
  unsure at all n locations
  Clone ID: LIB3076-060-P1-N6-H5
aaaanattattacaaaaaaaacgcgggcaaaaaaacaaccaacccaacaaaacaggggtccagggctacaaaaaaccaagcgggcaacacgtaaaaaggctacaaacaaggcaggcggaaacgaatcgaaggaaaggaacgcaaacggaacactaaaaaaacaaaaccaggaccgagggaggacaaaaggagcaaactcgaccttaagccaaaaggggacggcacgggcccaggcccaccagcgagggcgggggatctttggaggctccccaggccaaaaaggacccaaccgggggcggagagggccgagcccacccgtccgg

SEQ ID NO: 68788 - DNA, 602 bp, Zea mays
  Clone ID: LIB3076-060-P1-N6-H6
atcaagaatgcatcgctgttattacccagacgcaaacatcccaacccacgtacgctgcgcaatgtgtgcggcgtacacgactcgccgcccgtcacccccaaccaattcgaaagccaaagcctcacgcccgcccacgaatacacagctcactcacaggccacacatcccatcagagcgcatcacactcactcacttcgttcccttggtggtgagtccgtagccgaacgggaagagcgggtcgtagtgcgcgtcgcccacgttcatgggcagctggtccaccgacttgaaccacgtccgcggcagcttccccgtgaacccgtagtcgccgaacagcacgtccgccacgccctgcccctccgaccccggcagccacgccgccaccagcgcgtccatgtcgcccaggtacggctccaccaccagcggcctgccggagatgaggaccaccacgcacttggcggccccgcacaccgactggatcacgctcggcccgggcgccgggatcgtcaggttcaggttgtcgccgaacgtctccgcgtatggcggctccccgaccaccacgatcgcgtagtcgtacttgtcggccagcacgccgctgtccgggc

SEQ ID NO: 68789 - DNA, 495 bp, Zea mays
  Clone ID: LIB3076-060-P1-N6-H8
acaaagaccgaggccccaaaaaaaaaaaaagggggggaaaaaacaaaaaaaaataaaaggttttggcgggaaaaaaattttttttttaaaaaaaaaaacccaaaatttttaaaaaaaacaaagtttaaaaaaaaaaaaaaaggggttttaaaaaaaaaaagttggaacgaaattttccccaaaaagagttcatttttcaacctaaaaaaaaaagaatggtaaattttaaaatttaccctccaaaaaaaaggggggggggggaaaattttttgggaaacccaggggggttttttgcatcaaaaaattttttggggttttggtttcaaaagtggaaatttccccccttaaaaaaaccttgaaaaatacgggggtcaagaaaagaaaaaaccaaacacaatttggggggtttaaaaaaaagccctgaaggtttccggaaaaaatttgggggggggcccccaaaaaaattaaaaaaaaattttggtccccgaaccgggg

SEQ ID NO: 68790 - DNA, 621 bp, Zea mays
  unsure at all n locations
  Clone ID: LIB3076-060-P1-N6-H9
accaaacggggtctcatttccatgaaacgagcaaggaagacctatggctcctatgaatcagtgctataagctacagggctgacagacttcatcataacattttgaaggaaaaatcccaggcaatgggagtaataatatggtaccgtcaaccgtcctctagtaaaatttgacagattgcaaaaccatccgcaggtgaaactttgaagaaagtatgtctaggagaaccatcttccgctagcaccacaccattaatgtatgccgagaggtcaagcaccggaactccagcgactctgccccttcatgacttgttcggacttgtccggttagaggtgaattgaataggagaggattaaatcatctccaatctccctcaaactacctcaagccctcgaggtttagttcttggcccttcagccaagctcaagcagaaagatgccagcctccgcccccacagtgctatttcacaatccaatttctttgcacaaggaactagcgttcgggattattccactcccggagtttctaatgacggcatcacctgcaaaatccttcagcagggatgatgggtcctttgacccgccgaaccgcaanaatttgtccctgatggcactgcctgcactg

SEQ ID NO: 68791 - DNA, 661 bp, Zea mays
  Clone ID: LIB3076-060-P1-K6-A1
ctccgtctgaagcgtggccgcgattcccatttctgcttcgactcggttttccctgattctacgacacaggcagaagtctacagcacctcaacagcagaccttgtggagggtgttctgcaaggtaggaatgggacagtgttctgctatggagctacaggggctggcaagacctacaccatgcttgggacaatggaaaaccccggggtaatggtgcttgcaataaatgatttgttctccaaggtgacgcagaagaaccactcaattaagctgtcatacctcgagatatacaatgagacggtgagggatttgctgtctcctggtagcccccttaacctgagagaagataaacagggaattgttgctgctggtcttacccaaagaagtgtatactccacggacgaggtcatggagttacttcagaaaggcaacaagaatcgaacaactgaaccgactcgagtaaacgagacctcatcgcgttctcatgcagtactgcaggttgtcgtagaatacagatccttggatggagttaacgtaaaacgagctgggaaactatctctcatcgatcttgctggatccgaaagagctctggcaacagatcaacgcacgcagaggtcaatcgaaggagcaaacattaaccgctctcttcttgcactcagcagct

SEQ ID NO: 68792 - DNA, 589 bp, Zea mays
  Clone ID: LIB3076-060-P1-K6-A11
cccacgcgtccgcggacgcgtgggcgagactagagatttctcttgcaatcacgaatccatggcggatgctgaacctgttgatcagaagattaccttgaggaacgttgcaagccgcaatgtgtaaaaacattgtatgattatgagaaatgcgtcaagagagtcgagagcgacggaagtgggcagaagcactgcaccggccaatacttcgactactggtcatgcgttgacaagtgtgttgcaccaaagctcttcgacaaactgaaatgataacggaacgcaactttgaaggcgcggctcctttcaggaagtcaaatagctccaataaacccatgccttggcctctggaatttgtttgctgaacctgtggcagggagcctcattttgatacgttttgctgaaccgtctttgtttttttttcccctgaatctgtgtggtatcgcaagcgtcgagcccaatttcttttgtataagaataatgaggtgcccataaaaaataggccccaagaagattgttcgaatgtacacaagcaaaacaaatttcctcataattggcaactcgaatcctagatgtggcaaatcactggattgag

SEQ ID NO: 68793 - DNA, 646 bp, Zea mays
  unsure at all n locations
  Clone ID: LIB3076-060-P1-K6-A2
tcagctagcgagcgagagagaggggaacaaaaaggaagggcgaggaggacagggagccgagcgcaagagctgaggcttcgccgcgaaaccccagacctcgcgccgccccttcccctccgcggcgtcgtcctcgcacgctctccgatccaagatgtataagctggggagaggaaaccgcgacaaggtgcagcagttcatgaccattaccggcgccagtgagaaggttgcccttcaggcactgaaagctagtgattggcacttggaaggagcttttgacttcttctatagccaacctcaggtttctgtggtcaatactcggcatcttgaagatattttcaacagatataaagaacctgatgctgatatgataatggtggaaggaatatctcaattttgcaatgatctacaggttgatcctcaggatattgtcatgcttgtcatatcatggcacatgaaagccgccacaatgtgtgaatttactcgtcaggaattcattggtggactgcagtcaattggggtagattcaatcgagaagtttcgtggaaaattaccatcattacgagctgagctaaaagatgacaataaattccgtgatatatacaactntgcattcacttgggcaagggaaaagggtcaaaagtctctc

SEQ ID NO: 68794 - DNA, 483 bp, Zea mays
  unsure at all n locations
  Clone ID: LIB3076-060-P1-K6-A3
ccacgcgtccgcatctaacaagctcgaggggctccctggtgttctctttgtgctcccggattcgtatgttgatgctgaatacaaggactacggagctgaactcttcgtcaacggtgagattgttcagaggactcccgagaggcagaggagggtggagcccgtgccgcagagggcagcagacaggccgaggtacaatgacagaacccgctacgcacgcaggagggagaaccagcgatgaactgtgcgataaaatcataaaaaagaccacagcaacaagtcccaggtggtttcagctctggaattcaaggatcacctagtatcacctgtattaaattggcaatctcactttacctgcagtctagagtatcgtttctatgtgctcagcttggacgtattgtattctgtaattacagctacttggagatttggaaggacctggcttgcaacgtagtataatctctagtcttttttctttgtggcnnt

SEQ ID NO: 68795 - DNA, 533 bp, Zea mays
  unsure at all n locations
  Clone ID: LIB3076-060-P1-K6-A4
gtgccacttgcggcgcatctgcaagtcatgaggcatacacgctgatttgatgaaattgccccttgtattggttttggcgaactaaagagaactgcggttcagacatgccatatacttggagatgcattggtggttgattgtaaggttgcaagtgcatctcaaatttacaacaaaaatgggaaatcacgtgacttgattatcctccattcagccctatacataacgctatataatgtatatgccattgtacaacacgggctttgacagacaccagctaggctccaaaagggcatcccatgtagtagcttcacagtgtgttgctggatcacaaggaagtttagttatgtttcccaagcacagctggagaaagttagtttggcgtcagatgtattatgtatatttagttctgactaagctgtacaaagctagcagaagtgcgcaaatgtcctttctggatcgatctgcctgtaattntgaatctgcacatcgaagtaagcaggaatgtttcgtataaaaaaaaaaaaaaaanaaaa

SEQ ID NO: 68796 - DNA, 585 bp, Zea mays
  unsure at all n locations
  Clone ID: LIB3076-060-P1-K6-A5
aggccgccggacctccctctccctctcccggcgttctctctccctttctcctccccatgctctataaaacgaagctccgtgcccgactgcccgtggtgccggttccctgcaatcccgagctcgccctcacgctctcgtcctccctgctcgcgccgaccgccgccggtgccctgctcactgccgccggagcctcggagccgccacccggagacctcggcgccgtcctcatcgaccccgccgccgtccgacgtcgaccagcgctgccgaggacctcgacatcgcccttgccgacccctctgctcagtcgatcaccgtcgcccctcccgtgctcgctcccagcccccctacgcacaaggaacagaggaagaagctgattgtgtggtagaggacccgaattcgtttgaggaaaacctgcatgacttttgtgatcaagaaggtgatgaggaagactttgacgaagattttgacgagttctaagtctagcgacgctccagtcatcttcctgtgggagatcgcctatgttatttccgctgnattttgattatgatactgtttaaggctcttaagtctggatgatgtaataaa

SEQ ID NO: 68797 - DNA, 207 bp, Zea mays
  Clone ID: LIB3076-060-P1-K6-A6
gatgatccagcaaatgcaccctttttaaagagcatcaaggattctgactgcccaactgagcttgtgccggctgatgagaaatctatagtgaatgtgaatcttgtccggacggaagaagaatttactgagccagtcaagcgtgctgctccttttgaaggggaacgaagaaacctcatggaaccttctgataataatacttccaatgct

SEQ ID NO: 68798 - DNA, 430 bp, Zea mays
  Clone ID: LIB3076-060-P1-K6-A7
gggccgacttccgggtcgcccagcgtccggaaacaagcgctgacccgctcgcgaggagcgaaaggcgagcgcgcagcccagcgcccgtggcggaggcgaaacccccaccgacgcatcgcgcggagaccctccggtccggaccggaccgaactggagcccgcacactctctccgccggcggacgggatacgatccaacgtcacggagcgccggcacgagcatgctaggaatggggagcgtggaccggcgtggggccaaggggatccacgaagctaatacagcgcgcgcaggacgattggatggacagaatgccttactcccagaatgcagcgtagactgcagatccatcgagtgaagagctgaacagagcggctcaggacggcgacgtgctggcgccgattgagaacacacggacacgagccggtcttgac

SEQ ID NO: 68799 - DNA, 626 bp, Zea mays
  Clone ID: LIB3076-060-P1-K6-A8
cccacgcgtccgcggacgcgtgggatacgatcgagtccttaggtttccgaaatagtgtaatggaaaaagaagtgcttcgaatcattgctatttgactcggacctgttctgaaaaagtcgaggtatttcgaattgtttgttgacacggacaaagtaagggaaaacctctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggttcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtccacagataagtcat

SEQ ID NO: 68800 - DNA, 399 bp, Zea mays
  unsure at all n locations
  Clone ID: LIB3076-060-P1-K6-A9
cccacgcgtccgcggacgcgcggggtgccggcgggacacgcaacaaacccaaacccagcacggcagcaccgaaaagcnngcggaggcncggcacagaagacggggagccgcgcgcggacgacgaggggagccgcagcgaggcggacccgaagacacaaggcacgccacagggcaacaaccaggcgaccacacggggacgancgacgccgggcagggacgagcccaccacaaggagaacagaagacaggagagcgggaagccgacagggcgcaccagacaggcccagaacgaaacacacgggaggaggggcaccagacacagcagaaggaaacagaggcngaccagagcgcagccaccgcgacagccggggcaaaagaagcgacagagcacaagaacgcc

SEQ ID NO: 68801 - DNA, 319 bp, Zea mays
  Clone ID: LIB3076-060-P1-K6-B2
cggacgcgtggcggacgcgtgggtcaccatccagatcccctcctgtttctccccggcgtgacaagtctgcaagcaggagtcctgccaggagcaagagtctgccccgatcttgttctccggcaaaatcagagtgaatcggattctgcacttgaaacgttcagaaaggcagagctcgagctaaaagattgctgtacggattatgagcactgtgctagtagcattgctgtcccttccatatttttacaaatactctgttctttgaggagatcactgtatgctactactctgtacctgacatgatgcaaacgttgttggtttt

SEQ ID NO: 68802 - DNA, 398 bp, Zea mays
  Clone ID: LIB3076-060-P1-K6-B4
ggcccaccggaggcagagcgcggcggcggtgcggctggaaccggagacgtgggtactcgagtaccagaggagcgcgcttttcgagggcacacggctgctaccggccgccgcggacctgatcgcgtccaggtgctcgacgatggcgcggcgagcgcggcgcaggatgcagggtaggcggcggcttttcggtggtgcacaggcgaatccaacctgaatcgggctcgccggaggtcaaattgctctcttgccgaagaacaaaatgctctctaggctagctctagtagtagtagattcatctcatttcgtgtgagattcatcatgacttctgtgttcttttgcatggtctatcaagtgtaggccgacgctggaatcattttaatcttgttattaaggatcac

SEQ ID NO: 68803 - DNA, 196 bp, Zea mays
  unsure at all n locations
  Clone ID: LIB3076-060-P1-K6-B5
gtcatgagcggcggccatccaaggacacctttctaccaggcattcctaaagctagcaaagtccatatggttgctgcacaggttggcgcactccttcgatccaaaggcaaaggtgtttcaagtgaaaaagggaagtgaattttcggatatccacatggagagcgtcgtgaaggacatcatcctagaagnatgtcgcg

SEQ ID NO: 68804 - DNA, 644 bp, Zea mays
  unsure at all n locations
  Clone ID: LIB3076-060-P1-K6-B7
caaaaccaaagcgctcagccgctcgcgaggagcgaaaggcgagcgcgcagccgggcgcccgtggcggaggcgaaacccccgccgccgcatcgccctgagaccctccggttcggcccgggccgagctcgagcccgcgcaatctcgccgccggcgggcttgatctgatccaaggccaccgcgcgccggcgcgggcggcgaggaatggggagcgtggacggccgcggggtcgaggggatccacgaagctaatcggcgcgcgcagttgattggatggatgaatgccttactcccggaattcagtttgcctccggattcatcgagtgaagagctgcgagagctgctcagtgacggcgtggtcctgtgccgtcttgtgaacacactcatcccgggggttcttgagggatcctgggagggttatgcaccgtcagatcagaggttaggcaacgtgaagaaattcctctcggtggtctctgatatggggctgccaggcttcagtttgaaagatcttgatgagggattaatgtcttctgtagtggaatgtctcttggttttgaggggcagtgtggatcctagattaggtgatgatattccaccagatgttaccagaactcctttgagaaaacaatggngagttcaggaaatgga

SEQ ID NO: 68805 - DNA, 143 bp, Zea mays
  Clone ID: LIB3076-060-P1-K6-B9
cccatgcgtccgattgctttttgcaagattggagcctggatgaaagcagtggttcagagctaacttctgttctagagatgcggatgcttgactctgtgaatgaaagagtagacgattcgaacctactcctatgtggatctctg

SEQ ID NO: 68806 - DNA, 563 bp, Zea mays
  Clone ID: LIB3076-060-P1-K6-C1
ttctggtcttcttcaacatgagtccaaaatgtcagttcttcacttcagcataaagaaacacgactcttacgaagctcctatcaaatctaaggagcctttgattttcaatgttggattccgacaatttacggcaaggccactgttttcatccgacaacatcaactgcaataaacacaagatggagagatttctgcaccatggccgattttcggttgcatctgtatatgctccaatttccttccctccacttcctctaatagttttgaagaacagagatggcgagcaacctgccattgctgctgtaggttcgctaaaaagtgtggatccagaccggatcattctgaagaaaattgttctgaccgggtatccacagagagtctcgaaactgaaatcgatcgtgcggtatatgttccacaatcccgacgacgtaaaatggttcaagcctgttgagttgtggacaaaacatggtcgtcgtggccgcatcaaggagacctgtggtactcatggtgccatgaaatgcttattcaatagcagcattcagcagcatgatacttgtgtgcatg

SEQ ID NO: 68807 - DNA, 662 bp, Zea mays
  Clone ID: LIB3076-060-P1-K6-C11
gcagcgcaaagggccagggacttccatattggttggtttcttgatccattaataaatgggcaatatccaaagataatgcaagacattgtgaaagaccggctaccaagtttcacacctgaacaggccaagctagtcaagggctcatcagactatttcgggatcaatcaatatactacatactacattgcagatcaacaaactcctccgcagggaccaccgagctactcgtccgactggggcgtccaatattactttcaaaggaatggcgtgcaaattggacagatggcgcactcaatttggctttacatcgtcccatcgggcatgtatggagtcgtgaactacctaaaggaaaagtaccataatccaatcatcatcatatcggaaaacggaatggatcagcctggaaacctcacgcgcgaggagtacgtgcacgacgccgtgaggatcgacttctacaagaactacctgacggagctaaagagagggatcgacggcggcgcgaacgtgatcggctacttcgcgtggtctctcctggacaacttcgagtggctgtcgggctacacgtccaagttcggcatcgtctacgtcgacttcgcgacgctgaagcggtaccccaaggactcggcgtactggttcagagacatgctttcggggacgggctc

SEQ ID NO: 68808 - DNA, 669 bp, Zea mays
  unsure at all n locations
  Clone ID: LIB3076-060-P1-K6-C12
cccacgcgtccggtgaatcttttcctgccgaaaaggagatgctacgaaatgtggaggccaagatactcacaaaacgagctgaactttccaaatttgagtcagagtatagggaggttttggcgaagttcactgaaatgaccagcaaatacacacaagaaatgcaagcgattgatggccttctgaaggaaaggaatgagatccatgcttcctataccaacaatccacctctaaaacggagttccagcaggaataaagccaagtcgccttcgaaagtggccaaaactggtacagaaaaacatcatcagaaggaaaagaaggtgaaggatcactgcatggagggatgtggaagtgacagcgataactcaagtgaaaagaaatcaaaagagcggttcccaaggaagaaatggctgaaccttccattcaaacttgacaggagaaagacgtgctgagcaatgtattatatgttccgttgctattctatcctgttatgcataatcctgagctgaactcacatttcttctctttctcatgcttttataggaagtccctctcggcccaacactagattgatatacagagaatttccactgtggcctnccgaaccaagccctctcccactgctaccaccttccttcgttgtacccggattatttcgtgtaaagatcacat

SEQ ID NO: 68809 - DNA, 549 bp, Zea mays
  unsure at all n locations
  Clone ID: LIB3076-060-P1-K6-C3
ccacgcgtccgcccacgcgtccgctcctatcgtcggagaaccaccgaatccaccgcatcgcagagacgagtagaggttagatttaggctgaggtaagatggtgtgcatccggcaggcgaccatcgaagacctgctggcgatgcaggcgtgcaacctgatgtgcctgccggagaactaccagatgaagtactacttctaccacatgctctcgtggccgcagctcctcttcgtcgccgaggactacggaggcagcatcgtcggctacgtgctcgccaagatggaggaggacccctccgagccctgccacggccacatcacctccctcgcggtcctccgctcccaccgcaagctcgggctcgccactaagctcatgtccgccgcgcaggccgccatggaccaggtcttcggcgctgagtacgtgtcactccacgtccgccgatccaaccgcgctggcttcaacctttacacctntaccctcgggtaccagatccaggacatcgaggccaagtactatgccgatggggaggacgcgttcgacatgcgcaagct

SEQ ID NO: 68810 - DNA, 610 bp, Zea mays
  Clone ID: LIB3076-060-P1-K6-C4
gaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggaggagtgcaatttgtaactttatgctgtttgttcgcttttagacggcgtggcgaagtagtgtaaaaacggctttacaagtctattttgtgtggtagttcgtgtaccgcttcgtcccgaagcgatcttgggtaaagactgatgattcgtgttggcaaacgacacaattcgt

SEQ ID NO: 68811 - DNA, 605 bp, Zea mays
  Clone ID: LIB3076-060-P1-K6-C5
atcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgccaggttcctcaaggcgggcaagtacgcggagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcggggaggagtcgggtttgttgggaaggaaaattagattagtatcagtttttttgaatgggatgggaacgtggctgtgaat

SEQ ID NO: 68812 - DNA, 638 bp, Zea mays
  Clone ID: LIB3076-060-P1-K6-C6
gcagcaggagcgcccccgtctccctccacccttctccctctgtcagggtcctccgagtcggacttcctcacggccgccgcgccaaatcccgtctcgttgctccggtccgctgcgcatcctcaggaatggaacttggcgccaccactgccctctaccctctgcaccgctgcaaaaccatttacctggtcaggcatgcccagggcattcacaatgtcgcgggggagaaggactttggcgcgtacatgtcacatgaactgttcgatgctcagctcactcctttgggttggaaccaagtcgatggtctgcgggagcatgtgaagaaaagtgggcttgcagaaaagattgaattagttatttcttcccctttactgaggactatgcaaactgcagttggtgtctttggtggtgaaaagtatactgatggtgtaaatgcacctccactaatggtcgaaaatgccggacacagtggccgtccggcagtttcaagtttgaactgccccccatttattgcagtcgaaacctgcagagagcacttgggtgtccatccctgtgacaagaggaggagcataaccgaataccggcctctctttcctgcgattgatttttcattgatagagaatgatgaagatgttctttgg

SEQ ID NO: 68813 - DNA, 637 bp, Zea mays
  Clone ID: LIB3076-060-P1-K6-C7
atctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgctttatgtcattcctaatggaataggaaatg

SEQ ID NO: 68814 - DNA, 570 bp, Zea mays
  Clone ID: LIB3076-060-P1-K6-C8
cggacgcgtgggcgtgacagagaggaaagaagaagaacccgtagctctcaatgcatttgaactgatttcaaggtcagcaggcctaaatcttgggaacctatttgactcggagcaggaattcaaaagagaaacgaggttcacgtcaagatgtccaccgaaagaaatcattcgcaagattgaggaagctgcaaaacctctaggatttggtgtccagaagaaaaactacaagttgagtctagagaaagtaaaagcagggaggaagggaaacctgaatgttgctacggagatactacaggttgcgccctcgcttcatatggtagaagtccggaaagcaaaaggcgacactctggagttccaaaagttctacaagaacctttccaagaccttaaaggacgttgtctggaaatctgaagacctgcaaatgcgagctgcttcttagcacccactagatggcgagatgttcgtacgtgtcagattccattcccgtagcatgatgtgtcgtcagcggtttctagtcactgcgctctgcatggtccggtgggcgcgtggcttggcattttcagagatcgc

SEQ ID NO: 68815 - DNA, 665 bp, Zea mays
  Clone ID: LIB3076-060-P1-K6-D10
cccacgcgtccgggcgatccatccctcaccatgtcgtcggagaaggaggcggcgctcgccgccgtgctcgatgacagcccaaccatatttgacaagatcatcaaaaaggaaataccttctactgtggtttatgaggacgagaaggtactggctttcagggacataaaccctcaagctccaacacacattctcatcatccccaaagtcaaggatggactaactggcctggcaaaggctgaagagaggcacatagaaatacttggctatctcctctatgttgccaaggttgttgcgaagcaggaaggacttgaagatggctatcgcgtcgtcatcaatgacggcccaagtggatgtcaatctgtttaccacatccacgttcatctcctcggaggcaggcaaatgaactggcccccaggctaagaatatcttgtgattgatcagtgctaatgccaaggactgctactccatttctctagaataatccctgtaatttccataaaagctagtgcgcagtgcgctgaccttgtgctatatttgtggaattaccggaagcatgctgctgtgatctatgattggacacaagaaacttgtaactggtactcctatcatcgattgacttgtccttattgatcagctgatgggggttgcccactggccttgctgat

SEQ ID NO: 68816 - DNA, 586 bp, Zea mays
  Clone ID: LIB3076-060-P1-K6-D11
cgaatattcacatttctttataccaaaagcagacgatacgcaaaaaacgagcatatctgacagtaacatgcaacgggtagcgctacaacatagatctagcataaccctggcagtttagtaacttggacccatgctacaagaacgggacagtcgcttttccatctttcgtccagtcccaactgttgctcttgagccacctccaccgccgccttctgctgcagaaactgtgttgtattgcttcctgcaacctgggcagcgcccatcttccaccaagatcctgttgtggcagaagaggcacatgtgaaacccacaaggacagggacagaagctcgaatctgtcaggtcaagatcgtcacagcaaatggggcacgacagcggcaatgaaagaattccctgctgtgcagcactcattcccatatcctgccagcggttaccaatgcttgctgggaagctggtctgcttggagatgctgggtaagctctgtggtcgaaatatgtcatccggtgcccaagcccttgtcttgctttgaatcggttctggtttcgctgcatgagaaggttctgcagtggtcggagcttgtgggagt

SEQ ID NO: 68817 - DNA, 419 bp, Zea mays
  unsure at all n locations
  Clone ID: LIB3076-060-P1-K6-D12
ccaacgccttgcnnggcaccaagcgagagcggcgcgagcaccacaggagagggaccagacagggcagagngaggaggcaaagangcacaaccncgaanngacacacaagngcgcaaagaaaaggcaaagcaaaaaggggaggaagccgacgacngagccgaaannccagnaccagggggcccagacagacacgcagcagnaccgagcaccccnccgccaagcggcagaaccgcaaccacccggnggagcaaaagccaaggnngagncgacaggcangaagaaaccaccagcacaccanccacaccacgnaaggaaccaggagcgagggagggaaggaaggggaancganaggacaagggcgcagannggacacgnanacgaaacgnganaaacaacagaaaaggnaaaaccangagnng

SEQ ID NO: 68818 - DNA, 573 bp, Zea mays
  Clone ID: LIB3076-060-P1-K6-D2
cccacgcgtccgacccagcttacttggctgcacgtttggcatccttttatgaacgtgctggtaaggtaaaatgtctgggaagtccagacaggaatggcagtgtcacaattgttggagccgtctctcctcctggtggtgatttttcagaccctgttacctccgcaaccctcagtattgttcaggtcttctggggtttagataaaaagctcgctcaaaggaagcatttcccatctgtgaattggctcatttcctattcgaaatactccaaggcccttgagtctttttacgagaaatttgatccagatttcattgatattaggacaaaagcacgtgaggtgttgcagagggaggacgatctgaatgaaattgtgcagcttgttggtaaagatgcgctggcagaatctgacaagattacgctggagacagcaaagcttttgagagaagattatttggcacaaaatgcattcaccccatatgataagttctgcccattctacaaatctgtttggatgatgcgcaacattattcacttcaacacattggcaaatcaggctgtggagccggcagctggta

SEQ ID NO: 68819 - DNA, 425 bp, Zea mays
  Clone ID: LIB3076-060-P1-K6-D3
ccacgcgtccggatcttgtgaccctccctcagccgcgtcgcgtcgcatcctacgatccaaagctctctctgctcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggtgcttatctcggggctggacatcgcggtgcggctgctcgagcccatcaaggaggagttcccaatcctctcttacgccgatttctaccagctcgcgggagttgtggccgtggaggtcaccggtgggcctgaga

SEQ ID NO: 68820 - DNA, 619 bp, Zea mays
  Clone ID: LIB3076-060-P1-K6-D4
ccagtttggctcgtctcggcctcggcgcgtgcccccgacccgttgctgaccccgctccccggtgatctgatgtcggcggcggcacgcgcgccaccgccgccgcgcgcactctacgcgccgtcgagaagagtccctttcggtgccgtgatcctatccgcgccgcgacccggggctagggttcgcgcggcgcggcctcgcgaggggaatgttcataaccattgcctgttgacatcgtctagtctgaattcaagttctttgctatgccctccatgcaattgtgctcaaatggctttggccgacacaagaattgcttaccagcctgaagttgacaagcatgctggagttctggcctatgaactggttcaagggaatcttgttcagtggaattcatttatggacaaatcaatacctgatccaccaacagctgttcttcttcatggcatccttgggagcaggaaaaactggggatcttttgcgaagagattggctcaggaattcccaatgtggcagttcctcttggttgatttgcgctgccatggcgactcaacatcaattaagaagagtggaccacacactggtgcctcaactgctcttgatgttctaaagctgataatgcagc

SEQ ID NO: 68821 - DNA, 558 bp, Zea mays
  Clone ID: LIB3076-060-P1-K6-D5
tctcgattgggccaccgaattcacgttttttgccttcaaaagacaagagctcgtgggatccaaaacatgttgctgattgcattttatctgatagatctaccatgaaggtgacaactggccagcgcatgacagagagttctgtccttgacgcacacgttgcagaggttgatggagaaccatactggtattatgagtatcttgttcggaaatcaccaacaaaatctgcaccagaaccaaatttgtttcggcacaatgtagcctgcactgctgagcgtgatgggtacctgtactcactgaatgcttccactcttagcaaacagtgggaatctatggggccctttctacaaaagaccgtggcatcctttcgccttctccccggtacagaaaactatgttcctccctacaaggatccttggagattttggtgaatggagattcttcttgtagtcatcatttttatcccttcagatgactttatagcttcaggttttagaccatatttttcacgtcagatgtttagtgagtgtctgtcctttcagcttgacagataaaattcag

SEQ ID NO: 68822 - DNA, 90 bp, Zea mays
  Clone ID: LIB3076-060-P1-K6-D6
tttttttttttttttttttttttttttttttttttttttttttttttttttttttttttttttttttttttttttatttttttttttttt

SEQ ID NO: 68823 - DNA, 648 bp, Zea mays
  Clone ID: LIB3076-060-P1-K6-D7
ctcgacccttccttcccaggacgtgatgaatgctctcctcgaggctctctttgacggtgtgggcaagggatttgcaaaggaggtcgtgaagaacaagaagtaccttgcagttgctgtgccagatgagggtgcccagaccctgctggttcaagccatcgaggcttttggcagcaagtgcaaccccgaggcgctgaaggaggtcccagttgtcctgaaagccctgtacgacggagatatcctggaggaggaaaccgttgtggactggtacaacgctgctgtcgcagctggaaaggactcccaggtcgtcaagaatgccaagccgtttgtcgagtggctccagagcgccgagtctgacgacgaggatggcgatgaatgaagaggcgatgctgctctactgttcatggcttcacttgataatattaattcaataagtttattttgcttgtctggtgtcatcgatgtcagtcttcgtttggtgtcagtcggtctggtgtcgatgtctaaaaactgttattgtcgtgccgcgcagcataccctatgtggttggctgcgtttggtgtcagtccgttttgtgtttggatgtcacggtttattatgttcctgtgggctgccactatatattatagttgcttgggatgtgttttttat

SEQ ID NO: 68824 - DNA, 653 bp, Zea mays
  Clone ID: LIB3076-060-P1-K6-E1
aggaaactctgatcagagacttgggcactatatcgctgggcaggcttcaagttcaatacggttgtcagatctcgagcccttaattcacaacaagagaacagtgaagcatatcctaacaactatctctagcatcagaaatgctcagtctctccttttcaccaccatgtatgagcttgaggccagtgtcattgactcgctaaggtcagtactctcttgtccagtgtacccaataggcccctgcgttccatacatgatgcttgaagaccataccgtgtccagtggcaaagttgccaggcaaggagattatttcacatggttggattctcaacctgtgaattcagttttgtatgtctcccttggcagttttgtttcagtctcagcctctcaacttgaagagatcgcattgggcctaatagccagtgaggtcaggttcttgtggattcttcgagaacaatcccctcgggtgcaagaactcttctctggcatcaataatgggatgatactgccatggtgtgagcagcttgaggtgttgtgccatcattcagttgggggcttcatgacccattgcgggatgaactcgacacttgaaggcgtcttcgctggtgtgcctatgcttgccttaccactgttttttgatcaaccgattgatgggc

SEQ ID NO: 68825 - DNA, 422 bp, Zea mays
  Clone ID: LIB3076-060-P1-K6-E12
ccattgccttgctttgtactaatatacagcagcactagtaccataggtgattgacttgtcatggctgagtgaggaggcaaagatgcatatccttgaattgatactcttgtgtgcaaagaaatggcaatgcaaattggggaggaagctgttgtttgagctgaaattccagttccagtccgcccagacagacacgcagcagttccgagctcccctccgtcaagtggctgatccgcaaccacctgttggtgcataggctaaggttgagttgtctgtcttgttgattctacttgtcttccttctactccatgttggttaccaggagcgagggagggaaggaaggggaatcgataggattagggtgctgtttggttcacgtatttgtaatgtgataaataactgataatgttaaattatgtttgttt

SEQ ID NO: 68826 - DNA, 473 bp, Zea mays
  unsure at all n locations
  Clone ID: LIB3076-060-P1-K6-E2
caaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatcccaagggtgagatgaaaggttctgcaatcactggacctatcggcaaggagtgtgctgacctttggcctaggatcgccagtgcagcaaatgccatcgtttgagagcttgttggaatgtgtttagacttgagtatgatcatctcaattgtgtgttgcaggtgttgtaagggtgctattggacttgatggctccttttatgtttggtcactcaattctgtagtgaacagaaatttctggttgcctcannnnnnnnnnnnnnnnnnnnnnnnnnnnnnnnnnnnnnnnnnnnnnnaannaa

SEQ ID NO: 68827 - DNA, 603 bp, Zea mays
  Clone ID: LIB3076-060-P1-K6-E3
aaccgagtctagtgagccaagctttgcgggcatgaaaaagaagaagaagaaacatgtggaacttgattcttctcttaccgagaccggagatgttgatgacacaggagacgatcaagttagagaggatgaagaaggagaagggattgtgctcgctggtgccgctgccaccagatacccttgggaaggaactgacagagattataagtatgaagagctgcttggcagagtattcaacattttgcgtgagaacaacccggatcttgctggtgatagaagaagaactgttatgaggccccctcaagtcctcagggaaggaacaaagaagacagtttttgtgaacttcatggacttgtgcaaaacaatgcataggcaaccagaacatgtgatgatgttcttgcttgctgagatgggaacaagtggatccctggatgggcaacaaaggttggttatcaaaggaagatttgcaccaaaaaatttcgaagcgatacttaggagatatatcaatgaatatgtcatatgcaatggttgcaagagtccggataccattctttctaaagagaacaggttgttcttcctccgatgcgagcagtgtggttcatcgag

SEQ ID NO: 68828 - DNA, 342 bp, Zea mays
  unsure at all n locations
  Clone ID: LIB3076-060-P1-K6-E4
cttgaagatgtagatcttgtaggtgcacctgctncagcacctngaagatgtagatcttgtaggtctccacgctcttcttgcccttcttcttggtgctgaagcaggtgcacccgcacattggcatctnctacacggccacgtgcatcaggaactccaccattaaccagtatccaggaggggggggcgcctcangccgccaagctcgcacgctataacaagaaggctaccatcacccccccggagaaccagacctnctagcgcctcggccttaccggagagctcgacaagcacgccggctgcaagggctctattttttttatcaataacctaaaactaagctga

SEQ ID NO: 68829 - DNA, 196 bp, Zea mays
  Clone ID: LIB3076-060-P1-K6-E6
gcgaagtcgtcgtcgttcggttcggagcggatctgaggcgacgatagatggaggcggcgggatctctcggtctgcagtcctgctccacctcgatggatgatgtctctgcgctgataattattggatcaatttcgataattattagtagatctatgagatatgccgcctggaagaggcgaggtaagctgcagcatgt

SEQ ID NO: 68830 - DNA, 445 bp, Zea mays
  Clone ID: LIB3076-060-P1-K6-E9
gctggaactcatctcgggtttccagcagcccggcagagtcgcccgtttcgggggtgctggcatcctcgtaagcggcaacgtctcggaccctgtggctgctgctctcaaggctcagtatggtcccggttctaagattatgggcagcgacgtggatccttggacggacataggaagcaggtagcgccgtagcagctctactgcttctgttgctccttgtaccatatatttagttttggtgtaacttgaatgaaatcatcagaatatgagatgtggggggtggggagtgaatggctatcctgcccatactatctgtaggctgtcggccagcagcagtcgggttgcgttgatactggcattaacacacttactacttcgctttaaaggttctgtctagcttctggaacatcattgacattataatacgtggattaaggcattggccggc

SEQ ID NO: 68831 - DNA, 631 bp, Zea mays
  Clone ID: LIB3076-060-P1-K6-F10
gttctagatcgcgagcgggccgccctttttttttttttttttcataagtactgaccgatacattgaaacgagcaaataatacattggaaacgagcaactaattccctatctggcaaatctagagcaagagcatgagaaggtgttattcctctgcgctagtaagattcagctgaggcgactgcaaatgccgtctctttgcttcgttactcggcggctggagcgctgtgcttccagtgctcaagcggacaggagatcagaagaacgcccggctgccatagaacaccttgggagatggcttatcctgcttcccggcggcggctggcttcttcaccgcgatcgagtcggcaccagtggagtctgcgtcggttgtggctgctgcaggactactcctcccgctgctaccattgtctatgtccaagtccaaggcagggagcttcattttagccagggaatccgtgaattgctgcatgctcttcatgtacatgtccatgatctggttcccgtccaccttcacctcctgctcgatgttgacgctgatcaccggcttgtccacggcggcctccgacgcggcgccgggcgagttcgccgccgggacctcctggacggtgcgggacgaggcgacctccgtgtc

SEQ ID NO: 68832 - DNA, 265 bp, Zea mays
  Clone ID: LIB3076-060-P1-K6-F11
ggccaagaagatccgtggtgtcaagaagaccaaggctggtgacgccaagaagaagtaaacagtcatttatatttctgtattactgtcctgaactctgggtggtcgtctagttgcaatgtcataattatggtcgtgttaggttttgttccgcactcagcagtaagtgaagttttgtaattcctggatgtgaacctacccggattggctgtagcatgttgtgagatgagaaggctattttgtcatgcagttgtgtcatttgcaagcc

SEQ ID NO: 68833 - DNA, 519 bp, Zea mays
  Clone ID: LIB3076-060-P1-K6-F12
atcccaagcaaatttcgaaccggagaatgaacctcataatgttgacgtgaacatggagcaaccgacagttatgagtagcgccaaggggcaaaagggagctcaaaggagaaacaagaccaaaaaattgaatcaaagaaaaatccttggagatgttgaccttgcgcggcagtctggagtgagaagaagctcaagaatacgctcgaggcctttggagtattggcttggtgaaagattactatatgggccgatacaggacactttgcctgcagttattggcatcaaagcatactctcctggccaggatggcaagaaaacattgaaagtgaaatctttcgtgtctgaacagtattcagatcttgtcgctcaatttgcgaagtactaaacaagacaccatttttctaagaggatcacgccttgtgacttgttgctttgtcacctgactttatgatgttacatgtgttggtggaaccatagtactgcacaatgaaaaggcacacgtcctaccgaatggttgccagt

SEQ ID NO: 68834 - DNA, 354 bp, Zea mays
  Clone ID: LIB3076-060-P1-K6-F4
cgaccgcaaggcccggggccgcgccgccgacaaggctaagggcaagtttactgccgatgacgtcgctgccgccgccgctggtggcgccgccaccggcgcctctctccaggagatcgactagactcttcacggtcatctgatggttgtcgtaccgccttttcctcatctctttagtttttgctaccaattgttatgtgatagaggtcttatgttatttgaaaactgctctgtgcctggatgagagttttggaacataatgtgaacctgtgtgtctgtgacctgagctttgaagatctcattatgtggttaatgtctccttgtagtatcttctaaatggttgctgtgatttgtctt

SEQ ID NO: 68835 - DNA, 543 bp, Zea mays
  unsure at all n locations
  Clone ID: LIB3076-060-P1-K6-F5
cggacgcgtgggagccgaacagatctcctcgtcgtcgcctcgctgtctcctccgccgttgcctgcgatcccgatcatggagggcgacagtaccaacctcgacgcggctatagagtcgctcctgaacgtggagaagcagatgaggctggcaggcgatgtcgccggcacgcggaaggccgtcatcgacatcgtcgagctctgctacaagaccggcgcgtggaagacgctaaacgaccagatcgttctcctctccaagaggagaggccagctttaagccaggccatttacttgctttttggggttccaaaaaaaagggcaaatggggggctctccacttttgtttttggaccccccgatttttgcccccgagggggggggtttttaaaaaaacctggggcggggttttttttgggggaaaaaaaatattttttttttttttttttgtngnngnggggaagtatatatttttaggtaaaaaaagaagaggcgtatttaattttttttttttttttaaaaaaaaaaaaaagaagggttggtggtttgt

SEQ ID NO: 68836 - DNA, 519 bp, Zea mays
  Clone ID: LIB3076-060-P1-K6-F6
atcccaatcaaatttcgaaccggagaatgaacctcataatgttgacgtgaacatggagcaaccgacagttatgagtagcgccaaggggcaaaagggagctcaaaggagaaacaagaccaaaaaattgaatcaaagaaaaatccttggagatgttgaccttgcgcggcagtctggagtgagaagaagctcaagaatacgctcgaggcctttggagtattggcttggtgaaagattactatatgggccgatacaggacactttgcctgcagttattggcatcaaagcatactctcctggccaggatggcaagaaaacattgaaagtgaaatctttcgtgtctgaacagtattcagatcttgtcgctcaatttgcgaagtactaaacaagacaccatttttctaagaggatcacgccttgtgacttgttgctttgtcacctgactttatgatgttacatgtgttggtggaaccatagtactgcacaatgaaaaggcacacgtcctaccgaatggttgccagt

SEQ ID NO: 68837 - DNA, 441 bp, Zea mays
  Clone ID: LIB3076-060-P1-K6-F8
cggacgcgtgggcggacgcgtgggcggacgcgtgggcggacgcgtgggaagtgatgagaaatctcagtccgcgtccccagctctgtcactgtctggtagccctaatcgtggaggcaagaaaggtttggtttcctacggggatggctcacctgattcagctgggaagtaggtttccaccggggcattgaaatgtatcttacaccgttagccattggctgttgatcaggtccatcaatactttttgttatatttctactgtaagaagcggtttggtccttgagctgcccagctgttacatatgttgtttgggatgatcggctatgtcctttggttatcacaagagtcgtaatttgagcttaggttttgctgttgctaaacatgtagcacagattcagtgtgggattttgatgttatataagcttcaacgcaaagaatcattac

SEQ ID NO: 68838 - DNA, 411 bp, Zea mays
  unsure at all n locations
  Clone ID: LIB3076-060-P1-K6-G1
aaatcagagttaacaccatatcagcaggccctcttgggagccgagctgctaaggcaattggatttattgagaagatgatagagtactcatatgttaatgcaccattgcagaaggagctgttggctgatgaggtggggaacacagctgcattcctggtttcttcattggcttctgccatcaccggctcgactgtttatgttgacaatgggctcaatacaatggggcttgcaattgacagccctaccataacgtaatagatgnnggnngggnngatagaccacctncnctgcggcattgaggcatgagcctcgaataagaaaatatggagttattagtacaagaggtctgggatgttgggcctcctgctcnaacaagggaactgcagtgaccatgaagcgcatgctggaaacc

SEQ ID NO: 68839 - DNA, 663 bp, Zea mays
  unsure at all n locations
  Clone ID: LIB3076-060-P1-K6-G11
atgagagaaatgtggtccacagagatatcaagtgtgccaatatattggtgcatgcaaatggatctgtaaagcttgcagattttggattggcaaaggagatgtcaaaaatcaatatgctaaggtcatgcaaaggaagtgtttactggatggcacctgaggttattaatcctaaaaagatgtatgggccttcagctgatatatggagccttggctgcaccgtgttggaaatgctaacccggcaaataccatttcctaatattgagtggacaaatgctttcttcatgattggaagaggggaacagcctactattccctgctacctgtcgaaggaggcacaagatttcattggccagtgtgtaagagttgatcctgagagccggccttctgcatcacaacttttggagcacccattcgttaacagaccactgcgggcttcatttgaatcttcatctcccccagccatctgattgtactattgatatagtggggtgtttctcgttgtgagaccaatgcgcaggtcacgtgttggctttcagagcagaagcaggacaggattcaggaacgaggtacagtccttgcattgatgcaagcagcgacaagggtctccgcctccggtggaggaaactacgtcacgcggtgcggcggngcagtcttccggtgaga

SEQ ID NO: 68840 - DNA, 97 bp, Zea mays
  unsure at all n locations
  Clone ID: LIB3076-060-P1-K6-G12
angagaagaaagnggcccacagaggggtgaagggggccaaganaacggggccagcaaacggcccgcagaagcgagcagagccaagagggaaaaagga

SEQ ID NO: 68841 - DNA, 480 bp, Zea mays
  unsure at all n locations
  Clone ID: LIB3076-060-P1-K6-G3
cccacgcgtccgcccacgcgtccgcccacgcgtccgaatacatcaagaatctcactgctgtgttggagccagagaaagcggatgagttcaaaaagggtgtcgagggtgcaaccaagtttctccttagcaagctgaaggacctccaattttttgttggtgagtccatgaaggatgatgcgtctgtggtattcgcctattacaaggatggtgccactaatccgacattcctctatttctctcatggtcttaaggagatcaagtgctaggcgtgcggcgaaattagttacccatgttgggtactatctatgtactattattatatccaaaactatagttgtcctggctgaattgaactcaaaagggtttgtttgagaaaaaattgtcccaagattggattgcttgttaaagctcaatattgttattgaagtgttattgcttaaaataaaaaannctnnannaaaanncaaaaataaacaaaaa

SEQ ID NO: 68842 - DNA, 590 bp, Zea mays
  Clone ID: LIB3076-060-P1-K6-G4
cgtacaacgttgcaagattttgcagttgctgtgcaatctgatccacatttgcttggtccaaattggcccacacaaatcgagaaggtacaggcaatgtcatttggaggagaatgatacatagtggcctgttatagctgatgaacatgaacttctctaaaggagatgctgtttgctggcattgaagtaaatgaaacgacagaccaacaccatgactacaaaatctgagtattgcgttactcacaagcaggagataccaaggcccaccaggtgaacaaagggagatgcaatggacagtgtagcataaattcttccttgggaatctagcctgttgtcaataaatcgaagaatcgatagggttggctgatgtccaggccaagctaagaaactcgtcgacaaacataccctcagctcttggctcaaaaaacatgttctgatagtacttttagagatttgttgtgacgttgtaatagagcattttccccttattagacttaaatggaatcatttttctcagtgatcataaatgatgccttcaatggctcattgctcctgtacattgtattcagattatggcaatgatcacttgcaat

SEQ ID NO: 68843 - DNA, 427 bp, Zea mays
  unsure at all n locations
  Clone ID: LIB3076-060-P1-K6-G5
gcggcgcgtgggcgccgtggagttcctctccgacgcctcaagtcgtacgtccgcaggaggacggcgccgtcatcctcgatggtcgcggcctcggcgtcggcatcttctgctcgagtgggtcgcctcgcctcgccttcggctcagtactacgtctacgtcgacagggagtgcggcggcaaccccatgcgccgcacgccaaggtcggcggcgaggacggcgccggcacctggccctggccttncaggtctgaaggggaccatgagtttttggaagggantcaagcgtcgagtattatagaactatgtggggggacgggatgcacaatgttgtgattcgtttatttgtttattatgtggttttgtaatgtcatatttgtaacgctgttattattgcgatcgagcaaannnnannnnnnnnnnnnnnanaa

SEQ ID NO: 68844 - DNA, 606 bp, Zea mays
  unsure at all n locations
  Clone ID: LIB3076-060-P1-K6-H10
cccacgcgtccgcccacgcgtccgcccacgcgtccggtgcgctgcgacgcggcggggggcgggagccactcgtgcctgccgggctccgtcgtggtgacggccaccaacttctgcccgcccaacaacgcgctcccctccgacgacggcggctggtgcaacccgccgcgcgcccacttcgacatgtcgcagcccgtgttccagcgcatcgcgctatacagggccggcattgttcccgtctcctaccgcagggttgcgtgcaacaagaagggcggcatacgtttcaccatcaacggccactcctacttcaaccttgtgctggtgaccaacgtgggaggcgccggcgacgtgcacgctgttgccgtgaaggccgagcgctcccccgggtggcaggccctgtcgcgcaactggggccagaactggcagagcaacacgctccttgacgggcaggccctgtccttccgcgtcaccaccagcgacggccgctccgtgctcttcaacaacgccgncccccgcggctggtctttcggccagactttcagcggtgcccagttcaactgaacacacccccaccgttcatgcagcgtcgacccagtggcactagtacta

SEQ ID NO: 68845 - DNA, 455 bp, Zea mays
  Clone ID: LIB3076-060-P1-K6-H12
ggatgaaaagggcccaaaatatacatacaacgtcacaacaacccatatagccggccaaatgcccccattacatacgtatacataaacgtagctccacccacgtaaacgtactatggttcacccacacccacacccactacgttacacaagctcagctgctcaggacccgctgatgattacctatatgcttgctgtagcacgaagcgaaaaccatggttcgatcggcgccgtgcccccggttgccttaacagagagctcactttaaagcgcggacctgatgacggggaacgcatccttctgctgctctgcctctgcgtttgcgggcgccctcaacaacttgtccattttcttgacaaacgtttccatggcggggccgggcaggcacatgggcacgacgatgccgtccttgcccttggcgttcttgaacgggatgaggaagctggccaccccgggga

SEQ ID NO: 68846 - DNA, 663 bp, Zea mays
  Clone ID: LIB3076-060-P1-K6-H2
gggaagtcaatgcttcgagaagaggtgactgacgtggacattgctgagattgtgagcaagtggactggtattccagtgtcgaaccttcaacagtctgaaagggaaaagctgctgctgctggaagatgtacttcacaagagggttattggccaagacattgcagttaaatcagtggccaatgccatccgccgttctagggcaggcctatcagatcctaaccgtccgatagcaagcttcatgtttatgggacctacaggtgtgggaaagactgagctgggtaagacactggctgaattccttttcaacactgagaatgccctaatacgaattgatatgagtgagtacatggagaagcacgccgtctcccgtttggttggtgccccacctggatatgttggttatgaggaagggggccaattgactgaatcagttcgtcggcgaccttactcagttgttctgtttgatgaaattgagaaagcacaccaggaagtctttaacatattgttgcaactgttggatgatggaagaatcactgattcacaaggcaggactgtcagcttcactaactgtgtcataatcatgacatcgaacattgggtcaccattgatccttgacacacttagaaacaccacagacagcaaggaggccgtgtatgagataatg

SEQ ID NO: 68847 - DNA, 292 bp, Zea mays
  Clone ID: LIB3076-060-P1-K6-H3
catagctgtggagcagttcctgctggatgaaggcctccagtacacgcagcctcaggcgggtctgctccgagtgatggtgtactaacatctcttaggtgagaaaaaaaaacctccaaaaaaaagagaaaagagatgtactaaaacgcaggggaaaaaagcgtcagttggagcacgcactgttattccgtgtagctgtatattaaaagaggcagcaggagaatagcctgacaacaggatacagtgtaaaattatacgtagcttccttcattcaattcacattccttttccatcc

SEQ ID NO: 68848 - DNA, 630 bp, Zea mays
  unsure at all n locations
  Clone ID: LIB3076-060-P1-K6-H6
tcgagaacccttaccccgactctagcctcgccggcgagctcgggaagcaagaacaccgggaactggcgcgcgaagccgtcaggaaatccctggttctcctgaagaacggcaagtcctcctacgctccgttgctgcccctcccgaagaaggccggcaagatcctggtcgccggcagccacgccaacgacctgggcaaccagtgcggggggtggacgatcacgtggcaaggaagcagcggcaacaccactgccggcacgacgatcctctccgggatcgaggccaccgtggaccccagcacgcaggtggtgtactcggagagcccggacagcggcgtgctggccgacaagtacgactacgcgatcgtggtggtcggggagccgccatacgcggagacgttcggcgacaacctgaacctgacgatcccggcgcccgggccgagcgtgatccagtcggtgtgcggggccgccaagtgcgtggtggtcctcatctccggcaggccgctggtggtggagccgtacctgggcgacatggacgcgctggtggcggcgtggctgccggggtcggaggggcagggcgtggcggacgtgctgttcggcgactacgggttcacggngaagctgccgcggacgt

SEQ ID NO: 68849 - DNA, 427 bp, Zea mays
  Clone ID: LIB3076-059-P1-K6-A1
tgctgctgttcgacgcttgcttgcagggggcgagtcaaccagcgccggaagaggaagagtctatgtcatggctactgcgaggctatgtcaaggtggcttcattctagacgcctcagaaacactcatacagatgctggacatgggcttgcttcctgattacctggatagagctgctgggctgactgcactgcggaggaacatacaggaatccggcagcctagagtcctacttgaagctttgcaagcgactatctgagacagatctgattggaccatgtattgtgtatctatatgtccgcaaattcaaattgtggatggcacacatgctttagagttctgatgaaccctttcgtcatatatccactcatggcaggtgcaaaatggagatctttaaaaattgtgtgtggttcaatcgcttgttcctgttg

SEQ ID NO: 68850 - DNA, 560 bp, Zea mays
  Clone ID: LIB3076-059-P1-K6-A10
tcttagctaggacaaaatattgttctctttggggtggtgtcgtagcagcaatagtgattgggtttttgcttgacgacactgtaaagattgtgattggggattggaagaataagctctcttctctcaaaaaaaaaaaaaaaaaaaaaaaaaaaaaaaaaaaaaaaaaaaaaaaaaaaaaaaaaaaagggggggggggggaaaaaaaaaaaaaaaaaaaaaaaaaaaaaaaaaaaaaaaaaaaaaaaaaaaaaaaaaaaaaaaggggcgcgccccttttaaagaaccaaattttacttccccttccttccaacttaaaaccttttttttggggcccccaaaataaaattaattgcccctgttttaaaaccgttggacctggaaaaaccttggcttaccccaattaaatcccttggaaaaaaatccccttttccccagttggcttaataccaaaaaggccccccccaatcccctttccaaacatttccccaccctaaagggcaataggacccccccttttaccgccccttaaaccccgggggttggggtgtttccccccaggg

SEQ ID NO: 68851 - DNA, 64 bp, Zea mays
  unsure at all n locations
  Clone ID: LIB3076-059-P1-K6-A11
gcgtttgtccagcgtccgcccagcgtccggggggggggggggggcgagcagccttcncttacac

SEQ ID NO: 68852 - DNA, 520 bp, Zea mays
  unsure at all n locations
  Clone ID: LIB3076-059-P1-K6-A12
ggcgggngncggccacggcacaccactgggtcgtgctcggctccggcgacggtgtcagcgtgtggaacaggtccgccaggccgttaaggttcgtcctcgccgccgggcagccgctcggtgagcccgtggtgcagcacggacccttcgtcatgaactcgcacgccgagatacagcaggccatgggagactactcctacggcaagaacggcttcgagagggccggccagtggagctcctccgcctgatcggcgaggctatcgcgttaaattaaataaatgtgtgtaatacacacagctcaacgcttcccttaagttatgtagcaacgccatttgttggtgattaacgagtgatcgagcaagcttaaaaaagttccactccttttaaacttatatatttatcggtattttagctaatacaatagtttattgagactattgtattcgtgtatcgaaagttatgtagcaatgccatttgtgggtgattaccgtgttttccggtcgaagtatcagctagttcaatc

SEQ ID NO: 68853 - DNA, 728 bp, Zea mays
  unsure at all n locations
  Clone ID: LIB3076-059-P1-K6-A2
cccgggttcgtacccacgtcgtttcgcttccttcgcatttttcctttgcaaccgtgttgcgctagtcccccttcccaaccataanaccgtatggcgcctcaagggccgtanagtaagctccgcgtgcgaagaaagccggtggnagggaggagcctcgtcggccgtataaaacgactcgccggggaagtnatagtctcctctaaaggggccggggtgttttaaaaaaccgcggggttttttcccccccccttttttttttgtttgttccctctttttgttttttttttttttttttctcttttttttttttttttctcttttttttttggggttgtgttgttttggtttttttttttttttttctttttcttttcgttctttctttttttttttttttttggttgtttgtgttgtttttctttttttttcttttttttttttttttttttttttttttttttttttgttcctctttttcttttgtttttttttttttgtttttttttttttttttgtttgtttttgttttggtgtttgttgttttttttttttgttttttcttctggtgtttgtttggtgttttttttttgccttttcggttttttctcttttttctgttttttttttctttttttgtttgtctttttttttcgtttttggtgctttgctgttttttttgtttgtttttgtttttttgttttttgttttttttaatttttatttttaat

SEQ ID NO: 68854 - DNA, 573 bp, Zea mays
  Clone ID: LIB3076-059-P1-K6-A4
cggccgcgtgggcgcgctcgctttgggggggtgggcgaggtccaagttcctgcattgatggcgaccgaggtggctgagactcccgcgccgttggcggaggcggtccccgagacccccgcggaggcaccggcggcgcccgccgccgaggcgaagcctgccaaggccaagaaggcctctgcgcgggggagagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccggcggcaagctcaccaaggtgaagaactcctacaagctgccagcgcgcgccccggccgccgccaagccgaagcccaagtccaagaccgctgtgaagaagcccaaggccggtgccaagaagcccaaggccgccaccaagcccaagccgaagcccaaggccaagtcccccgccaaggcgaagcccgccgcaaagactaaggcagc

SEQ ID NO: 68855 - DNA, 512 bp, Zea mays
  unsure at all n locations
  Clone ID: LIB3076-059-P1-K6-A5
gcgttcggtgtcatcatcatnnttagcttcttggaaccagaatgccgccaagnncttcatnngttttcaggaccctgggcaggatgatttcaacccaaaatgcagnaaataacaccatttctcactcctgagacaaatttctccgattcaacagggggagaccatacaggttgagcgggtcatgcacagcgtaccaaccatttgggcataggctcatgggcagtcgaatctgcattggtgaagaacttgaggaccttttgatctagcttgtttatttctctagtttttgcgtcttgatattgtggtagtttggggcttcgggtctggtgggttgtctagcccatcagaacgcgtaatgggtattggtcttccagtatgttttcagcgttaatttggctaatttccccgcttggcttgtacaacaaattttatcagtactgactaccatgagttgtactgctctatatgctgcttcccactctctgaattggcagaatgattgatgagaagac

SEQ ID NO: 68856 - DNA, 578 bp, Zea mays
  unsure at all n locations
  Clone ID: LIB3076-059-P1-K6-A6
gcgtttttccagcgtccgctcctcgcattttccttgcggccggttgcctatccccctcccaaccaagnaccgatggcgcccaagccgagaagaagcccgcggcgaagaagccggtggaggaggagcccgcggccgagaagacgaccgccgggaagaacccaagcggagaagcgggtccccgctgggggggccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaagcccaccatcacctcccgcgagatccagacctccgtgcgcctcgtgctccccggcgagctcgccaagcacgccgtctctgagggcaccaaggccgtcaccaagttcacctcctcctaggcttgcacgctcgccctttgtaggcttctcttgtgttgatgttcgccttgtgttgt

SEQ ID NO: 68857 - DNA, 130 bp, Zea mays
  unsure at all n locations
  Clone ID: LIB3076-059-P1-K6-A7
gtccgcgtccatgtgtccgctactccgctcccccgcatgccncagttcctcacctagcggtagcgtgcgcgcgggnaaacgtagaaggcggcttcggnagcggcagcggcggcggcaacaccggggacgc

SEQ ID NO: 68858 - DNA, 559 bp, Zea mays
  Clone ID: LIB3076-059-P1-K6-A9
gcgtttttccagcgtccggtccataatgaggtggggggtgggcgtaatcatgactggatgctgcgaagagcaaacttctctgggggctatgtatgtgtgaaatttgagattaggattagaaaataaaggctatctgttgagttcatcaagcagtcagataagtcagggatccaaacccaacaattcgggggggggacttagcttcaatatgtgcaagaagattgtgcagatgatgaatggcaatatttggtcagtatcagattctaaaagcatcggagaaactatcatgctagtcctccagttccagttggaacctgtgactccggtctctggagcgtcctcagatttgtacagatcatccgcaattcccaactttaatgggctcagagtcctccttgcggacagcgactgcaccaaccgagctgtaactcacaggctcctagagaagcttggttgccgagtcctttcggtcgcttctggcgtccaatgcatcagctccttcgctgcggagtcgtccttccagctggtggttcttgatcttgacatgcagacgatggat

SEQ ID NO: 68859 - DNA, 512 bp, Zea mays
  unsure at all n locations
  Clone ID: LIB3076-059-P1-K6-B1
cggtccggaaaccccgggngagnatccggngcttccgcagtcccaccgaccccgccgccggggcgggctgccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctggggctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctcccctgcctgctgcgtgctntgtctgaatcgtgaacctccgttggtctttgttgtgtgtgcccc

SEQ ID NO: 68860 - DNA, 417 bp, Zea mays
  unsure at all n locations
  Clone ID: LIB3076-059-P1-K6-B10
cggccgcgtgggcggtcgcgtgggcaggcccagtcttccatgtgcgcatctggttgtgcagctttccttgcaaactacaattctaactcctatgcgaatgttgtattcaacaatgagcaatacagcctaccacattggtncgnnattagncatttccttcctgnattnnngcaaaaatgnnttgttnttttaacaagtgttcaacagttttnngtgttttcgaggaaccatcctnncaaaaatgcccaaaaaatgtttggttgggggaaaaaaaaataaaaaaaaaccccccttttaatatttaaaaaaaaaaaacccccggggggggggaaaaaaaagggggttttttttttttttttttnccagggggggagggggggtgtttttttttttttttttttttttgggggggggggg

SEQ ID NO: 68861 - DNA, 517 bp, Zea mays
  unsure at all n locations
  Clone ID: LIB3076-059-P1-K6-B11
cgtcctctgnaaatcaaatctaacacccacttcagtcgccgaggtcttggataataaaaacaccagcaaaggtttcagcttcacatttcctattcctaaagctccaagctctctacttgaaccgcctcctacaccaaccatggggcgcaccaccaaggaccttgccaatcactaacgaggatgttcccaagttcacctttggctcatccagcacggccaacaaactcgttttctccttcaactctacaagcagttctcctggtgctggtggaacagacccaaccttcaaatttggatctgataataagcgagagcttgtgttttgatacagttttttttttgatagacaccatgcccgcggatctgaactgtaccactctatctattcttggtgtaagacgtcttaagagagttggagtgtgctacttgagctacacaacatgacattcttttcattcattagcatattcaaacattacatattttagacgtcctgcgttggcaggacatttccccc

SEQ ID NO: 68862 - DNA, 101 bp, Zea mays
  Clone ID: LIB3076-059-P1-K6-B2
tcgtgattgcgacaatattggcaaaattgggggtgctttatattttgatatactgtgaacaaaacagtgccctatgagaccatcgtgatttatgcattttc

SEQ ID NO: 68863 - DNA, 330 bp, Zea mays
  Clone ID: LIB3076-059-P1-K6-B3
cccccccccccccaccccccccgcgctgcggggcccccccccacaaaaaaaccaccccccccccccccgcccacccaaacccattcccccccgtcccccccgcccctccccccaccccacccccccccccaaataccaagttaataaactcccccccctcccggccccaccccactcctttttaccccccccccccccccccccccccccggcgcttagcctccggggcccccccttcccctcccccccccctcccctcccccaccccccttcccccaaccccacaccacccccaccccccccccccccacaaccccccccccacccccc

SEQ ID NO: 68864 - DNA, 549 bp, Zea mays
  Clone ID: LIB3076-059-P1-K6-B4
gcgtattttcggcaggggctcatccgggtagggggggggtacgtcaccttccccgtcaagtaccagtgcgttgtctttagacccttcagggcgagatcctcgaagctgtcgtcaccatggtgaacaagatgggcttctttgcggaggctgggccggtgcagatcttcgtgtccaaccatttggtgggcggcggggtggagttccaatcaggagatgtgccgaactacacaacttctgatggatcggtgaaaattcaaaaagagagtgaggtgcggctgaagattattggtactcgtgtcgatgctacagaaattttttgcattggcacaataaaggatgattttctgggtgttatcagcgatcctggtgcggcagtgtaaatggtctaagaagcgagattgtactccattgttctgacttctgagtactatcgcagacgtgtgtaatcgctggtccgttaaaactgcaatggctgtactgactgcggaacttgttgagaatgatgtgactaggaccttgtttagggcctgtttggttctttagtttggc

SEQ ID NO: 68865 - DNA, 148 bp, Zea mays
  unsure at all n locations
  Clone ID: LIB3076-059-P1-K6-B5
cccagcgtccgnagntatctgcgcccaagccaggcaggctacccggngagagctcctggagtctggaatggctgatactctcgcggtgtctactgatcagaggggaagattgatgatgacaactngaaanactgnnaatcagtccact

SEQ ID NO: 68866 - DNA, 130 bp, Zea mays
  unsure at all n locations
  Clone ID: LIB3076-059-P1-K6-B7
ggggggagggaaaaaaaaaaaaaaaaaaaaaataaaaattttttttttttttttttttgttttttggggggggggggggggggggggggnaaaaaaaaaaaccaccccccgcccgggggggggggggggg

SEQ ID NO: 68867 - DNA, 461 bp, Zea mays
  unsure at all n locations
  Clone ID: LIB3076-059-P1-K6-B8
attggctctggcagtctttggggggggggatggggttnctttgttggaggctggggggggcttgtcttcacgacttgttattcaagcatcccgaatcctgcacagggagataaatccaaatcttctcatggtcctgtttctgatttcaattgtgttggtcatatgtcccattttgggctgcggggggtcnctnccaanatcattcctcaagtcttatctgccaattcataggcataattctgggggcagttctgttcttggtttgggattgcctttcaaacatttattattgaatcccattggttcaggtgatggtagatcatagactcctctgttccctactgttgctgggtcagatcctcattcttttgccggattcggtggctgccttgtctngcttatggaccccttccggcaatccttgggtgcctctcacagcttttctgttgggagcttaggtc

SEQ ID NO: 68868 - DNA, 547 bp, Zea mays
  Clone ID: LIB3076-059-P1-K6-B9
caccaatgtgttttcctttccttcccggtcccccaatgccgcctcctcatcactagtcaccacttccccgcgctgccctcccactcccacacactttctgctgcctctcgccgcggccgatgggctgcttccttggctgcttcgggggggccaaggagcgccgccgccgccgccgcaagcgggcgccctcacagtcccccaacggccgtgcccgggccttgccgcgggttacgccgaacaaggttgatctggatggggaggccgtctccgccgccgcgccgctactagcgacgctcctcgagttgagggactccacggacgagatgtgcctggccctcgtgaagaagaaggtgacattcgaccccaacgtcaccacattcgaggcggccccgatcccggaggacgacggcgaggaagccgatccggaggatggtggggatagcagcgagaaggggtggatgcaggcgtcggagtgcaccaagtccgaggccttccccttgaaccacaggtacagcaagttcgccggcagcggcaacgtcagcgacta

SEQ ID NO: 68869 - DNA, 559 bp, Zea mays
  unsure at all n locations
  Clone ID: LIB3076-059-P1-K6-C1
atcctccaaccccctacctcatgggggctgtccaagctcagctcccaagctatgctgtttttgaacttctccacgggaacccctttcgattctttcaagnntctgcttactttatgctgccgctgnaggggagttcaagggacaagggaaatcaagttccttattggtgacattgaagccagccagggggccttacagtactttggtctgaaagaggaccagacaccccttatcctcattcaggatggtgattccaagaagttcttgaaggatcacattgaggctgaccagattgtctcttggttgaaggagtactttgatggcaaattgacgccgttcaagaagtctgagcctattcctgaggtcaacaatgagcctgttaaggttgttgtggctgacaacatccacgatgtggtcttcaagtctggcaaaaatgtttcttattgaattctatgccccctggtgtgggcactgcaagaagctggcgcccatcttgggagaggccgccaccactctcctgaatgacgagggaatttgtgattgcttagatggacgcgac

SEQ ID NO: 68870 - DNA, 575 bp, Zea mays
  unsure at all n locations
  Clone ID: LIB3076-059-P1-K6-C10
ccccgcgtccgccccgcgtccggacaggcgcatccgcacactcccaattcccctcgagcgccgcagcgagcccaagaagccgaccgccgagccccctctccagtccagtccgcggtctcggtttcttgcttgcccggcgcccaatcttcagagagagctccttctcgtcgtctgtctgcgtgggcgcctcgaccaagaccgtcgccgtcctcctcgccgcggtgctcctcgcgctggtcgcgtccgcggcagccagcaggaagctggaggaggacgcacttctgggaagcctggccccagcccccgcgccggccgttggcggtgccgcggggctgcctggcggcaagccgggggcgtgggccgtcgccgctctggtctctctcgtcgccttcctcgtgatctgagggcgtggggatcgtgctgcgcatcgcgggagatggagggacgaatcctgcgatctggatcgcanagagagaggagagggggatatttatgttcgttctgtttgttctagggtgcctctcttttgcctgtataagagaggatcatgattttttttatataataataccgtt

SEQ ID NO: 68871 - DNA, 584 bp, Zea mays
  Clone ID: LIB3076-059-P1-K6-C11
gcgttcgcccagcgtccgcggccgcgtgggggggggggggggtttgatccgtttgctgaggcaaatgctgaggactctggtgctggtcctggaacgaaggattatgtgcatgtgcgcatccagcagcgcaacggcagaaagatctgactacagtccaggtctgaagaaagagttcagctataagggagcgtgggggatctgaagaaggaattctgctgcaatggtactgtagttcaggacccagagctaggccaggtcattcagctccaaggtgatcagcgcaagaatgttgctactttcctagttcaggctgggattgcgaagaaagagaacatcaagattcacgggttctaagggacctgtaaatgcttgtgccctatattgtgtgcctccacatattggggagcttgaagcatcgacaagttactagtcattgcttacttatataagaacataagtagtatttgctattgtcaagtgtgccttgcttgatgcaagttgtgttttcgtatcattattattatgcacggccatcgtacgtgtatggcttgtatgggttattgccaacttaataaaagcacact

SEQ ID NO: 68872 - DNA, 536 bp, Zea mays
  Clone ID: LIB3076-059-P1-K6-C2
gccagttgttgtttatcttgcggtagctggcgagccttcttgaaacgattcaataaccagtgggtggagagtgggtatggttgcttacgagaagaagaagcttggcgttactgacatctacgatcggcagccatatcttataaagtctgccatcgactttgaggtgtgctcgagagcagacgtggggggcggcaacagcttctcaacattctccaacctcgtagtgctgtccaggacagaaaggctgtataacctaggaaaggcgagctcgtgtggcgagaacatcgggctttcgtcgtatgcgtacaatgtcatgggcgacgatggtggaccgcagagatggatgacagatatgtcggacacaagcctgcagaggttaagttacggaacaaataatgtctcatgccactgactttgacgcatagcaaacttgactgaacatgatgtatacctgaggaagagtccttgcccgacttcgctttttatcggcaaaggaagcaagtttgtgcagctaatttgacgtgcttctgtgttcg

SEQ ID NO: 68873 - DNA, 566 bp, Zea mays
  unsure at all n locations
  Clone ID: LIB3076-059-P1-K6-C4
tctgagcacttatggcttagctgatatcaaataggaggagntgggaattgccagttccgagctctggcagaccagatattccgcaatcctgactatcacaaacatgtgaggaaggcggtagtgaagcagctgaaggagttcagngaaacactatgaaggttatgtgccaatggaatataagggggagtgggagaaaatgaaaagtctggggaatggggagatcatgtgaccttacaggcagctgcagacaggtttgctgctaaaatatgtctgttgacatcgtttagagacacatgcctagttgagatagtccccagagatgccactccaacaagagagctttggctaagtttctggtgtgaagtacactacaattcattgtatgcagttgaagatcttccaacacggaaaactaagaagaagcattggatgttctagctcgccaggctttggtgatttcttggtatgctgttggtcttctctttgtagtccagcagcatctgtaaacctgcttagttatgcctttgtttgttgtaagttgtaacttgacctggaatcaatttcat

SEQ ID NO: 68874 - DNA, 539 bp, Zea mays
  unsure at all n locations
  Clone ID: LIB3076-059-P1-K6-C5
gcacgcgctggggcggtggctcgcgcgggcggtgtcctcccacgacgcgcacctcacccgcgacgaagtcatcgaccggatcctcgacgtcatcaagagccaccccaagatcgacccctccaagtgaccccggaggcgcacttcgagaaggatctcgggctcgacagcctgnacaccgggggggtgggcatggccatcgaggaggagttcaagctcgagatcccagacatggaggctgacaagatcgactcactccctctggccatcgagtacgtcgccaaccaccccatggctggctgagcctctgctcgcccgagaggaggcgagttgaggtgaggcttcgcttggttttgtttccgagggcaaataatctgctggagtggcacagaaaaacttgttcttggtgctctgcattgcttcacggtgacggatgatgatgtcgaaatggaacattaacattttcagcgttagattgttgtttttgtgtgcgtgttatatctatatatactggttgacaaactagtttggttgattgagtc

SEQ ID NO: 68875 - DNA, 581 bp, Zea mays
  unsure at all n locations
  Clone ID: LIB3076-059-P1-K6-C6
gtcgacccagcgttttttcgttgtgcttttgcaggnaggatgtgtggtggggggtgtagcttgggagacaactgaaggaacattcacaaagcattttcagaagtatggagctataactgattctgtgatcatgaaggacaagcatactaggatgcctcgcggatttggatttgttacattttccgatccatctgtggtttagannnggctagnagatgaacatgtcatagatggaagaacagttgaagtcaaaaggactgttccaaaagaggaaatgtcatcgaaagacggtcctaagacaaaaaagatctttgtgggtggtattccaccatctcttaccgaagataaattaaaggagcacttctcatcgtatgggaaggtggttgagcatcagattatgcttgaccatagcactggacgctcacgtggctttggatttgtcacatttgaaagcgaggatgctgttgaaagggttatgtcagaggggagaatgcatgatcttggagggaaacaggttgaaattaagaaagctgaaccaaaaaaacctggtgtggggtgattcaagctcaaatggaagacac

SEQ ID NO: 68876 - DNA, 574 bp, Zea mays
  unsure at all n locations
  Clone ID: LIB3076-059-P1-K6-C7
gcgtttctctctccgcttcccgctccgatcgacctggtgcctccccaccaccgagccctggcggaccagctcaccgacgaccagatcgccgagttcaaggaggccttcagcctcttcgacaagnacggggatggttgcatcacgaccaaggagctgggcactgtcatgcgctcgctggggcaaagtctcganaggtgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgataaggaccagaacggcttcatctcggccgccgagctccgccatgtcatgacaaatcttggtgagaagctaactgatgaggaggtggacgagatgatccgtgaggctgatgtcgatggtgatggccagatcaactacgaggagtttgtcaaggtcatgatggccaagtgagccacagaaccataatctgaaggcagagaagattatgcattgcatattagtcaagatgcaactttttat

SEQ ID NO: 68877 - DNA, 534 bp, Zea mays
  Clone ID: LIB3076-059-P1-K6-C8
gcgttcggtgataattggctctggcagtattacgtggggggctcatgggattgctttgttggaggctggtcaagcattgtcttcacgactagatattcagggtaccgaatactgcacaggggagataaatccaaatattctcatagtactgtttctgatttcaattgtgttggtcatatgtgccatactatgcgggagcaattcgataccaagatcattccgcaagtcttatctgccaattcataggcataattctggaggcagttctgttcttggtatgggattgcctttcaaacatttattatggaatcccattagttcaggtgatggtagaacaaagacaccactgagccctactgttgctgggtcagatcctcatccatttgcaggattaggaggcagcagtgtcgagcttatggagtcctcgaggcaatccttgggtgcctatcacagctattctgttgggagcttaggtcagatgcagttttctagcggggtgaggaaccctagccggggtcagactacacttcaaag

SEQ ID NO: 68878 - DNA, 612 bp, Zea mays
  unsure at all n locations
  Clone ID: LIB3076-059-P1-K6-C9
gggccgtgttccgtgtccgcgtccatgtgtccgctactccggtggggggtggaggcctcagttcctcacctagcggtagcgtgcgcgcgggaanacgtagatggcggcttcggaggcggcagcggcggcggcaacaccggtgacgccgacagaggggacggtgatcgcgatccacagcctggaggagtggagcatccaggaggggggggccaacatcgccaagaagctggtggtgattgacttcactgcaacatggtgtcctccgtgccgcgccatggctccaatttttgctgatatggccaagaagtccccaaatgttgttttcctgaaagttgatgtcgatgaaatgaagaccattgctgagcaattcagcgtagaggccatgccaacattcctgttcatgagggagggcgacgtcaaggacagggtcgttggcgcagcaaaggaagagctagcaaggaagcttgaactacacatgngcctcgtagatcagtgatgccgtaatgtagtattcgcctaaataagaggacgcctagcctcaactctgagaaaactagtgcttctgtgatggtaattcgtatgagagagtgccccctttggtggtacttctta

SEQ ID NO: 68879 - DNA, 318 bp, Zea mays
  unsure at all n locations
  Clone ID: LIB3076-059-P1-K6-D1
gctttgcttcctnncgtcgagggcgcaagttncnnctgcattgnatggcgactcgtaggtggcttgagaacttcccgtcgcctgttggcgtggggcgtgtccccgtgtacccccgcggtaggcatccggcgtgcgccccgccgcctgaggcgtaagctctggggaantgtcaaggagaggcctcnntgcgcccaagnaagcgttgcctaacccgactccaccctgccgtaccgccgagnnatgatctcggngtgggctgtcacgtcgcttcaaggagcggacgggngtccagctctgttcgcgtatcgtccaagttcg

SEQ ID NO: 68880 - DNA, 572 bp, Zea mays
  unsure at all n locations
  Clone ID: LIB3076-059-P1-K6-D11
ccgctgctcgcacaccacnacccccgggccagcgccttgctcgggcttcaagtgaaggccttggacctccagcgcccccgctccacatttgcactatccctgtccgttttccccaccctaagcaccagcagcgccgccaccgtcggaaggccattccgctatcgtcgttgagcctctaatgggggctttgtcatgtcccggagccgtcgccatcgttccaagccaccaccctcttgttgccgcttccaagggatcctgagtcttgccttgagacaatgagcagtctgcgtttcctgagggagttgcaggagaagtccccgagcaggagcttggtgaaggttatccacattgtaaccactgcccaggagaagatgatggcaatgcggaggacttttaggagtttcacgacttcgaggagttctagactagattagtggcaacccctagtcagcttcctgtgaaggccttatctttacagcgttttgctttatcactttgattactcgttaagttgatgattgtggatgtctctgacatcatgatgtaataaattaatacttctttatgttatt

SEQ ID NO: 68881 - DNA, 577 bp, Zea mays
  unsure at all n locations
  Clone ID: LIB3076-059-P1-K6-D12
cggncgcgtggggntgccacgatgtggggggcgagagtggttttgctccgaacatccagggagaacaagnaaggacttgagctctntgaaaactgcaattgagaaggctggatacactggcaaggttgtcatcggaatggatgttgctgcttcggagttttacagtgacaaggaccaaacatatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaagggtaaccaaatcggatctgtgactgagagtattgaggctgtgaagatgtcaaagcgtgccggctggggtgtgatgactagtcataggagtggtgagactgaagacactttcattgctgatctggca

SEQ ID NO: 68882 - DNA, 498 bp, Zea mays
  unsure at all n locations
  Clone ID: LIB3076-059-P1-K6-D2
tctagttctagnacgcgnacggcgccctgtgttttttttttttttttttttttttttttttttttttttttttttttttttttttttttttttttttttttttttttttttttttttttttttgggggaaaggggttaattttgttttttaattaacccagcccaaaaccccaacaaaaaagggggggggggcaaaaaaaatttctccgccaattttttttaaaatcaaggttttaaaaattgccatagggggccgggtttttacccagttggggcccttggattttgcccccctcaacttaattagttccggtttattttttaaaatttgccccctcaaattagtttgttttcctggggcaaattggggcttgggggaaaaaaaacggccataaaaatgggtcccgggggggcttttggggcctttttttttttccgggttttatggggccggggggggccccgtcccccttttttttttccttgtttttttttttt

SEQ ID NO: 68883 - DNA, 562 bp, Zea mays
  unsure at all n locations
  Clone ID: LIB3076-059-P1-K6-D4
gcgttctcgcttcgttccactcctgagcactttgtgcgcgtcccanacaagccaatcgaagccgaggtacgaccatggactccaccggcnaccggacagggggtaaggggaagaagggagcggccgggcgcaaggtcggcgggccaaggaagaagtcggtgtcgaggtccgtgaaagccggtgtggatgtcggggcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaagcatagactgactgt

SEQ ID NO: 68884 - DNA, 355 bp, Zea mays
  Clone ID: LIB3076-059-P1-K6-D5
gcgttcgtgggcgcgcacccactaccacgtggaaggggggggggagcgcgtgctcgcgcgtaaggcgcttatgcagcgcgtccggtcccaggagctcggcaagaagctccgcgagatcctcatcaagaaaacaggggccagtgaggacatcagcgcattggccatttacgggcagcatctgtgtggggggggggggtttgagcgtgtggagaataaactcaactgcgaccttgagcaagagaacttttgctatattgcatgaaggacagattgagaataaaactagtttttggcgaacgaactattgtattttattgtacaatttagtatctatatatggatttaactgctgttg

SEQ ID NO: 68885 - DNA, 582 bp, Zea mays
  unsure at all n locations
  Clone ID: LIB3076-059-P1-K6-D6
agcgttcgcccagcgtccgggnacaggaaccagggggcgtgtgatgatattcccaagnaaattcctgaccctgatgctaagaagcctgaggactgggacgatgaggaagatggtgaatggactgcccctaccattcccaacccagaatacaaggggaccatgggaaacaaaagaaaatcaagaacccgagcgaccgtnnggaatggaaggcacctatgattgacaacccagattttaaggatgatccatacatttacgccttcgacagcttgaagtacattggcattgagctgtggcaggttaaatcgggcactctgtttgacaacatcatcatcactgatgaccctgcgttggccaagacttttgcagaggagacttggggcaagcacaaggaggcagaaaaggctgcttttgatgaggccgagaaaaagaaggaagaagaggatgccgccaagggtggggatgatgaggatgatgacctagaggatgaggaagacgatgagaaggcagacgaggacaaggccgactctgatgccgaggatagcaaggattctgatgatgagaagcagcacgacgagctct

SEQ ID NO: 68886 - DNA, 465 bp, Zea mays
  unsure at all n locations
  Clone ID: LIB3076-059-P1-K6-D7
gcgttcgtggncgcgtgggnaaataagcaggtcttggaggtgcactcgatgatgctgccattacagggtcattagaactacacaaaattaagagccgtcaatgggcgattttcaaaacatctgcaataaagggagaggggctctttgaaggtttggactggctcagtaacacgctcaatctgggggggcgaagggcctcctcctcgtcatgaatcatttgctggaggctaaagaatagccgatgcttgcaagtcagcgcgcaaatcccattctctttgttttaactccagaagttctacaccgccatcaattatctgtaaagtgcgtgttaaattttttggatactacattagatgtaccctcaggttgagatcaagaataggtctgtggaaaatgacgagcaaactgtgccactgtctttacccgtaaatctcatggatcatgacaagtttttttttgtacccc

SEQ ID NO: 68887 - DNA, 389 bp, Zea mays
  unsure at all n locations
  Clone ID: LIB3076-059-P1-K6-D8
caggtacccagggtgactacatgccaattactcgcggtgagaagcgctctgtagaggttgtgaaggtcacagatgagatgaaggcgtttgcggcctatggcaagctccgccttgagcggatgaacaagaagcacctcggtgcccgccgagaggggggggagctgagcagagaaggaagacaagaagtgaagcagccaaactttgtagcctgttttgttctgttcagtcatagcgagatgctacttccatcaagtgcttgttccaagttttttttgggtgctggaaatagagaccagtcaaatattttggtgtcctactgtttgataccttgtatttgtttgcgaactcagctatctaatgggttaatgaattcttggcgacgcananna

SEQ ID NO: 68888 - DNA, 541 bp, Zea mays
  unsure at all n locations
  Clone ID: LIB3076-059-P1-K6-E1
ntctctgtaactctcacttcaaaccttcagccttgacagcttcaatggttgcttcttatttccggtgctaatggatggttcattatgttcggatagacttttgctgatctttgttgcttgctttggagaaggattttgatttatcggaggcctatgtgtttggggtttctgaaattcaatcatcgggggtggccccaatggggaaagagtagtcatagattgatgataagaagattgcccaagctttaattcagtgtttgaagcattgctcaaagtgtcctggaatgttttattggagaaatttggtctgcacgccctactatcatggttcataactcctgtaaaacgtggcataggattacaaaatgacgcatcaaagtttttctccaaatggattccatgactatgggccaaatgatttccattgtaatgtcttcccatgcttgcttcaaagtgtgggcttccactaggagtggtgagtgggttcaagtcgaatgcttgaactggatggtttttagcgggccctaaattcaccacagcg

SEQ ID NO: 68889 - DNA, 513 bp, Zea mays
  Clone ID: LIB3076-059-P1-K6-E10
gcgttcttccagcgtccgtgttttctttggtgctgggtattatgtttggcaaaaggaggaatggttgagcaaataaagtaattccagattgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggagggagggaaaaaaaaaaaaaaaaaaaaaaaaaaaaaaaaaaaaaaaaaaaaaaaaaggggcgccccttttaaaaaatccaaatttttgccaccgccttatccctaactttaaattttttttttttggggcccataaaataaaaataaagggggcgttttttaaaacaggcccgtggaaaaaacccttcctttcccaaattaaaactctttggaaaaaatccctttttctgcaggggggtttaaagaaaaaggcgcctgctttatttactttttccaaaaatttgtccattttaaaagggcaaaagggcccccccc

SEQ ID NO: 68890 - DNA, 473 bp, Zea mays
  unsure at all n locations
  Clone ID: LIB3076-059-P1-K6-E11
ctcctcgcttttccttgcaccggtggggttccccctcccaccaaanccntggcgcccaaggccgnanagnaagcccgcggcngaanaaccggtggaggaggagcccgcgngccgtaaaagacgaccgccgggaagaacccaagcggagaagcgggtccccgctggcaagtccgccggcaagggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaagcccaccatcacctgccgcgagatccagacctncgtgcgcctcgtgctccccggcgagctcgccaagcacgccgtctctggaggcacc

SEQ ID NO: 68891 - DNA, 402 bp, Zea mays
  unsure at all n locations
  Clone ID: LIB3076-059-P1-K6-E12
ccccctttcccactctatattattttcaaaaagtctttcttaccttctttaatcgctccttacgctcactctttttttttctcatcagcancccccccattatttttttggggggggggttaactcctaacccaattatatattttttttttttatttaaaataatttttttttttctttcctttttttatttttttttttattttttttatttttttttttttcttttttattttttttttttcttttnatttttttttttttttttttttttttttttttttttttttttatttatatttttttttttttttaattatttttttttttatattttttataattttatattttttttcttttcttttttatttttttttttttttttttttttttttcttt

SEQ ID NO: 68892 - DNA, 560 bp, Zea mays
  unsure at all n locations
  Clone ID: LIB3076-059-P1-K6-E2
cgtctcagaagnacgtcttccgtggctgctgggtgccaagnagtgatgctctgaagaacttgaggaaaaggtgtagctattcgttttgttattggtcggagtgcaaatcgaggtgatagcttggaccgtaatattgatgatgaaaatcggcagacaaaggacttcttgattcttgaaagtgatgaagaggctgcagaagaattaccgagcaaagcaaaaattttcttcagtgctgcagttgaagcctgggatgcagaattttatgtcaaagttgaagataacattaatcttgacttagctgggttaattgagatgctcgaaggccgtcgaggtagccaaggattgtacatgggttgtatgaaatcagggatggtcataagtgaagagggccaacaatggtatgaacctgagtggtggaaatttggagattcaaaaacgtatttttcgacacgcttctggttctttgtttatcctctcaaaaaatttggctcgctacatcaacataaatagtgcgtcactgcagagttatgcacacgatgatatatcagtaggttcatgga

SEQ ID NO: 68893 - DNA, 551 bp, Zea mays
  unsure at all n locations
  Clone ID: LIB3076-059-P1-K6-E3
gttgcacacgtgcgaatccggntgttgcttgatttttgngagttgtccataataggcaggttgtacatttccggtctttggagaaccaaagatgatgatttttctttggaattgtcaaagcttcatacctatgatgatgttgttgagagagttgctcgccaacttgaattggacgaggcgagggaaaattcggcttacaccccacaattgctactctcagcaacctaaaccacagcccgtcaaatatcgaggagtggtgtatctgtcggacatgctcatccactacaatcagacgtctgacatcttgtattatgaagtgttggatataccactgccagaattgcagttcctaaaaaccctgaaagttgcatttcaccatcctacgaaggatgaggttgttattcatagcatcaggctttcaaaaaatagcaccattgctgatgtaataaatgacttgaaaactaaggttgaactgtccagtcctaatgctgaactacgtgtactagaagtcttcttccccaagatctttaagatctttccacttcctggga

SEQ ID NO: 68894 - DNA, 579 bp, Zea mays
  unsure at all n locations
  Clone ID: LIB3076-059-P1-K6-E5
tcccagcgtccgngnttccttcttaaactggtcacattccctccttgaaggaaggaaactcacaggagacgatatttaatccaccttggcggcacgagacagtcgccataggttcaaggtttggagaagcatttcaagagccagcttcatttcttgccataagacccctgtttgaggacgagagatacatggtaacatataacccgacaaaggataaagtgtatgctttgctcaaggaccaagcaaaatcagatgacattatcaaagctgcttttcatgctcatgtgctactgcattttattaatgcatcacatgcacggaggctgaagctgaagcagaagcaggcaaaccctgaccaatcagagcatctgtactctagaaacgtggatttcctggcgcacatagctgaatcttgcaaaattgtttcctcatcgtacggaacattcaagaagaaagcaagggaacagggttggataatgtcagaatctttgctcaaccctggcaaggctcgattatgtgcagcaaaaccacaatgaatctactgtttcagttcagtgtcgatgagatgataccaatctc

SEQ ID NO: 68895 - DNA, 119 bp, Zea mays
  unsure at all n locations
  Clone ID: LIB3076-059-P1-K6-E6
tacaaaanagctactacatcaagggcagtgcaaccactcatttgatggcatagtccatttgatgaggtcttagatgcaactgaacccactccaggggtttgctcaggaaccattgactt

SEQ ID NO: 68896 - DNA, 537 bp, Zea mays
  unsure at all n locations
  Clone ID: LIB3076-059-P1-K6-E7
gcgttcgtccagcgtccgnttgtgactcggttggggagaggactgggagcaggtttaacaataaacacaaaatgcttatacttcctcctgccactatggctagtttaccagtagctgagcgtgctattcttgttaaacccattccattcttcgaccatctgctacatctcttcaatgatggccaggtggatngcagatgcatgagagaccctatcatgactgacgattctaatgaggaattggaggcccagattgcgttgaacattattgcctcaggtgcagatacaagggaccaagatggggaagacctagataatataggattggagggtgaagataaccatcatgaggtcgcagcaagtagtggtgaggtgccttgtgaagtgatgtctgatactagtccaccatccgcgcagccatccgggtcctttgctgagagcacaatggctgctctgaagcctagcgcaaagaagatgaagatcatcagcaaaacgaaactaagcccaaaggcgcaggctgctctgccacgtgatggaa

SEQ ID NO: 68897 - DNA, 524 bp, Zea mays
  unsure at all n locations
  Clone ID: LIB3076-059-P1-K6-E8
gagtctggttcttttgatgctgttattgacaaaggaacactggattctcttatgtgtggtcaaattcccaagaatgcaacgaaatgctagagagtcaacagaatcctcaagaaaatggtgtctacatgctgatggttagggggatccaagttaccgcttgcgtctcttgaaggacatgngaaaaatggacagtaaagctccatgtcatagaaagagggagaaaagttcgaatcagaacaaatgggaactgacaaagccattgcctctagaggaccatagcacatcactagctgcacttcttggccccaaacctgatgtccactacatctatgtctgtgtaaagggcaacggtggcgcaagtgtggattctaaagctggagaagctgccaattgatttctcctataaccctctgaactgacgtgcgtaaccggtgtagcaaataatgtagaataatagaacagatgttgtacctcgaattgatcgttgttgttttattggataataaccagcgtgtgaattgtag

SEQ ID NO: 68898 - DNA, 318 bp, Zea mays
  Clone ID: LIB3076-059-P1-K6-E9
gcgttctttttttaggatttcaaatctagtacagggggggcataggccatagaataatggccaaccgcattgaagcaaatacgacagtcaccacttatacgaacgggaaaaaaatcattaccatgatcactcatgggcagaaaaaactagtgttgcgttcgcggcacagaaatgcaaaaccactcctgcgtggggggggggctccgccatgcgggctttgtctaggctgatataagccatgtgccagtcacctacaccagatagaatcaaaatgtctttctccttgcggatgtttggattgtcagttctagatcgcga

SEQ ID NO: 68899 - DNA, 559 bp, Zea mays
  unsure at all n locations
  Clone ID: LIB3076-059-P1-K6-F1
gttgaagcatattatagctctcgtgtgtgggggttcttttgcgctctcaagcgttgctcagtattaaaaccctatatgaaaaanaattactataagaataaaagatgattcaaaaattacaaatttccaaatatacaattctcataccttcagactattatatgcaaggctatccgcaggagggggcttcgtcatagcgcagagcccagcttcaagcttcggaaactccatacttctagccatctcccagcagacagataattctttgttgtctgggaggcagtataagaagtcatcttcatctgtgtcgttgaattctaaggcccctttcggatacttcagttctcgggcatagtgattagcttcaaaaatttcttcttcagataatttcttccccgaagcatgtcgtacaatataatcaagtactttggaagatgcttcgggggcagcagtgccagtttcttcagccaaaatttgttctgctatttctgttttttcggcttccaaagatttcaccttggcgggctctgaaggcccggcttcaatttcagactgttgc

SEQ ID NO: 68900 - DNA, 288 bp, Zea mays
  unsure at all n locations
  Clone ID: LIB3076-059-P1-K6-F10
cagttctacaaggtggcggtggacaatggnaacaaacaanagttgcttcaaagctcattaaattttgtttaacgagtatcttgtttgacagaaattgtgctatttttattgttcatgtactatgcatcaaatattagattctttggaatctagcaaaagtagggagtagattaaactggcctgctgatatgagattgatgtagtgcaaaactgtcatattgccacaaggtcgttggtggttgtatgcatttgaaggcggttgcaaattattgctttacgcattccacc

SEQ ID NO: 68901 - DNA, 425 bp, Zea mays
  unsure at all n locations
  Clone ID: LIB3076-059-P1-K6-F2
attaacanagctaaggctaaccagcttgctaaggtttaaatgcagtcaggttggagaactcccttgttcaggcttttgtcttgcttctgcagaaggagagatgacgtgctgcatgacatgatggcatgtgaggcagcggcctcttctccgcaacccttgtcatggcctggagttggtgtggtaggaaggggcacaattttattagggtagccaccagagttgaggtcccttttcaatggacgaacttggtgctgtggacgacatctgctattgtagataggcgcatacatgttttcctataaatgctagctctgcaatcaccaaaggaaaacacaagagtactcttggaggaaagtttagcattcagtttaacaaaccttaccaactcatgccttgtttgaatgcaataatgcatgttctgttgc

SEQ ID NO: 68902 - DNA, 548 bp, Zea mays
  unsure at all n locations
  Clone ID: LIB3076-059-P1-K6-F3
ggccatgnngcgaccgcaggaccgggtgcgggcggccaccttcctnnctcctctttccccactcacgcatccccgnnccccttttcctcnncgtttccctcgtgacaaaccctggntcctacccgtctcccttcgggcccgctgtcacaggggtggcccacggctcgaaggcccgntctccggngtccaccgggggggggcgcgcgccgtcgcccccagctttcccaccacgaatnnccggaggtagcttctgggngagaagaagatcagatggtcatcaagggctgtgcggtcttttgcgatggcagagctggaggcccggaagatgaggtaccctaccacaggcaccgaggggctcctcatgggcattcttgttgaaggaactagtggcgcagcaaaacttttgcgtgctaatggaaccacacttctcaaagtgcgtgaggaggcagcgaatgttcttgggaaatcagaaatgttttactttagtcccatgcatccaccattgacagaagctgcacaacgagcccttgattgggctgtcaatgaaa

SEQ ID NO: 68903 - DNA, 572 bp, Zea mays
  unsure at all n locations
  Clone ID: LIB3076-059-P1-K6-F4
cgnagacggnangtacggctcctcccggggcgactcggggnaatacaggaaggaggagaaggagcacaagcacaaggagcacctcggcgagatgggcgcccttgccgccggcgccttcgccctgtacgagaggcacgaggcgaagaaggacccggagcacgcgcagcggcacaagatcgaggggggggtggcggcngtggctgccctgggcagcggcggcttcgcgttccacgagcaccacgacaagaaggaggccaaagacgcggcggaggacgccggggaggaggaggagtccggccgccgcggcgaggggaagaagaagcaccacttcttcggctgatcgggctgctgctcgatcgatctacttgcgtacgtaggctgctccccaggaccagaaggagcatgcatggagggcgaacgaagtcacgggggtttgattgcccgtctatgtatatcatgtgtagttactgatgatgtgtgtgcatggtacttcgtacgcgtgtttggtgatcgatgtgtggtgtgtgtgtctctgcatggacattttcctactctgcgttttttctctctct

SEQ ID NO: 68904 - DNA, 425 bp, Zea mays
  unsure at all n locations
  Clone ID: LIB3076-059-P1-K6-F6
gcgttctggcgagtcaactgttgattgccatcaggtctcgaaggatgccaaatcttgcattcaccatagcaaacaanactttcaccttaacaccagagcagtacatagtgaagctggagcaagcaggacaaactatctgcatcagtgggtttatggcatttgacataccgcctcctcgtggtcctctgtgggggcggggtgatgtttttatgggtgcctaccacactgtttttgacttcggcgagaacaggattggatttgccaaatctgcatgaggactggagttctgcgctttagtagcatgcccagtttgttatcccggtattgtacatatatatgttgccaactggtgtaatccgcagtgtttaatagtatatattcatgcagaaatctagaagattgtggcatgatatgtgtttgcaaat

SEQ ID NO: 68905 - DNA, 575 bp, Zea mays
  Clone ID: LIB3076-059-P1-K6-F8
cggccgcgtgggcgcgctcgctttgctggctggggggggtccaagttcctgcattgatggcgaccgaggtggctgagactcccgcgccgttggcggaggcggtccccgagacccccgcggaggcaccggcggcgcccgccgccgaggcgaagcctgccaaggccaagaaggcctctgcgcccaagaagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccggcggcaagctcaccaaggtgaagaactcctacaagctgccagcgcgcgccccggccgccgccaagccgaagcccaagtccaagaccgctgtgaagaagcccaaggccggtgccaagaagcccaaggccgccaccaagcccaagccgaagcccaaggccaagtcccccgccaaggcgaagcccgccgcaaagactaaggcagccgcg

SEQ ID NO: 68906 - DNA, 573 bp, Zea mays
  unsure at all n locations
  Clone ID: LIB3076-059-P1-K6-F9
gcgtttttatggtgggttggcttctcctcccccgaccggttcgtgttcaggttctggttcgtgggcgagagggaagantggcggcgtcggacgttgagtaccgttgcttcgttggcggcctcgcctgggccaccgacgaccactccctcaacaacgccttcagcacctacggcgaggtcctcgagtcgaggaggatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgtggaggctacggcggcggtgggggatacggtggtgcaaaccgcggcggcggctacggcaacaacgacgggaactggaggaactgagcggtggggtccgctgaggcctagttatcttgttcgcttctgctaccgtgttcaccct

SEQ ID NO: 68907 - DNA, 556 bp, Zea mays
  unsure at all n locations
  Clone ID: LIB3076-059-P1-K6-G1
nttcctttctccacaaacacattaaggcggcatacggtcgctcttctcccctcctctcaatttgcgctcgtgctctgcttcttcggctccaagagcggcgaccattgctcattgatggcgatggagggacctgttttctgccgtcctgcaatgcaagcgaaactgcctgctgctgcgctggtcaacaactccctgaccaaatccgggcagcttgggactgcattgtttggtgccatttcaaaatacagaaacatttcaagattcatttctcccatctctcaaacatctacgaagaacataggtccatgctgtagcttgagctcgtcttctgatggtaatggatacatggctggaaactctagcgagagtgatgaagactatgttaattctactgtgctagaagcagttgaggtgagaagtggatcagaaggatatgtgataaagatgcgagatggaaagaacttgcgttgtgtccatagtaattttcaaggggagaaatatttcagagagtgcaccacaacctgctattggtttgaggattgaagatggaagccgg

SEQ ID NO: 68908 - DNA, 582 bp, Zea mays
  unsure at all n locations
  Clone ID: LIB3076-059-P1-K6-G10
ctcgttgntgttntacccgcaggaccctggccagtgatggtattcgtggcctctaccgtggattcaatatctcttgtgtggggatcattgtgtaccgaggtctttactttggtatgtatgattccctgaagccagtgcttcttgttggtaccctgcaggataacttcttggccagcttcttgctggggtggggtataaccattggtgctggccttgcctcctaccccattgacactgttcgccgtcgcatgatgatgacatctggtgaggccgtcaagtacaacagctccttggacgctttcaagcagattgtcgcaaaggagggtaccaagtccctcttcaaggtgctggcgcaaacatcctccgcgctgtagctggtgctggtgtccttgctgggtacgacaagctccaggtggttgtcttcggcaagaagtacgggtctggtggtggctaaggatgtataatgatgatgacgacgaacaacaaacatgatgttttaggtgcctcctttaagtaaacatacgtacggaccctcgacaccattttaagttcgctctcgcagaggctggtgagtttgtagcg

SEQ ID NO: 68909 - DNA, 582 bp, Zea mays
  Clone ID: LIB3076-059-P1-K6-G11
ccagccatcagttatcgagaagctgtgggctcttccatttctaggctagcctaggtctggaccagttaggcacgcaagtatcaatcgattcataagaggaggaggccattgagggagccaagtagaaggcagtcacggcaaaccacgtatcttgttgttagaaagctggtgagcaactttgtcaagcctcaagagctcatggaagatggcagtgctccaagacggtctactccacccgcccgcagaagcagatctgctgagttccacaatttttcagaaaggaggagaagggataagatcaacgagaagctgaaagcattacaggagcttcttccaaactgcaacaagaccgacaaagtttcgatgctagacgaagcaatcgactacctaaaatcacttcagctacagcttcagatgctggtcatggggaagggaatgtcaccagtggttccacttgagctgcagcaatacatgcattacatcacggctgaccctgcgcagttgcctccgttgcgcccctccggccagcagcaccggcaatttcagataactcaagccaatccccaaagacaatctaacgtc

SEQ ID NO: 68910 - DNA, 568 bp, Zea mays
  unsure at all n locations
  Clone ID: LIB3076-059-P1-K6-G12
cggncgcgtgggtggtagtacacaaagggagtcagggggtcccttctgtggcgattgatggccacctaaagttgcacgtgctagtgttaattccaaagcaatcaaactgtggatgataactactttggatcttatagttcatttggtatccacagggagatgctcggtgataaagtcagaacagatgcttacagagatgcaattttaggcaatcctagcctaataagtggagcaactgtactagatgttggttgtggcacaggaattctaagtctttttgcagctagggctggtgcatctagagttgttgctgttgatgggagtgcaaagatggcttctgtggctacccaagttgcaaagaataatggtctgttgtatgatgagaacgtggaagcagaacagaagcaaggcagtgctcaagttataagtgtcgtacatacaaaggctgaagagctaaaccagaaaatacaagtcccacaaaatggctttgatctattagtgagtgaatggatgggatattgcctgctgtacgaatccatgctaagttctgtcatatatgcacgtgatc

SEQ ID NO: 68911 - DNA, 628 bp, Zea mays
  unsure at all n locations
  Clone ID: LIB3076-059-P1-K6-G2
aatcccggggaaacaggtggtcaggtacaacaactgtcttcaaaaagggctgaggagagggacacaactgtcttcctgaagcgagaggcctntctgnngnccgggtgggttcgtgcttttttggtgtcccgggtcttgtggtttgtttttgggtggcgtttgttgttttgtttttttttntcccttttctnttttttttgtgggggggggggggttnnntnntnnnnttttttttttttttttttcttctttttcttttgggtgcttttttttctcttctttgggttttgtgttgcgttttcctttcttttgttgttgtttttggtggtgttgtttggtttgtttttttgtgtttttttttttttgtgttttttttggttgtttgcttgtgtttcgggttggttctttgtttttttgtttttttggtggtgttcgtgctttgtgttttgtttttttttgtgttttctgtttgttgttgttgtgtgtcgtgttttgttttttttgtttgntttttgttttcccgtttttcttttttttttttttttgttttttttttttttgtcgtcttttgctgtgtctggctttcttttttcttgcccttcctctgtcctttttctcgctttttcgt

SEQ ID NO: 68912 - DNA, 567 bp, Zea mays
  Clone ID: LIB3076-059-P1-K6-G3
caaaccccttgcaaaataatttcaagggcgaggagagaaacgagggtcatcaagaagaatagggatccacgatgggaggatggattcgagtttgtgtgtgaggagcctcctgtaaatgataaactacatgttgaagtcctaagtaaagccccgaagaagggctgatatatggcaaggaaactttgggctacattgatgtcaaccttgcagacgtgatcagtaacaagagaattaatgagaagtaccatctcatagactcaaaaaatggtcagatccaaattgagttgcagtggagaacttcctagacagaaagaacacgaatacctgaatgtggtatacatatgaatattcttgtgctgagtttgcggatacctgtaattgagctcatgtagatattccctttgtttcaagacatctgctgagtttttcagcttttaattgctcagatttactagaaacactatgggctagttttggagtccaaaaaccgaagaggattagagggactaaaattcccttattcaaaagtgaataatgagaggattttaggtaccgtttggttcaaaa

SEQ ID NO: 68913 - DNA, 424 bp, Zea mays
  Clone ID: LIB3076-059-P1-K6-G4
gcgttcgtacactgaacttaaatcgcgcagggggggggggggcagtagctgacaaagttctgtactgaggttcattccttacacaatgcaagcagttaagcaaggattacaagatcttggcgcagattctctccagtcagctcatgatcttttgcgatcagagacactcagattagaggtgagaaccggtgctgcccaggctgaaggaggtatccatggactggaatcatacgtgaagaaggcattctagtttcataaataaacaaagaagtattgggacaatagtggttagctgcatgatatgtaaggggggcaagtgtacctgacaaaagctcagcagcttgtcagcaaagcttgtcgagttgggcagcaagtgtatcatctgcttggcgtcataataataataataaacctctggcatcgg

SEQ ID NO: 68914 - DNA, 588 bp, Zea mays
  unsure at all n locations
  Clone ID: LIB3076-059-P1-K6-G5
tgccctgctgttcgnacgctnntgcttgcagggggggcggaggtgcaaccagcgccggnaggaaggaagaagtctatgtcatggctactgcgaggctatgtcaaaggtggcttcattctagacgcctcagaaacactcatacagatgctggacatgggcttgcttcctgattacctggatagagctgctgtactgactgcactgcggaggaacatacaggaatccggcagcctagagtcctacttgaagctttgcaagcgactatctgagacagatctgattggaccatgtattgtgtatctatatgtccgcaaattcaaattgtggatggcacacatgctttagagttctgatgaaccctttcgtcatatatccactcatggcaggtacaaaatggagatctctaaaaaatgtgtgtggctcaaacgcttgtccctgatgaacaacaagacatagaagcttcaatttcggtgaaccggttggtacataataatggttccttgtatatttttgaccgaagtagaggtatcaactggttgtttgttgtaaacagggctgttgtagtactttgaacagagtccatatcgt

SEQ ID NO: 68915 - DNA, 572 bp, Zea mays
  unsure at all n locations
  Clone ID: LIB3076-059-P1-K6-G6
cggccgcgtgggcggncgcgtgggcggggcgcgtgggtgacaattacctttatgccaagcttgctaagtttattgtgaacaaatctgatttggcggaaaaagatatcccggctttggctgatatagttggtgatgacgacaaggctaaagaaattgttgaagcagcaaaggcttcaatggggggggggcggtcaccagttgatttgatcaatgtccagcaatttgcccaaagggttatgaatctctctgagtatcgcaaaaacctttatgaatatctcgtgactaagatgaatgatattgcgcccaacctgacatcattgattggtgaagtagttggagctcgcctaatctctcatgctggcagtctttcaaaccttgccaagtgtgcagcttccacccttcaaatacttggtgctgagaaggccctattcagagcactgaaaactcgagggaatactccaaagtatgggcttatattccactcctcctttattggccgtgcttcaaccaagaacaagggcagaatggctcgttacctggcaaacaaatgctcgattgcttcacgcattgac

SEQ ID NO: 68916 - DNA, 534 bp, Zea mays
  unsure at all n locations
  Clone ID: LIB3076-059-P1-K6-G7
cggccgcgtgggtacgatttggtgacgcgcctgccatcgctggtcgctgcttctgctgtctacgcagccagactcactctcaagaggctcccctttggaccgacaccctcaagcaccacacgggcttcagggagtcagaggcagagctcattgaatgcacgaagatgctggtgatcgcgcactcgactgcccctgagagcaagctgagggttgtatacaagaagtattccagcgagcagttcggaggggtcgcgctgcgtccacccgcagaggagatctgcaagtgaacgaaggctactttatccgtgtttgcctattgcttgctttaggggaagtggcgatggaaggcgagtctgacattcgctaggcttttttatgtttgcttgtttcagacagccgtttgtttgctaggctgttctcagagtcggttgttatctgacttgtgatggcaactataattctatctagtacaacatttttattcattttanaaaaaaaaaaaaaaaaaagggcggccctagttctagatcgcga

SEQ ID NO: 68917 - DNA, 578 bp, Zea mays
  unsure at all n locations
  Clone ID: LIB3076-059-P1-K6-G8
gccagtgtaggttggttgttcccagtgggagatgcaggatggtccatgctggnggaatcttcattgtctgctgctgataaacaagcacagggtttgttaaaatcaactaatcataagcagcttctgagtgtgtcggacaacccaggcgcctttgatagacgtgacagtatggctggcaagatgggtgtgttggctgcagaggtgagaaaaactgatgccgtgggcaatagtaacatagtgcagaacgaggctgaaaagaaggaacatgcttgttcctctttgcctgatgttcccaaactagttgtcgcagcagcgtctccagttggtgtggcaaatgtgaataaggagatgaaagaatcaaaagacagttcaagtgaatccaatagccatgtaaaatctgaaggtgtcaattctcagcaaagcgagcaaagtgcaatgcagagttcaaagaaatcctgtgatggtgtgagtggaaaagaggacgaaaaagaagaccatgtcttatcagacgaaggttcttctctagccgctcacaccaagtcaaatgctacagccaagcttgatttcgacttgaatga

SEQ ID NO: 68918 - DNA, 508 bp, Zea mays
  Clone ID: LIB3076-059-P1-K6-G9
gtcacagtaactcttctactatcgttgggttgctcctccgatttgcgccgagaagcaaccgctatagttttcagcggtttcttttgttccacttgatgttgctttcgcttaagggcggttccttcctccatttgcctgccaatccacttttgacgagacagatatttattggatctagttccggaagaagataagattttcctcacagattatcctttttgctttgctctattctctttgattttgtcagctttgcgcccccaattttcaaccggagcaagacgacccgagcattctttgatttctttcccccacaacggccatgtcgctgagccgattctcgaagtggatatggccggggagcagagccagaaaccgtagaggccgcgaccgcgagccaccggcgtggagcagcacggccgtgacgaaaggcctcttcccggactccccgtccgggtttcgggagccagacgccggcgtcgggcgcacgggcacgatcagccggcgc

SEQ ID NO: 68919 - DNA, 547 bp, Zea mays
  unsure at all n locations
  Clone ID: LIB3076-059-P1-K6-H1
tgcagctccagacctcatcagnagcacctaccacaccgcccgccgccgatcccgtctcctccccgctgcggagcgtctccagccctgcccggtgcccacccagatggcaaacgcggcgtcagggatggccgtggacgacgagtgcaagcgccggttcctggagctcaaggccaagaggacgcggcggttcatcatctacaggatcgacgagaagaagaagatggtggtggtggagcaggtgggcgagcccgtgctcggctacgacgacttcgccgccagcctccccgccaacgagtgcaggtacgccatcttcgactacgacttcgtcaccgaggagaactgccagaagagcaagatcttcttcatcgcctggtctcctgacacggcgcgcgtgaggagcaagatgatctacgccagctccaaggagaggttcaagcgggagctggacggcattcaggtggagctccaggccaccgactccgtcgaggttggccttgacgtcatccagggccgtgcatgctgaggatgcccagcgttgaactgccca

SEQ ID NO: 68920 - DNA, 577 bp, Zea mays
  Clone ID: LIB3076-059-P1-K6-H11
cccagcgtccgcccagcgtccgcgggcgcgtgggtgatcttgttgagaagttagaagaatcctggataaacttgaagggcaactcgtggacttgtcttccttattgtatgaccaccggctggtcgatgcatatcaaaacagtaccgatatcctgcaaagcactatttttacacaacagtgtgtggaacgtgttctagctaacgagagagacaagatgaaatgctgtagcattgaatatagtcatccaaagcagtcatcccaggcttttgtctatggagggatccttctggctggatttcttgtgtattcactggttattttcttctcttcacctgttcgctaattttatgtccagatgcagaaagtcttggatgctttatggtaggctaggtttgtctggggctgtcaatcttcatgagggaatggcctgaactgtcttggatacagaagggctttggcacagttttagtgctctatttctcgacacacaagcaatcagacggctgatatatatgtaactgattcttgtctgcgataaactatagtcgatttcacagaagagctggtgcatgctatg

SEQ ID NO: 68921 - DNA, 562 bp, Zea mays
  Clone ID: LIB3076-059-P1-K6-H12
cacagctctgccgcttgcctccgccgggggggggagggacgaggcgcctagccggcaaccgttttcggggttgctggcggcgattggctgcggttccgcatcaagctggtcgaacgctgcccctcctgattggtaggtagctcgagatggatctgattcttccatataaggttggggacggggggggagtccaaatccttggtgagcggttacagaggtgcatggtttcgctgtaagatacataatatgcgtgtcaggcttggatacctggagtgttacttggaatacattgattatccaggcgaaaaaaaggaatgggttaggctctttcgaaagaactctgcaaggtccaaccaaaattcaagtgatagtattcacaccatgataaggccttcatttccaaaatggtattttgtgcatgaagttcctgagcagttcccaaatagtgatgtcacagcaattgttgatgaaacctggcaaattggtgatcgagttgattggttgaaggaaggttgttattggtctgggacaattactaagataatcaatgaagatctggtcg

SEQ ID NO: 68922 - DNA, 566 bp, Zea mays
  unsure at all n locations
  Clone ID: LIB3076-059-P1-K6-H4
cgcctacagnaacgtcatcggcgcccgcggggcctcgtggcggatcatctcctcctcgagcagaagaggaaggccgcgggaacgaggcgcacgccgcatccatccgcgcctaccgctccaanatcgaggccgagctcgcccgcatctgcgacggcatcctcgcgctcctcgactcccagggggggcgcatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggctccaacccaccccatcaggctcgggcttgctctcaacttctcagtgttctactacgagatcctcaactcccctgaccgtgcttgcaaccttgcaaagcaggcctttgatgaggcaatctccgagctagacagcctgggagaggagtcctacaaggacagcactctgatcatgcagctcctgcgtgacaacttgaccttatggacttccgacaccaa

SEQ ID NO: 68923 - DNA, 569 bp, Zea mays
  Clone ID: LIB3076-059-P1-K6-H6
atcggcacgcgtgtctggctaccacatcgacccttaccagggcgacaaggcgtcggccctgctcgtggacttcttcgacaagtgccaggcggacccgagccactggagcaagatctcccaggcgggctccagcgtatcgaggagaagtacacctggaagctctactcggagaggctgggggcgctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttttttcccttcccggaggcgaaaaaaagagtctgcttttgctaggcggcgggcgttcgttgctgctctttgcttcaagagttaaatttacctaccttgtcaaggtcttgttccatcattgatccgggtgtcgcttttttagtagtctg

SEQ ID NO: 68924 - DNA, 457 bp, Zea mays
  Clone ID: LIB3076-059-P1-K6-H7
ttaacgcttcatctctgccgcggtgctccggccgtgatgaccaacctaggcgagaagctgaccgacgaggaggtcgacgagatgatccgcgaggccgacgttgatggcgatggccagatcaactacgaggagttcgtcaaggtcatgatggccaagtgagtaaagcctgcggtaatggtgtagggaccgcgctcggaaggaggaaaccgtgcgttgcatattagtaaggcaatgcaatgcagctcttgtttccttcttcccgtgaagaaaccgtactagctgtagctgctgaacgtttgagtccctctgctgccacccttatctccattgtgccgtcgaacctccttgcttcccctgtgtgaatctgtacggattttcgtgttctgaacactgattgcagttgaatccagtttgtagttctatttgttcatcgaattcgaatctgcccgattccttt

SEQ ID NO: 68925 - DNA, 51 bp, Zea mays
  Clone ID: LIB3076-001-D4-F1A
tggagcaatttttttttttttttttttttttttttttttttttttcttttt

SEQ ID NO: 68926 - DNA, 286 bp, Zea mays
  unsure at all n locations
  Clone ID: LIB3076-001-D4-R1A
cggacgctggnnccgacgcgtgggtcttgaagttactgaaggcaacaaacttgctcaagtgtggagagatgtgcaggaaagagcttatgaagcgcatcgcacggcaactggaagaagcgtcagtgtcagatcttctgatccctacggtggatggggataccaccgtttacgacatcgacctgattcttagcattgttgaagaatttgtcagacaagaaaaaaaaaaaaaagaagaaaaaaaaaaaaaaaaagaaaaaaagaaggacggcaggacggggagagcgaa

SEQ ID NO: 68927 - DNA, 53 bp, Zea mays
  Clone ID: LIB3076-004-D10-F1A
aagcttcgatcttctagaatgcaagctctattattctatggtgtcacctaaat

SEQ ID NO: 68928 - DNA, 435 bp, Zea mays
  Clone ID: LIB3076-047-G3-F1A
aaacaactctccattatcctcttttttcattttcctacaatatggtgatatttttttttccatacagagataagttaatgctttctccatgagccatatgttacagaaaaccagcagaaagccgatccaaaagcatgctacaaatattagctgaaccgacaattcgccaagttggcatacgaagcacattgttatgtaaataaggacacttaggcccattggtgatcggcacagagaggcgacacgatccaggaggttaaagtaaactgcaactactggctgttcctaagctgcttgctgatgtgacctgagactatggttgcttcaggtacccttctccttcagcaaccccgcccatagaggtggagctgctggttatagagctcatcagctgagatggttgacagagaagttctgcctctgggtgtcgtgcgt

SEQ ID NO: 68929 - DNA, 473 bp, Zea mays
  Clone ID: LIB3076-047-G3-R1A
atccggggggaagaacaccaaccaagcaggacttggtttttgggaactccatgggctgtggaattgtccccaggaatcccctctgggtttgacgagattcatacagatacatatatttaattttttcccctttcgtttgctcaaaaaatcaattgtacaggcgaaactgcttgtttgtgctttgtttcttccgtgtttgtttccttgggattttcctctggtccgttcttcttcacctgtggggtgggaggagcagagacaatcatgggaaagcaaggaccctgccgtcattgcggagtcacaagtactccgctgtggcggaatgggccaccagataagccggtgctctgcaatgcgtgtggctcgaggtggagaacgaagggttcattggcaaactacactccaatgcatcgcaatgacaatattgatgatgatgaacccagagttagcaagctgaagccaccgacgtcaaa

SEQ ID NO: 68930 - DNA, 283 bp, Zea mays
  Clone ID: LIB3076-004-D10-F1B
gatgcgtcatcacaaatcatgggactttatttgcctttttattattatatatgtaacatcctgatacaacagaacgattttgtttaatttgttttccaacctaccttactgaaaccaacagtgaagggggaaaacccacaaaactggtcagccttccctcacaaaagcagttcagctcctgccgtgtaggagcggagaaaagattggcaggcatctcaggtagcataatagcccagaggatgacggaaaaaatggcccgcatgccacagactttttcgatcac

SEQ ID NO: 68931 - DNA, 634 bp, Zea mays
  Clone ID: LIB3076-008-Q1-K1-H2-M1
atttgggtgtgttctgctataatttacggtaagaattgaagacaatgatgtcggcatccctccagacactggcatgcttctcaattctgtctgcccttatgatccgatctgtggagggaagcataccaatgccttgaaggagatgagtgagccattgaaggtgcgtatcttgagcctgtcgtcaggtattgaggcctccaccatgcacacgagagagacccattggttcctgttgactgagtcgcccacaaacaccattctcttgtttctcagattttcaagcagcttgatggcatcaaatctgttttggaaaaaaggaaccatattaaaaaggggaatttgtcatgatgaatttggcctttctgttcatgtacttagattaaattgagcattccattgaaagctattctgtctgaaaagattagcagagaagaaaggatgccggcgggggagacgagacatgctggagaatgggtaccattattactggaatgtgcaccagctgaagctgattgattgagcctttaaataaataaataaaaaggctggtaaaattaaacctgtatcagtggttgcaaccgaatggtggtccacgtgattccctgcaggatgaggcacctagctagctgttgga

SEQ ID NO: 68932 - DNA, 510 bp, Zea mays
  Clone ID: LIB3076-008-Q1-K1-H2-N1
gggacataaaaagggtactgtgtgcccgtttcctctttcagtgcatatatatattggtgattttttacagtacatgatttaaatgctaagaataataaagtcagggtgagaaggcaggcatacattattaatcagtctctctccaacatggagcacattgtcaaaccgtcggtggcccgacgatgctagctgcatgcatctgcatcatgcatgtcgttgagtcccacggtttgatttgccattaggatcgactaaacaaaaaaacatggttggtggtgcggaggttgtgtctgctagcacagcatgggtacctttctttctgttgacctttagatgcacgtcttgatgcagacggtatagagaggagggtaggcaggcccctggactggacccccggtgctgctggctctctgctacgtactgctgcaccagcatcccattcccagatcccagtacgtagaatggacgtactgtacgcgacaggaacagtagtgtgttacttggcatgct

SEQ ID NO: 68933 - DNA, 242 bp, Zea mays
  Clone ID: LIB3076-038-Q1-K1-E12-R2A
tcgttaactatcggaatttcaaaaacccatggatatggtgacctagacaatttacacacaaggccggacacacgatggttgaaatcatacgggagactgatagaccaccgccctcaaacactaaagagcggagaattgacacgcaataatgggtgctgggacaaacatgatcaggacagatgatgaacgtgttatacacgccactcgggttgtaagaataacccgtctgatcaagaactcat

SEQ ID NO: 68934 - DNA, 284 bp, Zea mays
  Clone ID: LIB3076-004-D10-F2B
gatgcggggtcacaaatcatgggactttatttgcctttttattattatatatgcaacatcctgatacaacagaacgattttgtttaatttgttatccatcctaccttactgaaaccaacagttgaagggggaaaacccacaaaactggtcagccttccctcacaaaagcagttcagctcctgccgagtgggagcggagaaaagattggcaggcatctcaggtagcaaaatagcccagaggacgacggaaaaaagggcccgaaggccacagacttgttcgaacac

SEQ ID NO: 68935 - DNA, 308 bp, Zea mays
  Clone ID: LIB3076-004-D10-R2B
agccttccaccaagtctgtggcctgcgtgccttgtagggggtcgtgctcagggctcccccgcgtcccgagatgccagtcaattttttctccgatcttactccgcatgagactgctcgtgcttttgtgtgggaaggctgacccgccttgtgggagaccctccttaactgtaggttccagtgatgtcggacggcaaaccactcaatcaaattggtcactgttgcatcaggatgttacctgtctactaatgaaaaggcacataatgtgccatgatctgtgatgtcgcatcagagtcaatgctaccatctac

SEQ ID NO: 68936 - DNA, 477 bp, Zea mays
  unsure at all n locations
  Clone ID: LIB3076-007-Q1-K1-H11.F2
ttnntgttttttttttttttttttnntnntnnntnntttttttttttttttttttttttttttttntnntttttttnnnntttttttttttttttttttttnntnnttnnttnnnttttgttgtnttgtttggggtntttttttttttntttttttttttttttttttttttttnttttttnnntttttttttttttttttttttttttttntttttttttnttttnttttttttttttttttttttttttttttttnntttttttttttttttnnttttttttttttttttttttttttttttttttttttttttttttttttttttttttttttttttttttttttntttttttttttttttttttttttttttttttttttttnttgttttttttttttttttttttttttttttttttttntttttttttttttttttttttttttttttttttttttnnttttgtttttttt

SEQ ID NO: 68937 - DNA, 153 bp, Zea mays
  unsure at all n locations
  Clone ID: LIB3076-021-Q1-K1-F8.F2
tttatggtccccctttttttttttttttnnnttttttttttttttttttttttntgtttttttttttttttntntttttttttttttttttnnnnnntnnnnnnnnnnttnnnnnnnnntttnttnttttttttttttttttttttttttttt

SEQ ID NO: 68938 - DNA, 314 bp, Zea mays
  unsure at all n locations
  Clone ID: LIB3076-024-Q1-K1-B7.R2
ggggggggggggggggggggggggggggggggggggggggggnnggggggnggggggggggccgtgtttttttttttttttttttnntnnnnnnnntnnnttttgttgtgtgtttgtttnggtgggtnnnntncnnttnnngggntngngnggncggtggngcggcgggccgggggtggggggtgcgggcgtgtgggggggcgggggggtgggtgggggggggggggggggggggggggggggcgtggccgcgggggggggggggggggcggggcggggcccgcgggggggggggggggggggggggggggcgg

SEQ ID NO: 68939 - DNA, 684 bp, Zea mays
  Clone ID: LIB3076-047-G3-F3A
tgatgatgaacccagagttagcaagctgaagccaccgacgtcaaagttgaagtcacagaagaaaaaaacaaatcacattataatggagaatggaccattctctagtcagaatttccgaaagatgggggatgatgacccaagctatcggtctagttcaggatctgcagtatcatactctgggagttgtgccccatatggtgctgctgatgcaagtgaaatgactggttcagcacagtcacatgcttgggagtccctagtgccatcaagaaagaggagctgtgtcacccgtccgaagccttcacctgttgaaaagcttgcaaaagagctgaactctatcatgcatgaagagaagttatattacctttcagaatcatcagaggaagacctactataccatagtgaaactcctatcggttcctttgaaataggctctggaagtgtgcttctaagacatccaaactcgaaatcactggaggaagaatcaaaaacaagctcaattcctgcagataataaatcatatattacaagtgaatcctattcagactctgcctcatttgtcgttcacagtggaaacaaggcagcaattaacttaaatcttccaactgcaaggtcgaagaagtcgccgctgcatatggaaagacatgctagaagggataaacttcattatgagaatcagcatgtcct

SEQ ID NO: 68940 - DNA, 516 bp, Zea mays
  Clone ID: LIB3076-052-Q1-E1-E9.F2
agagaacaggcatttcttcttccttctaaatagcaaggacacttgcgcaggacacattcacatacaagcacattcgtcccatctgcagcctacgcatcaccgcatactggtaacaaggtactgctaaacatcagatcactccggcagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtagacgggggcgccggtgccgacacgctgcgcgtagcggcccttcttcaagtagcgcccgatgcggccgacgggg

SEQ ID NO: 68941 - DNA, 662 bp, Zea mays
  Clone ID: LIB3076-052-Q1-E1-E9.R2
gcgttcgccgcattcgttccaactcctgcacactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggggtggagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaagcatagactgactgtccggagtgatcctgatgtttagcagtaccttgttaccagtatgcggtgatgcgtaggctgcaaatgggacgaatgtgcttagatgtgtatgtgacct

SEQ ID NO: 68942 - DNA, 207 bp, Zea mays
  Clone ID: LIB3078-003-Q1-K1-B2.F3
cgtacgccgtccgcgccgccaccttggttgaactccttgcggtcgggcttgtggcagcgcttgacgaggcggacgctgtccttggcgaagtcgcggaggggatccaccacgctgtcgatcgcgtccatggcgacggggcgagatctcgagacgaatgtggaaggaagctgatgagaggatgcggttttgcgtttgcggacgcgtggg

SEQ ID NO: 68943 - DNA, 200 bp, Zea mays
  unsure at all n locations
  Clone ID: LIB3078-003-Q1-K1-B2.R4
gactagctgggnatagtgcatacttttgggnagcatagnaaacgaggatcctggtctttcngaaagtattgttaatgaaattttcgttcggttgtgtttctgatgtaatcgttgtactgagtagaccttctggataccggattctgagtagacctttgaatccttgatggatcagccaatcttcggaaaggaagtttcgt

SEQ ID NO: 68944 - DNA, 574 bp, Zea mays
  unsure at all n locations
  Clone ID: LIB3078-003-Q1-K1-C3.F3
gactactcttctacgtacgccggtggngcattaggnggnaactcatatgatggaactcctcaatggacttcaaaccaccaatatatgaagattcagctttgtaaatatcatcgatattaaattctttcccatcctcggatataatcactgcatctgagtcctccccagcatctcttttaggcggcagtgtaaaatatggtattttaccttcattccagtcatgaagcacaattctcgctgcagcttcaacatccactacaccaccctttttcaatttcccacgtacaggtgctactttctgaaggaaatcatcaactgaaccaaagtttggaaccttgtatagagacagcaacttctcatgtgggcaaaacttaggatctccttaacaggagcgactggatcttctattttctcaacctttttgcagtttcgaagggctacagacacaccactgttggaagatttgagcataacaacaccaggacaatccaacaactttaccttcttgtctaattgaacttcttgcattgatctagtaatccctggagtagaaccgacattgaccactcggcac

SEQ ID NO: 68945 - DNA, 375 bp, Zea mays
  unsure at all n locations
  Clone ID: LIB3078-003-Q1-K1-C3.R4
aggcagccagcgccagcacgcagnacgacaagttgtacaccgccgngggcgtactcgaccctcgcaaaagcaaagcagagaagaacggcgcaaggcgagcaggcccagcgcgctgaacgacatggacgcggactacgatttcaaggtggattatcggatggaggacggtgggagcgagggtgcacacgcggatgatgaagatggcggagatggatccgaggataatgaaccaatgaccggtgtcgatgatgcatgaattgtcatgtcgagtgccactttgccagaaatgatttgtcccaatgggggttgggaaattaacccacgacagttttgtgcttagtttgtttcttcaatgaaagatgacagttgcgtttt

SEQ ID NO: 68946 - DNA, 364 bp, Zea mays
  Clone ID: LIB3078-017-Q1-K1-H7.F3
ggttaggctataaaagagctttccgacaacccgaccttcctgttccgaagggttgacgaagagctgaagagctcccagggttcgaggaggcacatcttgagcactactatgcttacctgtgcgagaatcctccgcttgcgagggcattctatgcgctgcctcagctttctagcaaagttacgtgggttgctaggtacgtcaagaatcacagctccgaactgatgtagctactctgatgatgtggtggtattttggtctagtcactagggatgaaaaaaaaaaactctttttgttgtatgacagacagcatggaacgtgactatagtagggatcttttaatataacataacgtagattagtggcg

SEQ ID NO: 68947 - DNA, 64 bp, Zea mays
  Clone ID: LIB3078-018-Q1-K1-G4.F3
ttggtttgtttgcttcttatcgactgcagtttggattctgaacgtcaaaagttctagatcgcga

SEQ ID NO: 68948 - DNA, 236 bp, Zea mays
  unsure at all n locations
  Clone ID: LIB3078-018-Q1-K1-G4.R3
accctcagaatgtagcgttgtcgaatagcagtacgagtgggatgagagaaccatggggcaaggcagttccacccaaagagaagttcccaagcaaatacagcccagtgtaaggcaaacagctgtttgcaaatgtgccttgtccagcagcaagcctctcaacattgctaccatagagcacacatggtgctaccgttccagacccacgcgtccccccacgcgtccgnggacgcgtgggc

SEQ ID NO: 68949 - DNA, 101 bp, Zea mays
  unsure at all n locations
  Clone ID: LIB3078-032-Q1-K1-G3.F3
gtccatgtaccatatacatatatatangactacgaaacagtatgtgtgccatgtacggtcattttttttacagagttgagaggagtacccatgccgtttcg

SEQ ID NO: 68950 - DNA, 293 bp, Zea mays
  unsure at all n locations
  Clone ID: LIB3078-032-Q1-K1-G3.R3
atgacagccccgcggnagggagggtgcacttgttctccttggccaccaggtacatgtagtcgtcgtggccccatgacatgagcaccttgttgaggccgcagccctccgagtagacccccaacttggtgttgagcttcgggttgtggtagtcggggttctccttgaagtacttgaagtggacgttgcactcgtcgtatgcgcagccgacggggnaaggtgtcaccgacgacagcccactgagggagctccccgaagcttgggtgcagcagcaccttgcccaggtcgtggatgag

SEQ ID NO: 68951 - DNA, 293 bp, Zea mays
  unsure at all n locations
  Clone ID: LIB3078-050-Q1-K1-H5.F3
ctcatggacaactgggtgactgctttgtggccgcgtttgttgaagagatgnagtctgaaacgcgtanttagnaggtagcaccaagccgctcttcaaacttggctgattgtcagacttacactgctggttctgtttctgaaattcaaatgccacttcttaaattccattatatcctggtggaagaattgtatagtttttcctccctgcacacatgtgccgatttggctactactagtataatactaccgccttggaagttggaattaacccaaccaacacccccaggaaaccca

SEQ ID NO: 68952 - DNA, 245 bp, Zea mays
  unsure at all n locations
  Clone ID: LIB3078-050-Q1-K1-H5.R3
gtccttcctgctctgnagcttggngtacaaaccatagtctgggcanaggtggaagattcccttgccctctgtggagggaagccgtggttgcggcatacatcgatcagacagttgcagtaaggacggcgtacttcaggggcagcgctgttcagcacgctcttcagctcctctgtgatatcgtcaccaccgacctgggcgtcgccgagcactctgatcagcttgaccaggttctgcggacgcgtggg

SEQ ID NO: 68953 - DNA, 420 bp, Zea mays
  unsure at all n locations
  Clone ID: LIB3078-051-Q1-K1-F7.F3
aaaaccgcttccgctgagctcactttaggccaagnacgcccgccgctctggaagcgcacgacaaaggatgacaagatttctcaaaggtcgagaagaatacgtcangaggaaaagaacacgaagatattctccaacctttttgacaagaaggtcagcatattttcaaagaagaatgtgagatcgtcggaggtgccaccggcatccacttcatcttcttcgccagggccatttgacgagagtgagtggacgattttgtagttggaactcctgtattgtttcttttgtacaacatgtagaggggggggtgccccgccagatgcccgncaataancctaaactgaacataaccaaaactaaaccaataaaacaataataaaaaaaaaaagaaaaaaaaaaaaaaaaaagaaaaacaaaaccaaa

SEQ ID NO: 68954 - DNA, 427 bp, Zea mays
  unsure at all n locations
  Clone ID: LIB3078-051-Q1-K1-G4.F3
tacatttccagcttgggttgcagaaatcatctgtcctgcttcatatgnatattgtngatgataaaatcttggnaaaaggtaccgttngatacttaatagtgcacacggccatattggactactttacaattgcagataagacctcagcctcggatgctatttgtcaacttatcccccttcttactcaaggggcattaatcatagatggagatgaacctacaaacgctccagaactaccaaagaaagcaaaagctaagaagaaaaggtcgaaagaagccacttattgttcggatcatgcagacaagggaaggattaaaactaggaattagttgcctcaagtttgggcagtgcaaagattagcttttggaagatacaccattggcccaagcttgagctgggatggaatattcctaagatgatcgcaaag

SEQ ID NO: 68955 - DNA, 245 bp, Zea mays
  unsure at all n locations
  Clone ID: LIB3078-051-Q1-K1-G4.R3
tgtgttcctcctgatgctatcacgatgaaactttcagcctctcacttacatatagacccacttgcacctattttgaagtttgcagccctcagcagcagcaaggaattgacgcataagcaatatgtagcaaaacatcagcaatggacatcacaacaatgggngaaatttttactattacaggatgcacaacataaagtctagacttctgattagttatgtccctctatcataccgtgttttttcta

SEQ ID NO: 68956 - DNA, 190 bp, Zea mays
  Clone ID: LIB3078-052-Q1-K1-C2.F3
gcaggcttctgttagttattaattcatactgccgtgttactagtgcgcctcagcatggagaataaaaggtgtgaaatatagctgggagcttgtactttattagttatcgattgttgtttatctttaacttgcttaccgaaatcgtgttgtgcatcttgtctttttgtcaatgtaagcagagcctgttctc

SEQ ID NO: 68957 - DNA, 490 bp, Zea mays
  Clone ID: LIB3078-052-Q1-K1-C2.F4
ggctttggctgcccggcactggagtgggcgggtggtactccggcgccggcttgctgtgctcaggcaccgggtggtactccggcaccggcggcttgctgtggtcaggcaccgggtggtactccggcaccggcaggggtgccttgtggaagtgatctaacaagtgcttcttgatcggggagcagagaaacgcggacgcgcactccgcggacgggtagtgcatcttgccaggcacggcgactaaggtgccgcctgacatgggcgcgatcctggacggctcctgcccagggcaaggcgcgttattggcggcgctgtggagctgcgcgtggcagtcggcgccgtggaggtcggcggcaagtgggacgctgaaggctccggagctttggatctcactcacggtctttgtctcgtactcggcgctgctgttcttgcacttgatcgccacctgaagacccttgaaaccggtctcagccttcatgtacttactcgtgct

SEQ ID NO: 68958 - DNA, 195 bp, Zea mays
  unsure at all n locations
  Clone ID: LIB3078-052-Q1-K1-C2.R3
cgttgctgttcttgccttgangccactgagaccctgaaccgcctcaccttcatgttcttcctcgtgctgtcggcgcacctcgccaggcccacgacgaccgacgccacctggccctccgccgcgttcgtgacgccgaccaccatcagcacggcacagacgccgaggagcatcctttctggtgcccggacgcgtggg

SEQ ID NO: 68959 - DNA, 649 bp, Zea mays
  unsure at all n locations
  Clone ID: LIB3078-052-Q1-K1-C2.R4
accaagactccggngaccttcagcgtcccactcgccgccgacctccaggcgccgactgccacgcgcagctccacagcgccgccaataacgcgccttgccctgggcaggagccgtccaggatcgcgcccatgtcaggcggcaccttcgtcgccgtgcctggcaagatgcactacccgtccgcggagtgcgcgtccgcgtttctctgctccccgatcaagaagcacttgttagatcacttccacaaggcacccctgccggtgccggagtaccacccggtgcctgaccacagcaagccgccggtgccggagtaccacccggtgcctgagcacagcaagccggcgccggagtaccaccctcccactccagtgtacgggcagccaaagccaactccgatctaccatcctcccgctgagcactgagttcgatcaacaacgaacgccagagctagaagaacggcaggcttctgttagttattaattcagtactgcacgtgttactagtgcgcctcatgcatggagaataaaatggtgtgaaatatagctgggagcttgtactttattagttatcgattgttgtttatctttaacttgcttaccgaaatcgtgttgtgcatcttgtctttttgtcaatgtaagcagagcctgttctc

SEQ ID NO: 68960 - DNA, 503 bp, Zea mays
  Clone ID: LIB3078-055-Q1-K1-D7-F2A
ccccctaccgtagcctggaaccctttaaaccggccgcccttttttttttttggggtccttccccctcccttccttccccttccccttcctcctccccttccccccaccccctttctctttttttggcctttcttccctccttaaaccgtctttcttttttaacccttctttccaggggaccaccccctcttcaaaaagctctctaacctaaggcttcctggcccaggccctggactcttggctatcctcgaaaagctggttagaatcatcccatgttgaagaagctgatatttccttgatggaatacaaaagatctgaaaaattttcacccaagcgctggcgcttcttagcgtccttttgctctttttccttgagcctttcaagctgatcgtcatatacaagcttgatgttgatggttgatattcctttaagagcatcatcctccagagtagcagtttggaattcctctaatgtccatgaagttgtcataggaatctttccag

SEQ ID NO: 68961 - DNA, 434 bp, Zea mays
  unsure at all n locations
  Clone ID: LIB3078-055-Q1-K1-D7-R2A
cccacgcgtccgcggacgcgtgggcggacgcgtgggcggacgcgtggggtgatgatttccttgcaatgttggaagaaagcaaggagcttacatcatcaacaagatggagcaaagcaatacttatgtttgaagatgatgaaagattcaaagcagttgagcgtccaagggagcgtgaagatttatttgagaactatcttgtggaactgcataagaaggaaaaagccaaggctgctgaagaacacaaaagatatgtagcagagtacagagcttttctagaatcatgtgacttcatcaaggcaagcactcagtggagaaaagttcaggaacgcctggaggacgatgaacgttattcccgacttgagaagtttgatcggttggatatttttcaagagtacattcggcacctanagaaagaagaggaagagcagaagcgg

SEQ ID NO: 68962 - DNA, 172 bp, Zea mays
  Clone ID: LIB3078-013-H9-F3A
gacggcgcccccaactaggcctgaacatgaggaaggacacacttgagcataacgctattaacaaggcggacaaggggaaagaactggagaaacaacttgaagaagcaagagggcttgcttcactacaaaaaaggagagaattgaaggcagctggtattgatacacgccacag

SEQ ID NO: 68963 - DNA, 208 bp, Zea mays
  Clone ID: LIB3078-013-H9-R3A
ttcagtggcagattcaggttcggttaactcaacccgggtgttcgtagtatgcgagcagacggacgtggcggggccactcataccagcgggccttgcactgcttggcggactggcggacgagcagcgacgagatgcgcgcccactggttcttgccgtacttcatcacggccgccttgaggatctcgtcctccgtgttcttccacacgcc

SEQ ID NO: 68964 - DNA, 448 bp, Zea mays
  Clone ID: LIB3078-023-E2-F3A
tggctcttatgaccgaacttgcagccttctgtagtgttgtacttggtgcacatgcgtgtcttgaccgtagaagctggatgagaggcaccggtaagagcggcatgatccacatgagttcttgatggcgcaaatccagcaaagctacttaaattcagcatttttgcaactgccgcgtaaccaccagggacaaagggcaaaaaatgacatccctcgccaaacgggcacccaatcgtactgaaaaacttggtgcaaggcttcaatttgcttgatagaccagtttgaaatgactccgtgtctttggaacgcttcccggcggcggcagccccgttcgccgtttccggccggaacctcttccgggccggagcggttccttccatgccaagcctagcctcgcgtccgattgcagaggcgcaccggaaccctagccccccggtccgattcgttacga

SEQ ID NO: 68965 - DNA, 365 bp, Zea mays
  unsure at all n locations
  Clone ID: LIB3078-027-Q1-K1-E11
gcggtatctttttcactcaggactgggtatccatgccaggtgttataccggtggcttctgggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaaattgatggtttcaaagcgatggataccatttttaaataaanaaaa

SEQ ID NO: 68966 - DNA, 314 bp, Zea mays
  Clone ID: LIB3078-006-Q1-K1-A3
cccacgcgtccgcggacgcttgagcggattcatggtcacacacgtggggggctcttagggcgcctcccaggtgtacaaggagctgcatgaggccatcaaatcctacccggacgccttccaccgcgtcatcgacttaaacaacatcaagcatacacactgcgtcagcttcatcacctacaagcccccggtcagcgactataccgagctcgtcggccgtcctcctgcggctagctagctagctagctcctgcgtgagctaatagctagtgccatgcgtagtctatgacgatcggttttgcttcaagtcaccgtgta

SEQ ID NO: 68967 - DNA, 301 bp, Zea mays
  Clone ID: LIB3078-053-Q1-K1-B1
accgtcgtcgctacgttccaggggctctaggacaccggcaggctccccgtcttccttcgctggtccataagcctcggcagcgtcagcaacgagatggaaggatccggtgcatgcatgtgtgtacgttctacggtaacaagaagttttagacgctgtcatacctgccggcgctttcgatagacgacctgctgaaccatgctgactacctgctgttcaacagttggataccctggcttgagttcaccaaggtcagcttcttgtaccgtcgagaacgttacctatattgagctactaccactgg

SEQ ID NO: 68968 - DNA, 164 bp, Zea mays
  Clone ID: LIB3078-029-Q1-K1-D6
cggacgcgtgggcggacgcgtggggtcggtgctatgctcccgtactggttctcggcggtgaccatgaagagtgtgggcagtgctgcgctcaagatggtggaggaagttcgtcggcagttcaacaacatccctgggctcatggaaggcaccacaaagcctgacta

SEQ ID NO: 68969 - DNA, 420 bp, Zea mays
  Clone ID: LIB3078-015-Q1-K1-E5
aggggtgactactggcacgccaattgttggtattgtcccaaacacagatcagataggcagtgatcaccgtgaaatagccaatgtgtaccgaccttctcatgcagacgcaacttatgacttcaagtacggcgttagagctgtacagggaggtgggaggtcgtttggcacagaaaccgtaggaagggtggctgcaggtgccctcgccaagaaaattcttaagctcaaatgtggattagagatctcgtcgtttgtttacaaagtgcatcacgttgtgctcccagaagacgcggttgattatggatctgtaactttggaacatatagagagcaacatcgttagatgtgctgatccagagtacgcagagatgattatagacgcaatcgacagagttcgagttccaagggattcggacggtggaat

SEQ ID NO: 68970 - DNA, 453 bp, Zea mays
  unsure at all n locations
  Clone ID: LIB3078-012-Q1-K1-C8
cccacgcgtccgagtgaaatgtctaaggtgtacagaccatcccatgcagatgcaacctgtgacttcaagtatggagttagagctgtgcagggaggtggaaggtcatcagccagagaaaccattggcagggtggctgcaggagctcttgcaaagaaaattctaaagctcaaatcaggagtggagatcttggcatttgtttctaaagtgcaccaagtcgtacttccagaagatgcagttgattatgagactgtaaccttggaacatatagagagcaacatcgttagatgtcctgatccagaatatgcagagaagatgattgctgccattgatacggtacgagttagaggagattcaattggtggggtcgtcacatgcattgcangaaatgttcctcgtggtcttggctctcctgtttttgacaaacttgaagctgaactgggcaaagccatgctt

SEQ ID NO: 68971 - DNA, 350 bp, Zea mays
  Clone ID: LIB3078-012-Q1-K1-D3
caagaccgccgcattgctcgaggcctcggttgtgattggggcgatcatcggaggcggcgctgacgagcagatcgagagggtgtggaagtacgcgaggtcgatcgggctgctgttccaggtggtcgacgacatactcgatgtcaccaagtcgtcagaggagctcggcaagacagcggggaaggacctggcaagcgacaaaacgacgtaccctaagctgctggggctagaaaagtcgcgggagttcgcggaggagttgctctctgatgccgtatagcagcttgcttgcttcgacaaggagaaggcagcgcctctgttgcatctggccaactatatcgtccatatgcacaact

SEQ ID NO: 68972 - DNA, 433 bp, Zea mays
  Clone ID: LIB3078-002-Q1-K1-C4
gcgcaagccgtccggttccttctgcagaaggaactcgactaccttgtcggagctgtttcaagccctaaacgcgcttttgctgccatcgtgggtggttcaaaggtgtcatccaagatcggggttattgagtccctgttggagaagtgtgatatccttctcttgggtggtggtatgatcttcacgttttacaaggcacaaggtctccctgttggtgcttcattggtcgaggaagacaaactcgagcttgcaacgtctctacttgcaaaggctaaggaaaagggtgtctcccttatgctgccaaccgatgttgtcattgctgacaagtttgcccctgatgctaacagccagattgttccagcatctgcaattcctgatggttggatgggcctggatattggcccagattctgtcgcttcattcaacgcagccctgg

SEQ ID NO: 68973 - DNA, 441 bp, Zea mays
  unsure at all n locations
  Clone ID: LIB3078-050-Q1-K1-D12
tgacaagttcgccgtaggaaccgaggctgtggcaaagaagctggcagaactcagcggcgggggcgtcacaactatcatcggaggtggagactccgtcgccgccgtcgagaaggtgggagttgctgacgttatgagccacatttccacgggtggtggcgctagcctggaattgttggaaggaaaggagcttccgggagttgttgccttgaatgaagccgccactgtgactgtatgaagcatgctttcattttgtttcgtcttcgtcttcatgtgccgttgtatacttgctacattctcgcttgcacctncccagccgctcgctcgaaatgtaagagaccaatgttttatagagccaatggaaatcgtttgaacaacgacgacccatatagtatgtgctttaccgaagtgatctttcctcggtaacgtactagtgatataaaa

SEQ ID NO: 68974 - DNA, 420 bp, Zea mays
  unsure at all n locations
  Clone ID: LIB3078-027-Q1-K1-D12
cggacgcgtacggcgacacgaagttcgataccctgtcctacctggcgtcgctgccgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaagtgtacaaggagctgcaagaagccatcaaatcctacccggacgccttccaccgcgtcatcggcttcgacaacatcaagcagacgcagtgcgtcagcttcatcgnctacaagccccccggcagcgactagaccgngccccgccggccgcccccggcggctagctagctagctaagctctgcgtgagct

SEQ ID NO: 68975 - DNA, 416 bp, Zea mays
  unsure at all n locations
  Clone ID: LIB3078-028-Q1-K1-F4
ctcctgcagaagcctcggcaacgtcagcaacggcggaaggatccggtgcatgcaggtgtggccgggctacggcaacaagaagttcgagacgctgtcgtacctgccgccgctgtcgactgacgacctgctgaagcaggtggactacctgctgcgcaacggctggataccctgcctcgagttcagcaaggtcaggcttcgtgtaccgcgagaactccacctccccgtgctactacgacggccgttactggaccatgtggaagctgcccatgttcggctgcaacgacgccacccaggtgtacaaggagctgcaggaggccatcaaatcctacccggacgccttccaccgcgtnatcggcttcgacaacatcaagcagacgcagtgcgtcagcttcatcgnctacaagcccccgggcaga

SEQ ID NO: 68976 - DNA, 364 bp, Zea mays
  Clone ID: LIB3078-040-Q1-K1-E5
gctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaac

SEQ ID NO: 68977 - DNA, 368 bp, Zea mays
  Clone ID: LIB3078-052-Q1-K1-H4
cacctccccgtgctactacgacggccgctactggaccatgtggaagctgcccatgtgcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctatagctcctgcgtgagctagtagctagctagtgccatgcgtcgtctctgtcgttcggttttgctttcgggtcaccgtaccctttgcttgctgggttcttccttccctttttcctttttttttcttt

SEQ ID NO: 68978 - DNA, 359 bp, Zea mays
  unsure at all n locations
  Clone ID: LIB3078-001-Q1-K1-B1
gcgcccacgcgtccggggtctcaagtccgccgccagcgtccccgtggcccgccgcagcaccaggagcctgggcaacgtgagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctncccgtgctactacgacggccgctactggaccatgtggaagctgcccatgttcggctgcaccgacgccacgcaagtgtacaaggagc

SEQ ID NO: 68979 - DNA, 364 bp, Zea mays
  Clone ID: LIB3078-004-Q1-K1-B4
gccgtcgctccgttccaggggctcaagtccaccgtcagcctccccgtcgcccgtcgcgcctggagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgatactggaccatgtggaagctgcccatgttcggctgcaacgacgccacccaggtgtacaaggagctgc

SEQ ID NO: 68980 - DNA, 423 bp, Zea mays
  Clone ID: LIB3078-052-Q1-K1-F8
gagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctagctagctagctcctgcgtgagctagtagctagtgccatgcgtcgtctctgtcgttcggttttgcttccggtcaccgtgtaccctttgcttgcttgggttcttcttttcttttttccttttttttcttcttttccccggccat

SEQ ID NO: 68981 - DNA, 441 bp, Zea mays
  unsure at all n locations
  Clone ID: LIB3078-006-Q1-K1-C7
ggccaccgccgtcgctccgttccaggggctcaagtccaccgccagcctccccatcgcccgccgctcctgcagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctncccgtgctactacgacggccgctactggaccatgtggaagctgcccatgttcggctgcaacgacgccacccaggtgtacaaggagctgcangaggccatcaaatcctacccggacgccttccaccgcgtcatcggcttcgacaacatcaagcagacgca

SEQ ID NO: 68982 - DNA, 413 bp, Zea mays
  Clone ID: LIB3078-034-Q1-K1-B7
gcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatc

SEQ ID NO: 68983 - DNA, 437 bp, Zea mays
  Clone ID: LIB3078-053-Q1-K1-D9
cccacgcgtccgcggacgcgtgggtccaggggctcaagtccaccgccagcctccccatggcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaag

SEQ ID NO: 68984 - DNA, 438 bp, Zea mays
  Clone ID: LIB3078-018-Q1-K1-H8
gcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagct

SEQ ID NO: 68985 - DNA, 433 bp, Zea mays
  Clone ID: LIB3078-013-Q1-K1-H11
atccggtgcatgcaggtgtggccggcctacggcaacaagaagttcgagacgctgtcgtacctgccgcggctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctagctagctagctcctgcg

SEQ ID NO: 68986 - DNA, 420 bp, Zea mays
  Clone ID: LIB3078-033-Q1-K1-A2
ggcgtgcccacatccaagcgcaccttcgagcaggcgcagtcgctcggcatcccgctctggacgctcgacgacaacccgctcatcgacctcgccatcgacggtgccgacgaggttgaccctgacctcaaccttgtgaaagggcggggtggtgctcttcttcgtgagaagatggttgaggcagcatcggacaagtttattgttattgttgacgagacaaaactagttgatgggttaggaggtagtggtctagccatgccagtggaagttgtgcagttctgctggaagtacaaccttgtaagattgcaggaactgtttaaggaggaaggagtcgaggcaaagctaaggtttgaaggcgacaagccctatgttactgacaactcaaactacatcgtcgatttatacttcaagacgccaatcaag

SEQ ID NO: 68987 - DNA, 389 bp, Zea mays
  Clone ID: LIB3078-053-Q1-K1-F4
cttggtgatcaggtaaaagctgtggaggtggcatgatgcgactggattcatgttgatgtcatggatgggcgctttgtggcaaacatcacaattggacccttggttgttgatgctctgcgtccagtgactgatcttccgttggatgtacatctgatgattgtggaacctgagcagcgagtccctgattttatcaaggcaggtgctgatattgatagtgtccactgtgaacagacatcgaccattcatttgcaccgaacagtcaatcagattaaaagtctatgagcaaaggcaggagttgttgtgaatccagcgactgcactcactgcaattgattacgttcttgatgatgatgacctggtgctgattatgtctgtgaatcctgggtttgg

SEQ ID NO: 68988 - DNA, 426 bp, Zea mays
  Clone ID: LIB3078-011-Q1-K1-B10
cgcagaagcagtatgctgatgctgtgattgaagttctgccgacccagttgattcccgaggagcgacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaattttcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagactttccaggtagcaacaacgggacaggtctctttcagaccatcattggactgaag

SEQ ID NO: 68989 - DNA, 412 bp, Zea mays
  Clone ID: LIB3078-034-Q1-K1-E8
gtgtccccttcgattctgtctgcaaactttgcgaagcttggtgatcaggtaaaagctgtggaggtggcaggatgcgactggattcatgtcgatgtcatggacgggcgctttgtgccaaacatcacaattggacccttggttgttgatgctctgcgtccagtgactgatcttccgttggatgtacatctgatgattgtggaacctgagcagcgagtccccgattttatcaaggcaggtgctgatattgttagtgtccactgtgaacagacatcgaccatccatttgcaccgaacagtcaatcagattaaaagtctaggagcaaaggcaggagttgttttgaatccagcgactccactcactgcaattgattacgttcttgatgttgttgacctggtgctgattatgtctgtga

SEQ ID NO: 68990 - DNA, 389 bp, Zea mays
  unsure at all n locations
  Clone ID: LIB3078-002-Q1-K1-A2
gaccaagccgtccaatcaaggtggaggccatggatgggccctttgtgccaaacatcacaattggaccctggggtgttgatgctctgcgtccagtgactgatcttccgttggatgtacatctgatgattgtggaacctgagcagcgagtccctgattttatcaaggcaggtgctgatattgctagtgtccactgtgaacagacatcgaccttcatttgcaccgaacagtcaatcagattaaaagtctaggagcanaggcagggattgttntgaatccagcgactccactcactgcaattgattacgttcttgatgttgttgacctggtgctgattatgtctgtgaatcctgggtttgttggcagagctttatcgagagtcaagtaaggaa

SEQ ID NO: 68991 - DNA, 385 bp, Zea mays
  Clone ID: LIB3078-007-Q1-K1-G3
caaccggcaccaagcctgacatcattgggttgggcaccggctccgagctggagatcgcgggcaatgcggccgacgagctgaggaaggaggggaagacggtccgcgtcgtctcgttcgtctcctgggaactctttgatgagcagtcggatgagtacaaggagagcgtcctccctgccgacgtcacagcgaggatcagcatcgaggccgggtccactctcggctggcagaagtacgtcggagcccaaggcaaggccattggcatcgacaagttcggcgcgagtgctcctgccgggacgatctacaaggagtacggcatcaccgtggagagcatcattgcaactgccaagagcttttaagagctaacaacggtctgggagtttttttt

SEQ ID NO: 68992 - DNA, 371 bp, Zea mays
  Clone ID: LIB3078-014-Q1-K1-H3
cccacgcgtccggcggcgttccgcaaggccgccgccggcccgctgcagggcatcctggaggtctgcgacgtgccgctcgtgtccgtcgacttcaggtgctccgacgtgtcctgcaccatcgacgcgtcgctcagcatggtcatgggcgacgacatggtcaaggtcgtcgcctggtacgacaacgagtgggggtacagccaacgcgtggttgatctggcgcacctggtggcggccaagtggcccggcgcggcggcggccggcagcggcgaccctctggaggacttctgcaaggacaaccccgagaccgacgagtgcaaggtgtacgaagcatgaggccagggttctttccacgacgaaacgtacaacacggg

SEQ ID NO: 68993 - DNA, 416 bp, Zea mays
  Clone ID: LIB3078-002-Q1-K1-B8
gtcgcctggtacgacaacgagtgggggtacagccaacgcgtggttgatctggcgcggctggtggcggccaagtggcccggcgccgcggcggccggcagcggcgaccctctggaggacttctgcaaggacaaccccgagaccgacgagtgcaaggtgtacgaagcatgaggccagggttctttccacgacgaaacgtacagcacgggcgcgagggttctttccatagagaataatatacagattattcgcccaaagagacgtatgttatatatatgagttgtatgcagtcaccgaactggtacaggcttccgctttccatttcctgttgggagtcgtgtagtgtaatcctggggtgtgtatttggttcatcaatcatgccagccgatttgaatctcgtttcaccagcatgatctgat

SEQ ID NO: 68994 - DNA, 444 bp, Zea mays
  Clone ID: LIB3078-055-Q1-K1-H5
gcgccgcgcccgcgccgccgcgctcaacatcgtgcccacgtccaccggtgccgccaaggccgtctcgctggtgctccccaacctgaagggcaagctcaacgggatcgcgctccgggtgcccaccccgaacgtctccgtcatcgacctcgtcgtgcacgtctccaagaagaccctcgccaaggaggtgaaccaggcgttccacgacgccgtggccaacgagctcacgggcatcctcgaggtctgcgacgtgccgctcgtgtccgtcgacttcaagtgctccgacgtctgctacaccatcgacgcctccctcaccatggtcatgggcgacgacatggtcaaggtcatctcctgggacgacaactagtggggctactcgcagagggacgtcgacctcgctgacatctgcgccaaccagtggaagtgaagcgtcgcattgtaatactc

SEQ ID NO: 68995 - DNA, 343 bp, Zea mays
  Clone ID: LIB3078-024-Q1-K1-G1
ggcaatcctgatcagtgatgcaatggagactggaactgtgcagatcaactctgcaccgggtcgtgggcctgatcatttccccttccagggactgaaagacagtggcattgggtcccaggggataacaaacagcattaacatgatgaccaaggtgaagagcactgtcataaacctgccgtcaccatcctacaccatgggctgagatattcttgttaagtgttctatagctccatgagcaatgtagagagttaaatgtttcatagccacgtgagatttggacgctatttacacctcagttcttcctgcagaagatcttttgcaagttaaagaataaagtgcgttg

SEQ ID NO: 68996 - DNA, 113 bp, Zea mays
  unsure at all n locations
  Clone ID: LIB3078-029-Q1-K1-F12
tcgtccacgcgttcgnccacgcgttcggttcaccggcgccgccaaagccgtctcgctggtgctccccaacctcaagggcaagctcaaccggatcgcgctccgggtgcccaccc

SEQ ID NO: 68997 - DNA, 258 bp, Zea mays
  Clone ID: LIB3078-039-Q1-K1-A2
cgacgacgcactcgtacaccggctacctgaggctgctggacgcgtcccaccgcggccgcctgctgtcccgcgcgggggcgctgaacatcgtgccgacgagcacgggcgccgccaaggccgtggcgctggtgctgccgcatctgaaggtgaagctgaactgcatcgtgctgcgggtgccgaccgcgaacgtgtccgaggtggacctggtgatctacaccgtgaagactggcatgacggtcaaggacgtgaacgcggttt

SEQ ID NO: 68998 - DNA, 451 bp, Zea mays
  unsure at all n locations
  Clone ID: LIB3078-056-Q1-K1-D5
atgccaccaaaacattcgacgaagcattggacaccaccaagactgttatttggaacgggcccatgggagtgtttgagttccagaagtttgcagctggcaccgaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctncacacatggactttcgaggataggcttgccaccgtgttttgctagatgagtcg

SEQ ID NO: 68999 - DNA, 344 bp, Zea mays
  Clone ID: LIB3078-003-Q1-K1-G10
gcttgagaacgtaagattctacaaggaagaggagaagaatgacccagagtttgcacaggggcttgcctccctagcagatctttatgttaacgatgcatttggaacagcccacagggcgcatgcatcgaccgagggagttaccaagtttttgcagccttctgttgcagggttccttctgcagaaggaactcgactaccttgtcggagctgtttcaagccctaaacgcccttttgctgccatcgtgggtggttcaaaggtgtcatccaagatcggggttattgagtccctgttggagaagtgtgatatccttctcttgggtggtggtatgatcttcacgttttaca

SEQ ID NO: 69000 - DNA, 403 bp, Zea mays
  Clone ID: LIB3078-014-Q1-K1-F7
cggacgcgtgggcggacgcgtgggaaaggtgtcatccaagatcggggttattgagtccctgttggagaagtgtgatatccttctcttgggtggtggtatgatcttcacgttttacaaggcacaaggtctccctgttggtgcttcattggtcgaggaagacaaactcgagcttgcaacgtctctacttgcaaaggctaaggaaaagggtgtctcccttatgctgccaaccgatgttgtcattgctgacaagtttgcccctgatgctaacagccagattgttccagcatctgcaattcctgatggttggatgggcctggatattggcccagattctgtcgcttcattcaacgcaagcctggatacaaccaagacggtcatctggaacgggcccatgggtggcttc

SEQ ID NO: 69001 - DNA, 427 bp, Zea mays
  Clone ID: LIB3078-052-Q1-K1-F3
ggctaaggaaaagggtgtctcccttatgttgccaaccgatgttgtcatcgctgataaggttgctcctgatgctaacagccagattgttccagcatctgcaattcctgatggttggatggggctggatattggcccagattccattgctgcattcaacgcagccctggaaacaacccatactgtcatctggaacgggcccatgggtgtttttgaatatgacaagttcgctataggaactgaagctgtggcaaagaagttggcagaacttagccgcatgggtgtgacaactatcatcggaggtggagactctagtcccggctttgagaatgtctgagttgctgacgttatgagccacatttccaccggatgtggttccagcttggaaatgttggaaggtaaggagctttcaggagttactgcattggat

SEQ ID NO: 69002 - DNA, 368 bp, Zea mays
  Clone ID: LIB3078-049-Q1-K1-G10
catcagtttgcttgcctatcacaattgatgttggtacaaataacgagaaactgcttaatgatgagttctacattggactccggcaaaaacgtgcgactggcgaggagtatgatgagcttattgaagagttcatgtctgctgttaagcaattctatggtgagaaagtcctcattcagtttgaggactttgccaatcataatgcctttgatttgcttgaaaaatatagcaagagccatcttgttttcaatgatgatatccagggcacagcatcagtggtccttgcaggtttgttagcagcactcaagatggttggtgggaccctggcagagcagacttatttgttccttggtgcttgggaggctggaact

SEQ ID NO: 69003 - DNA, 446 bp, Zea mays
  Clone ID: LIB3078-012-Q1-K1-E8
gcagacttatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctctcttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgcttaacaagcatatacatggagtcaaggccgttcaatctttgtcagtggcagtccatttgcccccgtggagt

SEQ ID NO: 69004 - DNA, 458 bp, Zea mays
  Clone ID: LIB3078-033-Q1-K1-A12
cccacgcgtccggttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccaattttgaagctgctatagcaatgaccaaccagggtgttcaagtgttcccagagataatggttcctcttgttggaacaccac

SEQ ID NO: 69005 - DNA, 127 bp, Zea mays
  Clone ID: LIB3078-007-Q1-K1-A1
gtgacatctggagttggaagaacattcacaaaagaaatcattgaggccatgtcttcctgtgacgagaggcctatcatcttttcactgtcaaacccaacctcgcattctgaatgcactgcttaacaag

SEQ ID NO: 69006 - DNA, 345 bp, Zea mays
  Clone ID: LIB3078-050-Q1-K1-G11
tcggcatcagaaagatctctgcgcacatcgctgcagccgtggctgcaaaagcctactagctcgggctgccgacccgtctgcctgccccaacgaccctgtgaaatatgccgaaaactggatgtacacttccgtctaccgaaactaccggtaatgctggcgggaatcaattttgccagtattaaaaaatctatcaacgcgggatggtactctgttgtttatagtccctgctgctaaccacccttgttgctggtgctgctggagaggcattgtacctgtccatgcatatatgatatatatatgttgtaacgttgtgaaagcaaacaatcttgggtaccaatgtttgtt

SEQ ID NO: 69007 - DNA, 426 bp, Zea mays
  Clone ID: LIB3078-022-Q1-K1-D10
cagacttatttgttccttggtgctggggatgctggaactggtattgcagaacttattgcgcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctggtcactccatcaaacctacagttctgatcggtacatctggagttggaagaacattcacaaaagaaatcattgaggccatgtcttccttcaacgagaggcctatcatcttttcactgtcaaacccaacctcgcattctgaatgcactgctgaacaagcatatacctggagtcagggccgttcaatctttgccagtggcagt

SEQ ID NO: 69008 - DNA, 371 bp, Zea mays
  Clone ID: LIB3078-040-Q1-K1-H1
ccattctttgatgttgcatatcaaggttttgccagtggaagccttgatgaagatgcattttctgtcaggctttttgttaagcgtggcatggaagtgtttgttgcacaatcttacagcaagaaccttggtctatattctgaaagggttggtgcgataaatgtcgtgtgctcagcaccagaagttgcagatagggtaaagagccagctgaaacgattggcacgtcccatgtactcgaacccccctattcacggtgccaagatagttgccaacgttgttggtgatccaatcatgtttggtgaatggaaacaagagatggagctaatggctggacggatcaagaatgtaagacagaagctctacgacagtttgtc

SEQ ID NO: 69009 - DNA, 447 bp, Zea mays
  Clone ID: LIB3078-033-Q1-K1-F11
caaaattgatggaagaccagtgaaagaagtcattaaggataccaagtggttagaggaagagttcaccctcacagttcaaaagcgtggaggtgtgctcatccaaaaatggggcagatcatcagctgcatcgaccgctgtttcgatagtggatgctattagatccctcgtaactcctaccccagaaggtgactggttttctacaggggtttatacgactggaaatccttatggcatatcagaggatatcgtgttcagcatgccatgcagatcgaagggtgatggtgattacgaactggctagtgatgtgttgatggacgattttctctgggaaccgattaaaaagagcgaagctgaattgcttgctgagaagaaatgcgttgcccatcttacaggagaggggaatgcattttgtgatcttccggaagataccatgctaccaggagaagt

SEQ ID NO: 69010 - DNA, 431 bp, Zea mays
  Clone ID: LIB3078-023-Q1-K1-H1
cccacgcgtccggttctagatcgcgagcgccgcccttttttttttttttttttttttttgggtttgttttttttttttttttttttaaacaagtccatccaatgggctgggatattaattaattattacaaaacagcatgcaaattgtaccatgcttattattacaatatgtataatatgccaagattttccacttggacttgacaaccagagtgaattttaagaggccggaaattacatttgcatagggaaaacagacgcttccagttcggcatttccatccaaaactgacaaaacgccaccattcggaagctgattattgcggggcactctgcaggtgagtgaaaagaagcccgctatccagggttctgcatgccggccgggatgcccttcatggtgaggatgaacctgtcttccaagccgggcgggta

SEQ ID NO: 69011 - DNA, 391 bp, Zea mays
  unsure at all n locations
  Clone ID: LIB3078-056-Q1-K1-B2
ctccgtcgtcgtcaaggaggcgcgcttcgtcgagtacttcagatcggctacaccggagaccgagtacgggaggatgaacatcggcagccggccagccaagaggaggcccggcggcggcatcacgaccctgcgcgccatcccctggatcttctcgtggacccagaccaggttccacctncccgtgtggctgggagtcggcgccgcattcaagttcgccatcgacaaggacgtcaggaacttccaagtcctcaaagagatgtacaacgagtggccattcttcagggtcaccctggacctgctggagatggttttcgccaagggagaccccggcattgccggcttgtatgacgagctgcttgtggcggaaagaactcaagccctttggggaagc

SEQ ID NO: 69012 - DNA, 426 bp, Zea mays
  Clone ID: LIB3078-016-Q1-K1-C2
acgggaggatgaacatcggcagccggccagccaagaggaggcccggcggcggcatcacggccctgcgcgccatcccctggatcttctcgtggacccagaccaggttccacctccccgtgtggctgggagtcggcgccgcattcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctccttcagatcgctgggcacaaggatattcttgaaggccgaccatttctgaagcaggggctggtgc

SEQ ID NO: 69013 - DNA, 427 bp, Zea mays
  Clone ID: LIB3078-014-Q1-K1-G9
cgagtggccattcttcagggtcaccctggacctgttggagatggttttcgcgaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatg

SEQ ID NO: 69014 - DNA, 418 bp, Zea mays
  unsure at all n locations
  Clone ID: LIB3078-015-Q1-K1-F11
cccacgcgtccgtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagtccaagtggaaaatcttggcatattatacatattgtaataataagcatcgtacaatctgcatgctgntttgtaataattaattaatatccc

SEQ ID NO: 69015 - DNA, 271 bp, Zea mays
  Clone ID: LIB3078-051-Q1-K1-F1
cccacgcgtccggcgccgccttcaagttcgccatcgacaaggacgtcaggaacttccaggtcgtaaaaaaaatgtccaacgagtggccattcttaagggtaaccttgaacctgctgaaaatggttttcgccaagggaaaccccggctttgccggtttgattaacaagctgcttgtggcggaggaactcaagccttttggaaagcagttcagggacaattacttgaagacacagcagcttttcctccaaatcgttgggcacaaggatattct

SEQ ID NO: 69016 - DNA, 349 bp, Zea mays
  Clone ID: LIB3078-055-Q1-K1-D12
gccccggcagctacgggttcagcaccaacctcagggcctgctgcggcgccggcggcggcgagtacaactaccagaacggcgcgcggtgcggcatgcccggcgcgtacgcgtgctctgacccggggttcgtcgctcaactgtgacggcatccacctgacggaggcggcgtataggaagatcgccgactggtgggtcaacgggggctacttgcaaccggtcattttgggctaaaagcttgttcgggaaccggggttcggggcttggttgggggtccgttggcccttaaggttagggaaggggatcggattaattgtaatttttttagctggaatctaagcaggcgagaaga

SEQ ID NO: 69017 - DNA, 440 bp, Zea mays
  Clone ID: LIB3078-053-Q1-K1-C9
cgccgctccgcgctccgccctcctccctcggcgcagcgtctgccagcttcgcttccaaggggcaccgaggctctccctgctccgtgcgaaggccgcttccgaggacacatcggcctccggcgacgagttgatcgaggacctcaaagcgaagtgggacgccgttgaggacaagcccaccgtcctcttgtacggcggcggcgccgtcgtcgccctatggctgacgtccgtggtcgtgggcgccatcaacgccgtgccgctgctccccaagatcctggagctcgttgggctcggctacaccggctggttcgtgtaccgctaccttctctttaaggaaagcaggaaagagttggccgccgacattgagaccttgaagaaaaaaatagctggaacagaataaacgctcatggaaagttttagagcgtcctttcttctttggaaag

SEQ ID NO: 69018 - DNA, 356 bp, Zea mays
  Clone ID: LIB3078-051-Q1-K1-B3
ggacctcaaagcgaagtgggacgccgttgaggacaagcccaccgtcctcttgtacggcggcggcgccgtcgtcgccctctggctgacgtccgtggtcgtgggcgccatcaacgccgtgccgctgctccccaagatcctggagctcgttgggctcggctacaccggctggttcgtgtaccgctaccttctcttcaaggaaagcaggaaagagttggccgccgacattgagaccttgaagaaaaaaatagctggaacagaataaacgctcatggaaagttttagagcgtcctttcttctttggaaagagatctattcgatcggagaaccaatgcaactacttgagtactattattgcc

SEQ ID NO: 69019 - DNA, 340 bp, Zea mays
  Clone ID: LIB3078-001-Q1-K1-F3
gcggagcagaccttcatcatgatcaagcccggcggcgtccagcggggcctgatcggggacatcagcagtcgcttcgagaggagggggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaagaatgtca

SEQ ID NO: 69020 - DNA, 377 bp, Zea mays
  Clone ID: LIB3078-023-Q1-K1-C3
gggagttgccaggagcatgccaacatctgctgcccttgatgttgttgcaaagaatttgagccttgagttctttgaggtgcctactggatggaagctttttgggaattggatggatgctggaatgtgctcaatctgtggtgaagaaagctttggcactgtggctgaccacattcgtgagaaggatggcatttgggctgagcttgcatggctatcaattattgctttcaagagtttggacagccttgtaggagataagcttgtcactgatgaagatatgtgtcgctagcactggtccacatatggtcgctatttctacactcgctatgactatgagaatttttatgcacgggctgctaatgagcttattgcttacctag

SEQ ID NO: 69021 - DNA, 414 bp, Zea mays
  Clone ID: LIB3078-022-Q1-K1-C1
gggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacac

SEQ ID NO: 69022 - DNA, 407 bp, Zea mays
  Clone ID: LIB3078-002-Q1-K1-F5
agcttttggagattgcccaagtacccgatgagcatgtatgttgctgtttctgtgtggcttaagtttcataatctgttccatgatttcaccaccagccttttgtagtaagagctacacaaccttttctaattttcttgtatctctatccaggtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaagtttctcccagtgaaggctacatctgatct

SEQ ID NO: 69023 - DNA, 394 bp, Zea mays
  Clone ID: LIB3078-011-Q1-K1-E7
gcgcccacgcgtccgatacccctgatgatgctttgactgcgcgaaacaatggggcacaaggagtcggattatgccggacagagcacatgttctttgcttcagacgagaggattaaggctgtcacgcagatgattatggctgccacgcttgagctgacgcagcaagcgctcgaccgtgtcttgccgcatcataggtctgacttcgaacgcattttccgtgctacagatggactcccggtgaccatgcgactgctggaccctgcgctgcaccagttccttccagaagggaacatcgcggacattgcacgtgaatcatgtgctgagacggcagccaaccaggacgatgccctcgcgcgaattgaacagctctcagaagcaaacccgacgcttggctt

SEQ ID NO: 69024 - DNA, 354 bp, Zea mays
  Clone ID: LIB3078-011-Q1-K1-D6
cccacgcgtccgcccacgcgtccgggtttttgtggagaacacggtggagagccttcgtgtgtggccttcttcgcgaaggctgggctggattacgtttcttgctcccctttcagggttccgattgctaggctagctgcagctcaggtgcttgtctgaggctgcctcctcgttggcaaccggattgcctgctgctggtggatgtggtgatcaacagtattattacagagccatgctatgtgaacattactagtagcagtgctcataaaagctacaatcccatctcccttttttttccagtcatgtaaaacttccaaactgctccatggttcaaaactctgttcttcaatacaaaaa

SEQ ID NO: 69025 - DNA, 303 bp, Zea mays
  unsure at all n locations
  Clone ID: LIB3078-007-Q1-K1-E1
aaaagctttcagaagtaaacccgatgcttgtcttccgtgggtgcaggcttggtatatcgtgccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgatngagatccccagggcaagctctgtggctgatg

SEQ ID NO: 69026 - DNA, 409 bp, Zea mays
  Clone ID: LIB3078-028-Q1-K1-A6
cccacgcgttcgcggacgcgtgggtgacgatcggaggccatgtgctgcgcgaaggtgagtggctgtcgctgaatgggtcgactggtgaggtgatccttgggaagcatccgctttccccaccagcccttattggcgatctgggaactttcatggcctgtgtggatgatgttagaaagctcaaggtcctggctaacgccgatacccctgatgatgcattgactgcgcgaaacaatggtgcacaaggaattggattatgccggacagagcacatgttctttgcttcagacgagagtgataacgctgtcaggcagatgattatggctcccacgctagagctgaggcagcaggcgctcgaccgtctcttgccgtatcagaggtctgacttcgaggcatgttccgtgctatggat

SEQ ID NO: 69027 - DNA, 406 bp, Zea mays
  Clone ID: LIB3078-055-Q1-K1-E2
gggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttctgcaatgtgggcaagactatcgggtacaaagttggaacaatgattgagatccccagggcaactcttgtggctgatgaaatagcggagcaggctgaattcttct

SEQ ID NO: 69028 - DNA, 428 bp, Zea mays
  Clone ID: LIB3078-051-Q1-K1-G2
cccacgcgtccgagatgattatggctcccacgcttgagctgaggcagcaggcgctcgagcgtgtcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatgggttctctgtgggacaccacagaactgggc

SEQ ID NO: 69029 - DNA, 426 bp, Zea mays
  Clone ID: LIB3078-002-Q1-K1-E2
agccttcggttgggtttatcgtaccctgaatggacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtg

SEQ ID NO: 69030 - DNA, 438 bp, Zea mays
  unsure at all n locations
  Clone ID: LIB3078-013-Q1-K1-H10
cccacgcgtccgcggacgcgtgggtgatgagatagcggagcaggctgaattcttctcctgcggaacggacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaggtgcttgtctgaggctgcctnctcgttggcaaccggattgcctgctgctggtggatgtggtgatcaac

SEQ ID NO: 69031 - DNA, 376 bp, Zea mays
  Clone ID: LIB3078-051-Q1-K1-G3
acgactcgttcgacatgatcatggactgctgcactcgatctgaggcagcacgcgctcgggcctgtcttgacgtatcagagggcggacttctaaagcatcttccacactctgtatgcactcccggataccatgcgactcctggaccctactctccaccagttccttccacaagggaacatcgactacattgtaactgaatgatctgctgagaccgtagccaaccatgaggataccctcgcgcgaatcgacaaactttcaaaagtaaacccaacgcttggcatccgagactgcaggctcggtatatcgtgccctgcatcgacaaagacgcaaactccctccatctttgaagctgctatcgcaatgaccaaccaaagtg

SEQ ID NO: 69032 - DNA, 312 bp, Zea mays
  Clone ID: LIB3078-011-Q1-K1-B7
gtgatgatgcattgactgcgccaaattatgaggcacaaggaattggattatgccgtgcagagcacatgttctttgctggagacgatacgattaaggctgtcaggcaaatgattatggctcccacgtttgagctgaagcatcatgcgctcgaccgtctcttgccgtatcagaagtctgacttcgaaggcattttcactgctatggatggactacctgttaccatccgactcctggaccctctcctctacgagttcctttcagaagggaacatcgtagacattgtcagtgaattctgtgctgagactgtagcca

SEQ ID NO: 69033 - DNA, 437 bp, Zea mays
  Clone ID: LIB3078-052-Q1-K1-H5
gtgaattatgtgctgagacgggagccaaccaggaggatgccctcgcgcgaattgaaaggctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgat

SEQ ID NO: 69034 - DNA, 394 bp, Zea mays
  Clone ID: LIB3078-050-Q1-K1-C8
cgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctac

SEQ ID NO: 69035 - DNA, 253 bp, Zea mays
  Clone ID: LIB3078-052-Q1-K1-G4
cgactcaaaggtgaaaacgcaacactgttccagcaactttcagatgccaaccaacaggtcagtactgcagtcacagacaacagaatcctcaaatccgatgtagaagcgttaagaattaaagtaaatatggcagaggatatggtaccgagaagtgctgtatcgtgtggcctaggcgaccttggcctggcaccatacgtgaactcaaggaaaatgtgccaagctttgaatgtgctcacagggttggattaactag

SEQ ID NO: 69036 - DNA, 426 bp, Zea mays
  Clone ID: LIB3078-034-Q1-K1-C10
gcatcatctttattgatgaaattgatgccattggaacaaagcgttttgacagtgaagggagtggcgatagagaagtgcaaaggacaatgttggaattgctgaatcagcttgatggatttagcagcgatgagaggataaaggtgatagctgcaacaaatcgtgctgatattcttgatcctgctctgatgagatctggtcgtctggaccgtaagattgagttccctcatccatcagaggaagcaagagctagaatcctgcagatccactcgaggaaaatgaatgtgaatccagatgtcaactttgaagagttggcgcgttcaaccgatgatttcaatggcgctcagctaaaggctgtttgcgtagaggctggcatgctcgctctacgccgagatgctacagaggttacccacgaggatttcaacgagg

SEQ ID NO: 69037 - DNA, 418 bp, Zea mays
  Clone ID: LIB3078-034-Q1-K1-G8
ggtaactcaagaactgttcttatgcatgcagcagccataagcattgctactagcgtcgcctgcacgtgctgtgtcgtttccagggtttcatgcggggcgaagcagctggtctctgccgcctgaacgccgccggaatctgcgaggcctccccgagctgcgtgcgtcgtcggataaggcagccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccgccgtgccggctccaggaactgagatggcgcagctagtgtgcggaggatgccacacccttctcatgtacata

SEQ ID NO: 69038 - DNA, 353 bp, Zea mays
  Clone ID: LIB3078-007-Q1-K1-E5
acgcactctcctccgccgccgcccgaggcaagatggttctccagaacgacatcgaccttgtgaacccgccggcagagctcgagaaactcaagcacaagaagaagcgcctcgtccaatcccccaactccttcttcatggatgtcaagtgccagggatgcttcagcataaccacggttttcagccactcccagactgttgttgtgtgcccaggctgccaaactgttctctgccagcccacgggaggaaaggcgaggctcacggagggatgctctttccgccggaagggagactagagtggagtctgttattagtactggatcggttgtcaatctccagtatgtggattcaaattt

SEQ ID NO: 69039 - DNA, 442 bp, Zea mays
  Clone ID: LIB3078-039-Q1-K1-D5
ctgctgcagcgcctccgccgccgccgccgcatctaacgcagttccctccgccgcagggcgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaagaattttcataaatggttctcgagcagctatgtgttgcatgttggctac

SEQ ID NO: 69040 - DNA, 469 bp, Zea mays
  Clone ID: LIB3078-024-Q1-K1-C5
caaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtg

SEQ ID NO: 69041 - DNA, 436 bp, Zea mays
  unsure at all n locations
  Clone ID: LIB3078-057-Q1-K1-D9
gccaggcggacccgagccactggagcaagatctcccagggcgggctccagcgtagcgaggagaagtacacctggaagctctactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttttttcccttcccggaggcgaaaaaaagagtctgcttttgctaggcggcgggcgttcgttgctgctctttgcttcaagagttaaatntacctacctt

SEQ ID NO: 69042 - DNA, 433 bp, Zea mays
  Clone ID: LIB3078-039-Q1-K1-A8
gaagatgtttgacctcatcgagcagtacaacctgaacgggcacatccgctggatctgggcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctgtaagctctactcggagaggctgatgaccctaacggcgtgtacgggttct

SEQ ID NO: 69043 - DNA, 360 bp, Zea mays
  Clone ID: LIB3078-040-Q1-K1-F8
cccacgcgtccgctgtaccgctacatctgcgaacaccaagggcgccttcgtgcagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtaccggttctg

SEQ ID NO: 69044 - DNA, 404 bp, Zea mays
  unsure at all n locations
  Clone ID: LIB3078-001-Q1-K1-C7
acgcccacgcgtccgcccacgcgtccgtcgaggagtacaagttgaagggccatatccgggggatgtctnctcagatgagccgcgtccgcaacggggagctgtaccgctacatttgcgatacgaagggcgcattcgtgcagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaagggagatccgagctactgggacaagatctcacagggcggcctgcagagaatctatgagaagtacacctggaagctctac

SEQ ID NO: 69045 - DNA, 424 bp, Zea mays
  Clone ID: LIB3078-012-Q1-K1-F7
ctggaagctctactcggagaggctgatgaccctcaccggcgtgtacgggttctggaagggcgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttatttcccttcccggaggcgaaaaaaagagtctgcttttgctacgcggcggtcgttcgttgctgctctttgcttcaagagttaaatttacctaccttgtcaaggtcttgatccatcattgatcccagtgacgctatgttaggagtctgatggact

SEQ ID NO: 69046 - DNA, 421 bp, Zea mays
  Clone ID: LIB3078-016-Q1-K1-D7
cccacgcgtccgctggaagctctactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttttttcccttcccggaggcgaaaaaaagagtctgcttttgctaggcggcgggcgttcgttgctgctctttgcttcaagagttaaatttacctaccttgtcaaggtcttgttccatcattgatccgggtgtcgctttttta

SEQ ID NO: 69047 - DNA, 353 bp, Zea mays
  unsure at all n locations
  Clone ID: LIB3078-001-Q1-K1-E8
ctgacgcatgggcacgtttgccggatcgtactgcgggccggccgagatcatcgtgcgcngggtgtctagcggcggcatggacccttaccagggctacaaggcgtcggccctgctcgtggacttcttcgacaagtgccaggcggacccgagccactggagcaagatctcccatggcgggctccagcgtatcgaggagaagtacacctggaagctctactcggagaggctgatgaccctcaccggcgtgtacgggttctggaagtacgtgtccaacctggagaggcgcgagacccgacggtacctggagatgctgtacgcgctcaagtaccgcaccatggcgagcaccgtgccgc

SEQ ID NO: 69048 - DNA, 436 bp, Zea mays
  Clone ID: LIB3078-007-Q1-K1-E9
ctgaaaactcgaaggctggttgtcaaagtgtgcgacatcgtcacccggagagctgcccggctagccgccgctggtattgtcgggatactgaaaaagctcggccgtgatgggagcggtgttgcttcaagcgggagaacgggagggcagatgaggcggacggtggttgccatcgagggtgggctgtacgagggctacccggtgttcagggagtacctagacgaagccctggtggagatcttgggggaggaggtggcgcggacggtggcgctgagggtgacagtggatgggtctggggccggcgctgccctccttgccgccgtacattcgtcgaatagacagcaaggttccatatagggagaagggaagatggtgatacagccccctctgtgcaaatgtaaaaaggaacattatttgatatctatattcatatatatat

SEQ ID NO: 69049 - DNA, 378 bp, Zea mays
  Clone ID: LIB3078-004-Q1-K1-H6
ctggatttgaactccgcgtgcacccaaatgaagatccctagctagcacttgtcctggggtcgactatgcaaacaaaaccagcaacgccagaggctattgcaaaaaaggctgcctaagatacatctaataccgaaagcatcaatgcctaaagctcaaacagcgatactgttatcgctgaatcataacttgcctgaaatgctgctgctgttgacaagcaagaacagtcatacgatgatgactatgtactacagcaggcactagcaatgtcaatggacggcggtgctgtatgatctgcaactgcgactgactccgctatggcacaagctggtgcatctgaccctgacttagcgttggctcttcaaatgtctgtccaggatg

SEQ ID NO: 69050 - DNA, 353 bp, Zea mays
  Clone ID: LIB3078-004-Q1-K1-C5
gccttcctgtatgatatcttctgggtgtttatctccaagagatggtttcatgagagcgtgatgattgtggttgcgcgtggcgacaagaccgacgaggatggtgtgcccatgctgctaaaaatcccgcgaatgtttgatccatggggtggatacagcatcattggctttggtgatatccttcttcctggtcttttagttgctttctcgctaagatacgatttttctgcaaagaagggcttacggtctggttactttttgtgggcaatggtggcctatggctctggacttctaatcacatatgttgcgctgaacctgatggatgggcatggacaacctgcccttttgtacatcgt

SEQ ID NO: 69051 - DNA, 391 bp, Zea mays
  Clone ID: LIB3078-012-Q1-K1-H4
cccacgcgtccgcccacgcgtccggcaagatattcttggtattaccttgatcgttacaggcatccaaattgttagaatacctaaccttaaggtgggttcagccttcctgggttgtgccttcttatatgacatcttctgggtttttatctccaagatgttgttccatgaaagtgtgatgattgtggttgcacgtggtgacaagactgatgaggatggtgtacccatgctgttaaagattcctcggatgtttgatccatggggtggatacagcatcataggctttggtgatatccttcttcctgggctgttggttgcttttgcattaaggtatgattgggctgccaagaagaccttgcaatctggctactttttgtggtcaatggtggcatat

SEQ ID NO: 69052 - DNA, 431 bp, Zea mays
  unsure at all n locations
  Clone ID: LIB3078-027-Q1-K1-D7
gatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctagagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgccttaaggctgcttacgacgcactcgccgtcgaccaccagggcctnctggccgacaacgataaccttcgggcacaggtgatctccctgacggagaagctgcaaagcaaggaggacatcccgtcagcaacca

SEQ ID NO: 69053 - DNA, 382 bp, Zea mays
  unsure at all n locations
  Clone ID: LIB3078-024-Q1-K1-D11
cccacgcgtccgcccacgcgtacggcagcatgtacgtgttcatgcaatggaagcagtgaggggttgctgggagcttgaacaatctttacaaagcctaacaggggcatctcctggtgaaggcactggagcgaccatgtctgatgatgaagacaaccaggtggatagcgaagccaacatgtttgatggaaatgatggatcagatggtatgggctttggccccttaatgctgacagagggtgaacgatccttagttgagcgtgtacggcacgagctaaagaacgagcttaagcagggttacaaagaaaaagcttgtgatatcaaggaagagattatgcgcaagcgcagagctgcgaaacttnctggagatactgcatctgtgctg

SEQ ID NO: 69054 - DNA, 340 bp, Zea mays
  Clone ID: LIB3078-029-Q1-K1-B7
ggaagattgaattccctctcccagatattaaaactagaagacgcatcttccagattcacgacatcaaaaatgacattagctgacgatgtgaacttggaagagtttgttatgaccaaagatgagttctcgggcgctgatattaaagccatctgcacggaggctggattgctcgccttaagagaacgtagaatgaaagtgacccatgcagatttcaagaaagcaaaggagaaggtgatgtacaagaagaaggaaggtgttccggatggtctctacatgtagtagacgtctcctgccttgtcagaacaagttatcctcgtctctctcgtcatgggagatttga

SEQ ID NO: 69055 - DNA, 386 bp, Zea mays
  Clone ID: LIB3078-033-Q1-K1-C11
cccacgcgtccgcccacgcgtccgccgcggcgacggtgacgacgaccgcgcgagcgccggcgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaaggttactgtcaagggtcacctgcacacctacaggttctgtgacaatgtgtggaccttcatcttgacagacgcaagcttcaagaacga

SEQ ID NO: 69056 - DNA, 410 bp, Zea mays
  Clone ID: LIB3078-018-Q1-K1-H2
ggaaaaccaagagaaaattaagctcaacaagcagctgccctacctcgttggcaacatcggtgagatcttggaaatgaaccctgaggatgaagctgaggaggatggtgctaacattgatttagactcacaaaggaaaggaaaatgtgttgttctgaagacctccacaagacaaactatattccttcctgttgttgggctagtggaccctgacaagctaaagcctggtgatctggttggagtcaataaagatagctaccttatactagatacattgccatcagagtacgattcacgagtgaaggcaatggaagtggatgaaaagcccacttgagaatattatgacattgggggtcttgaaaagcagattcaagagcttgtagaggcaattgtactggccatgacacataaag

SEQ ID NO: 69057 - DNA, 410 bp, Zea mays
  Clone ID: LIB3078-050-Q1-K1-B6
agaggatgaagatttcgttgcagacaaggatgatagtggatctcctactgatgactcaggtgatgaggaatcagatgctagtgatagtggtggtgaaaaggagaaatcatccaagaaggaagcaagcagttcaaagccagttcagaaaagaaagcataagggcagggatgacgaaggacaagagaagaaaaaaccaaagaagaaaaaagatccgaatgctccgaaacgagccatgaccccgttcatgtatttctcaatggctgagcgaggaaacatgaagagcagcaacccagatttgcctacgactgagatcgcaaagaagcttggggagatgtggcaaaagatgtcaggcgaagagaaacagccttacatccagcaggcccaggtcgacaagaaacgttatgaaaaag

SEQ ID NO: 69058 - DNA, 438 bp, Zea mays
  Clone ID: LIB3078-054-Q1-K1-A12
gttccatggagcgaggaggagcacaggcagttcctttccggcctggagaagctgggcaggggcgactggcgaggcatctccaggagctacgtgccgacgaggaccccgacgcaggtcgccagccatgcacagaagttcttcctcaggcagagcagcttggggaagaagaagcgccgctccagcctctttgacatggtgccgatttgcgagaacagtgcgagcatctccgatccgctgagcagcgaaggggcctcaacctctctgtcgctgaacgtgccacgccacggcgtcacctccgtctccgagagggcggccttggacctgaattcgacggaggaagacgacagcagggcggacgcgtcgtcggcatcggcatcaggtgcagggaccagaccaccgttcccggcagcgcagacggagccgctgcagccttcgtcg

SEQ ID NO: 69059 - DNA, 449 bp, Zea mays
  Clone ID: LIB3078-052-Q1-K1-A9
gggatgatgaagagcgggtacgagggggtcagggagatcgagaagcggctcaccaacacgcgtcgggtggagcgccacgtctgggcaggtcgacaactgggtctacgaggaggccaactccacgttcatcgaggacgaggcgatgaggaagaggctcatggacaccaaccccaattcgttcaggaagttggtgcagaccttcctggaagccagtggcagaggctactgggagacaacggaggagaacctggacaggctcagggagctctattcggaggttgaagacaagattgaggggattgacaggtaaattgatttgccagatcggtcggccgatcggttccagcattcaacccataacgagcttggaactcttctgcctcattgggactcttgtacaatgtctgggtgtgtgatttatatatatataaaagtgtaacatgtaatac

SEQ ID NO: 69060 - DNA, 426 bp, Zea mays
  Clone ID: LIB3078-054-Q1-K1-A2
cccacgcgttcgcccacgcgttcgcggtgacaagggtgttctcgaacgcatcaggctggtactcgtccaacgtgaacctggccgtggagaacgcgtcatggaccgacgagaagcagctccaggacatgtacctgagccgcaagtccttcgcgttcgacagcgacgccccaggggcaggcatgaaggagaagcgcaaggcgttcgagctcgccctggcgacggcggacgccacgttccagaacctcgactcgtcggagatctcgctgacggacgtgagccactacttcgactcggacccgaccaagctcgtgcaggggctgcgcaaggacgggcgggcgccgtcctcgtacatagccgacaccaccacggcgaacgcccaggtgaggacgctgtcggagacggtgcgcctcgacgcgaggaccaagc

SEQ ID NO: 69061 - DNA, 460 bp, Zea mays
  Clone ID: LIB3078-023-Q1-K1-F12
cccacgcgtgcgcccactcgtccggtggtattcccgcttgcgagcttagggagcacctggtcatcttgcgaagcagtgatgccacacgccatctgtttgaggtgtcagctggccttgactctttggttctcggtgaaggacaaatccttgctcaggttaaacaagttgtgaggagtggacagaacagtggaggcttgggaaagaacattgataggatgttcaaggatgcaatcactgctggaaagcgtgtccgctgcgagaccaacatatcatctggtgctgtttctgtcagttcagcggcggttgaactggccctgatgaagcttccgaagtctgaagcactgtcagctaggatgcttctgattggtgctggtaaaatgggaaagctagtgatcaaacatctggttgccaaaggatgcatgaaggttgttgtggtgaaccgctccgtggaaagggtgga

SEQ ID NO: 69062 - DNA, 475 bp, Zea mays
  Clone ID: LIB3078-027-Q1-K1-C2
caagaaatgcttctcaactttgctacagaatgtgcggactctgtacttcctgcgtacataccgatcatagaacggaggaagaacactccgttcaacgaggagcacagggcatggcagcaattgcggagaggtcgttatgtggagttcaaccttgtctacgaccgtggtacaacatttggcctaaagactggaggaaggattgagagcatacttgtgtcccttccacttacagcacgatggcagtatgatcataaaccggaagaaggaaccgaggaatggaaacttctggaagcctgcataaacccgaaggattggatctgattagccgttattcttgagatcttttgttagaagtttcccttctgtagggctaagaccacgtgcagtttcattatatattttgcatctgtagaatcgtgaataaatatgatgtagtgatgttgtagctgtttggatctatctgctggtttttccc

SEQ ID NO: 69063 - DNA, 338 bp, Zea mays
  Clone ID: LIB3078-049-Q1-K1-D11
ctctatgaaagatgttccaacatatctacctgaaggcacaatattgccctgtgagctccgacgagaagatgtaagagatgcattcatatgcttgactgcaaattcgctcgcggagcttcctgctggcagtgttgttggaagtgcttccttgcggagacaatctcagattctctacagatatccatcactgaaagtagttaacttcagaggaaatgttcagacacggttaaagaaactcaaggaaagagatgtgtctgctacattgttggcgctggctggattaaagcggctaaaaatggcagaaaatgcaacagctgtactatcagtggaagaaatgc

SEQ ID NO: 69064 - DNA, 422 bp, Zea mays
  Clone ID: LIB3078-007-Q1-K1-F2
ccaaggtctcactcatccggattgggacgcgtgggagtcctctggctcttgcacaagccgatgaaactcgggaaaaactgaaagccgcacactctgagttagctgaggagggggctattgagatcgtcatcataaagaccacaggagacatgatcttggacaaaccccttgcagatattggaggcaagggtttattcaccaaggagatagatgatgcactcttgcagggaaggattgatatagctgtgcactctatgaaagatgttccaacatatctacctgaaggcacaatattgccctgtaacctcccacgagaagatgtaagagatgcattcatatgcttgactgcaaattcgctcgcggagcttcctgctggcagtgttgttggaagtgcttccttgcggagacaatctcagattctc

SEQ ID NO: 69065 - DNA, 429 bp, Zea mays
  unsure at all n locations
  Clone ID: LIB3078-054-Q1-K1-E2
cccacgcgttcggcgggaaccctctagccatgaccgctgggatccacacgctcaagcggctgacagagcccggcacctacgagtacttggacaagatcaccggcgaactcgtccgtgggatactggacgtcggtgcgaaagcagggcatgatatgtgcggaggacatatcagaggaatgtttggcttcttcttcaccggcgggcccgtccacaacttcggggacgccaagaagagcgacaccgagaagttcgggaggttctaccgtggcatgctggaggagggcgtgtacttcgctccatcgcagttcgaggcggngttcaccagcttggcgcacaccttccaggacatcgagaagaccgtcgaggccgctgagaaggttctgaagcggatatagggggtccgcttcaagcaagcatgcagagagcatt

SEQ ID NO: 69066 - DNA, 282 bp, Zea mays
  Clone ID: LIB3078-039-Q1-K1-D10
tgcattcatatgcttgactgcaaattctctcgcggagcttcctgctggcagtgttggtggaagtgcttccttgcctagacaatctcacattctctacagatatccatcactgaaagtagttaacttcagaggaaatgttcagacacggttaaggaaactcactgaaggagatgtgtctgctacattgttggcgctggctggattaaggcagctaaatattgcagaaaatgcaacagctgtactatcagtggaagaaatgcttccggcagttgcccaagtgct

SEQ ID NO: 69067 - DNA, 387 bp, Zea mays
  Clone ID: LIB3078-054-Q1-K1-D9
cccacgcgtccgcccactcgtccgaaattttcgattcatgggctactgagctcagcccggctgattttgaggagtttagcctgccttatctaaagcagatagtggatagtgttagggaaacacatcctaacttgcctctgatactctacgcaagtggatctgggggcttgctggagaggcttcctttgacaggtgttgatgttgtcagcttggactggacggtcgatatggcagagggcaggaaaagattgggatctaacacagcagtccaagggaacgtggatcctggtgttctttttggatccaaagagtttataagcaggcggatttacgacactgtgcagaaggctggcaatgttggacatgtactgaaccttggccatggca

SEQ ID NO: 69068 - DNA, 442 bp, Zea mays
  Clone ID: LIB3078-008-Q1-K1-H8
gcgatcacgggcgacgccaacacgctggccggtgacatctcgcccaaggccgggctgggcgacctccgcggcctcgcggcggggctgcgcggccagaacggctctgccatgatcgacggctccgagagcttcgacggcgccaaggcgtacaaggacagcaagatctgcaacatgctcaccatgcaggagctgcaccggcggtaccacgaggagacgggcatcacgttcgcgtcgctctacccggggtgcatcgccaccacggggctgttccgcgagcacatcccgctgttccgcctgctcttcccgcctttccagaagttcgtcaccaagggcttcgtgtcggaggcggagtccggcaagaggctggcgcatgtggtcagcgaccccagccttaccaaagtcggggtgtactggagctggaacaggggactcgcgtcgttcg

SEQ ID NO: 69069 - DNA, 352 bp, Zea mays
  Clone ID: LIB3078-004-Q1-K1-D7
ctcctggcgcgcctgctcctggacgacatgcagaagtccgactacccgtcccggcgagtcatcatcctcggctccatcaccggcaacaccaacacgctggccgggaacatcccgcccaaggccgggctgggcgacctgcgcggcctcgcggcggggctgcgcggccagaacggctctgccatgatcgacggctccgagagcttcgacggcgccaaggcgtacaaggacagcaagatctgcaacatgctcaccatgcaggagctgcaccggcggtaccacgaggagacgggcatcacgttcgcgtcgctctacccggggtgcatcgccaccacggcgctgttccgcgagcaca

SEQ ID NO: 69070 - DNA, 172 bp, Zea mays
  Clone ID: LIB3078-006-Q1-K1-G6
gcagaagtccgactacccgtcccggcggcttatcatcctcgggtccatcaccggcaacagcaacacgctggccgggaacatcccgcccaaggccgggctgggcgaccttcgcgggctcgcggcggggctgcgcggccagaacggctctgccatgatcgacggcttcgagagc

SEQ ID NO: 69071 - DNA, 419 bp, Zea mays
  Clone ID: LIB3078-003-Q1-K1-C7
ctcaagtcgagcgggcgcaccggcgtgatcgcctcggaggaggaggacgtgcccgtagcggtggagcagagctactccggcaactacatcgtcgtgttcgaccctctcgacggctcctccaacatcgacgccgccgtctccactggctccatcttcggcatctacaaccccaacgacgagtgcctcgccgacgtcgacgacaatgacaccgtgagtgctaattaatctcatctcccttaccttctttctgttctgactggctcattacgtgacaattctatctccaacactacactacgtacgtacgcgcgcgcagcttgattcggtggagcagaggtgcatcgtgaacgtgtgccagccggggagcaacctgctggccgccggctactgcatgtactcgagctcggtgatcttcgtgc

SEQ ID NO: 69072 - DNA, 379 bp, Zea mays
  Clone ID: LIB3078-008-Q1-K1-E5
gggaggtgcattcactggtgaaattagtgctgagatgctcgtcaaccttggcgttccctgggtcattcttggacactctgaaaggagagctctgctgggagaatcaaatgagtttgttggagacaaggttgcttttgctctgtctcagggactaaaggtcattgcatgtgttggtgagacccttgaggagagggaggctggttcaaccatggatgttgttgctgcacaaacaaaagcaattgctgagaagatcaaggactggagcaacgttgttcttgcctatgaaccagtctgggctattggaactggcaaagtcgccaccccagctcaggctcaggaagtgcacgccttcctgagggattgggtaaagatcaatgtc

SEQ ID NO: 69073 - DNA, 360 bp, Zea mays
  Clone ID: LIB3078-029-Q1-K1-F7
gcctctgttggccgttcgaatctccgcacccaatttaatcgacacctcaccgagatgggccgcagagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaagagagctct

SEQ ID NO: 69074 - DNA, 408 bp, Zea mays
  Clone ID: LIB3078-033-Q1-K1-B10
gcgatccaatctagactctcccctcttcctccctccctctctctatctctcttcggggtccgaatctacggacccaagcgaatcgacacctcaccgacatgggccgcacgctcttcatccgtggcaactggaaatgcaatggaaccacagatcatgtcgcgaacatagtcaaaaccctgaatgaacgacaggttcccccttcagatcttgaccaggtcgttgccagccctacttatgtcttccttcctgtgctcaagagccagctgtgccaagagttccatgatgctgctcataactgctgggtgaagaaaggacgtgctttcactggtgaactcagatctgagatgctcctcaaccttggtgatccctgagtcattcttggacactctgaaacgagaactctgcttg

SEQ ID NO: 69075 - DNA, 433 bp, Zea mays
  Clone ID: LIB3078-049-Q1-K1-E4
gcgattggttgacgaccaacatatcacctgatgttgcgtctagcacacgaataatctatggaggttctgtgaatgcagccaactgtgcagagctagcaaagaaagaagatatcgacggttttcttgttggtggtgcctcgttgaaggccccggacttcgccaccattatcaactcagtgaccgccaagaaagttgcagcctgatggaccaccctgtgagaaataagaggccatcagcgtgtcgcctcatctgccacgccttaaagcctgtataggaggtgatccgtgtgatggtgtgcccgtcacctcctgtttttgctgatttgcagcacggggacagaaaataatgttttgctctcgtggacctgcactgcacgtgacgaggagagttcagttgtcgtgagcgatgtacgttggggatattgtgatgtggt

SEQ ID NO: 69076 - DNA, 431 bp, Zea mays
  unsure at all n locations
  Clone ID: LIB3078-007-Q1-K1-B10
cggacgcgtgggttggaccagtggaatggctgaaaccgtacactgatgagacagtgatggagcttgggcagaaaggggtaaagagcctgcttgctgttcccattagttttgttagcgaacacattgaaactttggaagaaatcgatgtggagtacaaagagttggctttggaatctggcatcaagcactggggacgggttccagcactaggttgcgaacccacattcatttcggatcttgctgatgctgttattgaaagcctaccttatgttggcgcaatggcagtttccaatcttgaggctcggcagtctctcgtacccctcgggagcgtggaggagctgctagcagcatacgactcgaagcgcgatgagctccctccaccggtaatcgtgtgggagtggngctggacaaagagcgcggagacctggaat

SEQ ID NO: 69077 - DNA, 459 bp, Zea mays
  Clone ID: LIB3078-053-Q1-K1-F7
tccgcattctccgtcatggctgagccgacgccgtcgcagtcgccagcgcagacgccgcgcccgccgccgacgcagcagactcccgcggcgggtgggctcgaggacatgctggcgtgtgtggcggcgctggaggccgcgctgctgccgtgcctccccgcgcgcgagctccaggccgtcgaccgctccctccagtcctcccaccagattgatgttgagaggcacgcaagggatttcatggaggctgccaagaagctccagtcttatttcatcagcctgcagcgtgaggaaccgccatctgcagaagagatgcttcgaaaggagattacgacaatggaggaagagttgaagagcaagtctgagctcattgccaagcacaagaagttgattgaagggtggcaaaaggaactgaaggagcagctgggcaagcacatcacggagcttgaaagggtgtgaagagtg

SEQ ID NO: 69078 - DNA, 449 bp, Zea mays
  unsure at all n locations
  Clone ID: LIB3078-053-Q1-K1-F8
ggaacataagggggagatgaaggttgtggtcaggacagttatttcactcaccaaggaggaggagaaagaactcaaggaaaccttgcaggatatccttggggaaaacaaaactattttggttgaacagaagattgactacagcatcatgggaggattagtgattgaattcgggcagaaggtgcttgatatctcaatcaggaacagggcgaagcaaatggaggcgttcttgaggcaaccacttgacttctaacagccttttggataaaagaagcatcatcggaatgcagaggctgtcctgttgaaggttttcctgtgtctgcaattttaatctgtccttttgaataaaatgtttcctctaacaagtgaagggcactgtttntattgtctcgtgggccacagatgcctgctgaacaatttatgttcatttcttcttttcttaaagaagcatg

SEQ ID NO: 69079 - DNA, 354 bp, Zea mays
  unsure at all n locations
  Clone ID: LIB3078-053-Q1-K1-F9
atggagacatgctcacaatctggtgaccgcgaattgtcagaggacttgcttgtctattggattgagcagggtaagaaagaatgcttcgcttcttgcctcttcatttgctatgacctgatccgaccggatgtcgctcttgagcttgcatggatgaacaacatgatggactttgccttcccgtacctgttgcagttcattcgtgaatacactagcaaggtggatgatttagtgaaggacaagattgagtcgcagaaggaagaaagagccaaagagaaggaggagaaagaccttgtggctcagcagaacatgtatgcacagctgcttcctctcgctttgcccgccccgncaatgcct

SEQ ID NO: 69080 - DNA, 388 bp, Zea mays
  Clone ID: LIB3078-053-Q1-K1-G1
aaaagtgaccgaaaatttattccgaagataaccaaacaataatagtaggtacgtacgtgacgtagatagatagatagatagatagatagaacataaataacaggcaatagacagtactagtactactaccagcaccgtcgccgcaggcacacgtggatctgctgcgcgacctgagaaggggaggcgtacagtggccggcggatgcgagagcggccagcgggtcatgccggcggcggaggcttggcgacgacgacggggaagtcgacgacgagcaccttgtcgatggcggccatgaaggtggcggcgaaggcggtgtggctgtcgtgggccatgtaagcggcgaggtcggcggcggaagcgaaggtgagcgagaaaacgtgcgtgaagg

SEQ ID NO: 69081 - DNA, 310 bp, Zea mays
  Clone ID: LIB3078-053-Q1-K1-G10
gaaactacaggtctcgatccaattgcatatattgatgttgttgaacaagagagcacaggaagcgtgagctcagttatgccatgggatcgttctcttcgtgaaatggccaaagatgagatgtatttgttagttgcagttctttttattatcgtgaaggttgtagcacacttcatacctgttgtcatgtctcatctaagagctttcttagttgttcgtgtccaaaacttgaacttagggatccgtaggggatcaaaccagctcctggaacgagccttgaatgttcttgatgtaaggaggctttggagcaagc

SEQ ID NO: 69082 - DNA, 427 bp, Zea mays
  Clone ID: LIB3078-053-Q1-K1-G11
gttgctggtctatactatgtcaatctatgaaaatatggctgcaaattaaaaagacttgggaatggggggagacgtccccttgactttagtcttaagaaggggcctaccaaacccgggaagaaggcaggaacctcatgtgagcaggcttctttggctgccgtggaaccatctgtgctgtttcatccagggaggtgggcacacagccatgcagcacagggatcgaaccctggtggggagcgccacacctcgggtgctgaaccactgcgctattagcgcctctacaaacacgactgtaattgcttatatgattaaaaatgtggagattacataagaattttactaacatggtctatcccatacatgaacctggatcttttggagtctttcctgattgatgtacccatatatatatatatatatatatata

SEQ ID NO: 69083 - DNA, 431 bp, Zea mays
  Clone ID: LIB3078-053-Q1-K1-G12
cccacgcgtccgcccacgcgtccgcaaaaagtttgcaagttataccgtgttcaagggagaggctgcactttctatacatcctatactgccaagtttcagcaaattagaatccggaggatctcgagtgagcaaaaatggatcagtaatgctgaccttctttcctgctgttggacaaaggaagtatgactatacaaagaaacagctctttgctctgtcacctactgaagttggaagcctgataagtcttgggcctgctgaatcctgtgaatttttccatgacccatccatgaaatcaagtaatgaaggaacggtgaaaaaatcgctgtcgatcactccacttggcagtgacagtggatactttgttaatataacccgtgtgaacagtgcagagaggactaatgatcggctttcagtccctattacaaaagctg

SEQ ID NO: 69084 - DNA, 468 bp, Zea mays
  unsure at all n locations
  Clone ID: LIB3078-053-Q1-K1-G2
ccgcgtgcgaaccaagcagaccacaacaagaagaagcgtagncgtcgccggaaggaaaggcgcggagcaagatgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcaacatggtggtggataagctcggcgattacctgatcgagcaaggcttcttaa

SEQ ID NO: 69085 - DNA, 467 bp, Zea mays
  Clone ID: LIB3078-053-Q1-K1-G3
cccacgcgtccgtggactacctcgggaacccgagcctcatccacgcgcagagcatcctggccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaaggggccgctcgagaaccttgctgaccacattgccgaccccgtcaacaacaacgcttgggcctacgccaccaacttcgtccccggcaagtgaaggaagcgccggcggtgacctttaggtgtccggatgcatttgagcgcacgcctggtttcggtttgtaccatgatggtaactatt

SEQ ID NO: 69086 - DNA, 415 bp, Zea mays
  Clone ID: LIB3078-053-Q1-K1-G4
gttttcaggttaccacctggcgtcaagaaagtgctgcatccgatcatctcctgcgcactctgggcagatttcgcggcgctggcctatgggtacatctcagggtttggacttgatgccgtgctaggtgcttacctcacaaaggtgccctctaatcctggagccggtgacgtactaatgactttccttgggtctgtgatcatatcatttgcattctcgatcttcaagcagagaaagcttgtgaagaggcacgcaacagagattttcacatcaattgccatcgcgtcgacattctctctgtactcaactgctatcataaggcgcctgattgggctagagccatcgttaaccatatcaatactgccaaggtgtattactctggcgctggctttgagcatagtggctttctttgaaggtg

SEQ ID NO: 69087 - DNA, 481 bp, Zea mays
  Clone ID: LIB3078-053-Q1-K1-G6
ctcgaatggtcgaacagtagtttgctcgctattatccatggcgacttctacggctgctgccactgcactgctcggccccaggccggcagttccagccaagttggcgcagaggaggtgcctccatgcggttgctgggtggacgacgatgaggaggaggggagctgcaggggtcgtgcgagctttcttcaaccctctcggggatgagcgcatcctccgagaagccatcaaggagccagtagcattcatgggtggtgtgtttgctggcctcttgaggcttgacctgaatgaggatcctctcaaggaatggataagtcggacagtggaggcttctggaatagctgaggaaaacagctctgaagaatcaagtgaggcagatcaaaatgatgcacctcagcaaattgagattgagtgaggtgcattgtctacttttgtccacttgtcacttttcccttgtaacttatcctgaatatatgtgacacct

SEQ ID NO: 69088 - DNA, 246 bp, Zea mays
  Clone ID: LIB3078-053-Q1-K1-G7
tccacacgtactgggacccacgtgtacacatgggccgggccatgcgcgcgcatccgggctgcacgcgtaccatcagcctgctctatgaggcctacaggacaagaaagggggggaccatctgcaggtggataaagaacgtggccaacggcgaccacaaggagcagcatgtacatgacccgcaccgccgcgctgccaagaaagtgcagcgtaagcctgccatgcatgagcagaacctacggcaactga

SEQ ID NO: 69089 - DNA, 468 bp, Zea mays
  unsure at all n locations
  Clone ID: LIB3078-053-Q1-K1-G8
cgaggcggggatgacgagcccaatggtggccaccccggtccagttccacacaaccgggcgcctcagcttctgctccttttcctttcccagcgcatcagggaggcggcgattcgcggcggtgagggcgtccgcggagacgatggcgacggagaagctgggcatcaaggtggagcgcaacccgcccgagtcccgtctctccgagctcggcgtccgccagtggcccaagtgggggtgcgagaagagcaagttcccgtggacctactccgccaaggagacgtgctacctgctgcaggggaaggtgaaggtgtaccccgaaggccacggngaggagttcgtggagatcggcgcgggagaccttgtcgtcttccccaagggcatgagctgcacctgggacgtcgccgaggccgtcgacaagcactacaacttcgagtagccgccgtcgncgactagccctgcggggctcgatgt

SEQ ID NO: 69090 - DNA, 313 bp, Zea mays
  Clone ID: LIB3078-053-Q1-K1-G9
actgcacagtgcaaaactgtatcaagttttcaggacctttggctacaacctcagttgccgctaatgcaaaatttgaaattagaagccccaagcgtgtgcagatcaaatttgatgaagggattgttggtacaccacagttgaccgactccattgtgctaccagagaagtttgagttatttggacagaacatcgacctgagtccactgaaaggcatattttcttccatcgaaaatgcagcatcctcggttgcaaagaccatatctgagcagcctccgctgaaaataccgatcaggacaaacaatgctgaatcgtg

SEQ ID NO: 69091 - DNA, 219 bp, Zea mays
  Clone ID: LIB3078-053-Q1-K1-H1
ctcacgctgccaagtacgcttgccatcgatgacattatgaaagtatataccggcgctttgaggggagactattatcagcagcgtggtgtgctacacctacacttgcataaaaaactggacttgtaagagatggaaaagatcgtagctaactgatcacccagaagaaggccatccatgagccggacttgcacaatcccaagctcgagacgcctaatccta

SEQ ID NO: 69092 - DNA, 465 bp, Zea mays
  Clone ID: LIB3078-053-Q1-K1-F6
ctcaaccttcagaggagccccctaagaggttaattgagcaacacagatggccagccatgatagctgggcaggcgccgaagaatctcatgtcaagaagcattgacctttcggacaaagctaatataccagtcccaccatcaaatacatcaagaggtctttcaccaaggaagacgccttctgtcagacctgttgcatcatcaaatacatcaagaggcctttcaccaaggaagaccccttctgtcggaccagtcccatcatcaaatacatcaagatgcccttcaccaatgaagaccccttctgttgaagcttcagtgaaactgtcaaatcagtcattggatgaagtggcaaggagtttggctattcaatcaagcagaagagatgataaggtagattcacagacaatagagagatccaaatctttgagccgaccaaacagaacagttacttttcctgttccaattctac

SEQ ID NO: 69093 - DNA, 393 bp, Zea mays
  Clone ID: LIB3078-053-Q1-K1-E10
cccacgcgtccgcggacgcgtgggtagagaggaagagcgcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtccaggttggcaaggaaccgcaggactgtgaaccgtccatatggtggtgttctgtctggtaccgcagtgagagagaagatcatccgggcctttttggtcgaagagcaaaagatcgtgaa

SEQ ID NO: 69094 - DNA, 405 bp, Zea mays
  Clone ID: LIB3078-053-Q1-K1-E11
cccacgcgtccgcccacgcgtccggcggagccggcggcggagcggagatggcggagaagaagcgaggcgccggcactcgcaaggatgaggtggtgacacgcgagtacactatcaacctccacaaacgcctccacggatgcacctttaagaagaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtgtcagaattgcccgcaaccggaacgatgaggaagacgccaaggaggaactctactctctggtcacagttgctgagatcccaccggagggtctcaaaggtttgggaactaaggggtgtg

SEQ ID NO: 69095 - DNA, 395 bp, Zea mays
  Clone ID: LIB3078-053-Q1-K1-E3
caccactccgcgctagctgaggacggtacagcggcacagaggtgcgacgtacgacgacgacggcgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccggcaggcgacagctgggcttaagcctgaagcccccgacttccgcctgcaaacgggtgacccccgcgggttcaccctcggcgacacgctt

SEQ ID NO: 69096 - DNA, 462 bp, Zea mays
  Clone ID: LIB3078-053-Q1-K1-E4
cccacgcgtccgagatgatgcttagggtttccgcgtctccggccgccgcggtggccaaccatgtctctggtggggccgcggcgaccacggctcctgccagggtgacggcgcagcgcagcggcgtctcgctgtccgccgccgccgccgccggcaaggggaaggaggtgctcagcggggtggtgttccagcccttcgaggagatcaagggggagctcgccctcgtgccccagtcccccgacaggtcgctcgcgcgccacaagttcgtcgacgactgcgaggcagccatcaacgagcagatcaatgtggagtacaacgcctcgtatgcgtaccactccctcttcgcctacttcgaccgcgacaacgtggccctcaaaggatttgccaagttcttcaaggaatccagcgacgaggagagggagcacgctgaaaagctcatggagtattagaacaaacgcggaggca

SEQ ID NO: 69097 - DNA, 399 bp, Zea mays
  unsure at all n locations
  Clone ID: LIB3078-053-Q1-K1-E6
attaagcnggacaaagagaagaaaatcctgtccattcgggataggggtattggcgtgggcaaggaagatcttattaggaaccttggaacgattgctaaatctggcacttcaggaacaggagctgctcgagtctcttgtcgaagctgatacgagaaggcaggaaagagctaaaaagatggaagaaaagaaagtgtctctgcaactatacgaagcaatggaggcgttggtcaagatcaatctggagacgaacaagatcatggacttcatcaagtttgacgtcggcaacgtggtcatggtgactggcgggaggaacaccgggcgtgtaggagtcatcaagaacagggagaagcacaagggcagctttgagaccgttcacgtgctgcttggagctttttgcta

SEQ ID NO: 69098 - DNA, 459 bp, Zea mays
  unsure at all n locations
  Clone ID: LIB3078-053-Q1-K1-E7
ctccctgctttgttcagacttcagagcccttcctcttgtgtccgtgcaaattggtgatgcttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggctatctgctgctgctgctagttctgcttggagggcatgggcgtccatcatcgtggagatgtggccatgcgggacacccaccgncgaataaaatgctgtacttatatgcacgcacgttagaaatgcattaatgtctggttgatgtgatcttttgtgtgtgtgtgcgcgcatcttcatttgcactggaaaatgctttattatttgtgaaggtctggaaatct

SEQ ID NO: 69099 - DNA, 372 bp, Zea mays
  Clone ID: LIB3078-053-Q1-K1-E8
agcttcgaccccctcggcctggccgacgaccccgaggccttcgccgagctcaaggtgagggagctcaagaacggccgcctcgccatgttttccatgttcggcttcttcgtccaggccatcgtcaccggcaagggcccgctcgagaacctcgctgaccacatcgctgacccagtcaacaacaacgcatgggcctacgccaccaacttcgtccccggcaactaagctcaacggctatgctatgcaacttcattgtctttcggatcggagagggtgtacgtacgtggattgattgatgctgcgagatgcatgtgtgtcttttgtttcacgttgcattgcataggcaagtcgagatgatgagttggcgttgtacac

SEQ ID NO: 69100 - DNA, 446 bp, Zea mays
  Clone ID: LIB3078-053-Q1-K1-E9
aaactccaaaggaggcccccaagccaaaggtggttgaggtaccagcagaagaggaagcagcaaagccaaagccaaagaatcctcttgacttgctgccaccaagcaagatggtccttgatgactggaagaggctatactcaaacacaaagaccaacttccgggaggttgccatcaaaggtttctgggacatgtatgacccagagggctactctctgtggttctgtgactacaagtacaatgacgagaacaccgtctcctttgtgaccctgaacaaggttggtggattcctgcagcggatggacctgtgccgcaagtacgcctttggcaagatgctcgtggtaggttctgagccacccttcaagctgaagggcctttggctcttccgtggccaggaggttcccaagtttgtaatggatgaggtctatgacatggagctctacgagtgg

SEQ ID NO: 69101 - DNA, 368 bp, Zea mays
  Clone ID: LIB3078-053-Q1-K1-F1
cagaggcgcagaaggcagtcgcggacaggaggaagaggaagaagaagcggcagcgagcgaggatgccgtgcctgaacgtgtcgaccaacgtgaacctggagggggtggacacctacgccatcctcgccgaagccttcaagtccgtcgccaacatcatcggcaagcccgaggcctacgtgatggttgttctcaagggttcggtgcctatggcatttggaggtacccaggagccagcagcttacggtgagctggtttccatcggaggcctgaaccctgatgtgaacaagaagcttagtgctggcatcgcttctatcctggagtcaaagctgtctgttcccaagtcacgcttttacctcaagttctatgac

SEQ ID NO: 69102 - DNA, 358 bp, Zea mays
  Clone ID: LIB3078-053-Q1-K1-F10
cggacgcgtgggtatccttctatccccattcccatcccgagacaggagaaggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaagacggtcggggtggaggtggtgcgcctggctccacaccccaagtacaagcgccgggagcgcatcaagaagaagtaccaggcgcacgaccccgacaaccagttcaaggtcggcgacgtcgtcgagctccaacccttccgtgccatcttcaagaccaagcactttc

SEQ ID NO: 69103 - DNA, 188 bp, Zea mays
  Clone ID: LIB3078-053-Q1-K1-F11
ctggaaagtggttctggttgacaacaccgacttcgtcagggaactccagtgagaaccgggccggagcacccaggtgctgagactgggtgtagtttagcagggcttgtgatccaatacgatgtgggctagaggttgtgctgctgctagcctgctaatgcaactgctacatgatcttgtttggcagtggt

SEQ ID NO: 69104 - DNA, 348 bp, Zea mays
  Clone ID: LIB3078-053-Q1-K1-F12
cccacgcgtccgcccacgcgtccggcacccttttgcggcttgcagctaaagtcgatgcgatcaaggatacactggagaacgatgagcagaaggttggagctgaaatagtaaggagggccctgagctacccacttaaattgattgctaaaaatgccggtgtcaatggcagcgtcgtcactgagaaggtcctttctaacgataacttcaagtatggttacaatgctgctactggacagtacgaggacttgatggctgctggtatcattgatcctacgaaggtttgtggccctaaagcttttcctatccttctgcttgaatactatagttagttggcttggaacttcggtc

SEQ ID NO: 69105 - DNA, 447 bp, Zea mays
  Clone ID: LIB3078-053-Q1-K1-F2
tttgattcatgcatttgatcatttcaactgctttctccaattctatgtctttaattatgaggggatcaattcattctggagtgatttggtattgaaccttgctgtcgcagagcttcagttagcctctaccactgctccatcgcttggtggcactttcttgttcttttttctgtgtggtagtgtgcatatgcatgtttgacatataatacttagtatttaatgttaaactgttaatggtcacttgtgttttcagaatgagatgaatgagcgtgagttgtgtgcactgaaatctgtcattaagtgcattgaagatcataaacttgaggagcagtaccctgtggacccacttcagaaaagggttttgcagctagagaaagcaaaggcagacaagaggagggctgttgaagcagcccagccacagtccaagaagcctcgtgccaatggatc

SEQ ID NO: 69106 - DNA, 455 bp, Zea mays
  Clone ID: LIB3078-053-Q1-K1-F3
gggaactgagtgcataaacaccaccacgtctatagaagagcacttgcacaaggagctccccgacccagttgatctgaaatccatggagatgactgtacctgatcagcatgagccatctttcaatgaaccagaacatgtactcaaagacgatgagaaatccgagggtcatttctctgaagagaaagtagatgcaggagctaatgagattcataatggagggcaagatgacaatggtggtgtcaagactatatatgaatgtgggattgttgagaaaaaggctgaccggagtgtggataagacagtgccgaagactgaagtggctcaagtatggaggaaggatgatccaaaaggcaatgacgtgattgaagaaaccaaaagcaagctcctgctggaaaggaagagcccggtgaaagccttggtgggggcctttgaaactggattgtcgttcaaggagt

SEQ ID NO: 69107 - DNA, 445 bp, Zea mays
  Clone ID: LIB3078-053-Q1-K1-F5
cccacgcgtccgcgaccaccgcaggaagatggaggccatcggggccggcgccgtggggaggctggccacgaggaactcggtcaaggacctgctgctgggcattggaaagggtcgaagcggctgcgaaccgctgcacctcttcccgtctgccgttctgacggtgaaccgcgggccgtcgccggacttcaagacggcgcacgggatccaccaatggtggcggcccgacctgtcactggagtgcaccgcgcattactacacgtgaaccttttaccctgacttcatgaagctccgtcctcgaatatctcacttcactccgggaattggattgaaagcttgaaccgacaaaaggagaagcgtaacttttcaaacatcggtacccttcgtccgttgaagacttagttgcattgatgattttgatataaccttttttaaaaagatttttttc

SEQ ID NO: 69108 - DNA, 366 bp, Zea mays
  Clone ID: LIB3078-053-Q1-K1-E1
gcgttcgccagcgtccgcccacgcgtccgcggcgagctctctaagaggtcgggtggaactaccatggggccatcagggaacttgaggagaagaggaacgagaaggtcaaggttgcctacgagaggaagaagcaattggccaagctgcgtgtcaaggccgagaaggcagccgaggagaagttggggtctcagttggagattcttgcccctatcaagtactgaggagctgtgctttgtcatcagttttggggaacatctagtctttggtttaagtgttctgtaacagtttgtgacagtataatctggaaaaccgtgttataattctgccactgctatttgaacacattttctagctggagaatgaact

SEQ ID NO: 69109 - DNA, 438 bp, Zea mays
  Clone ID: LIB3078-054-Q1-K1-C6
gagaaacccgcggtaccggagcccatctaggctcagctggccgccgcgggggccgggaaggactcggacatcttcgctgttgtcatgattggttcaagacagtacatagtgatgccgggcaggtatatatacacacagagactgaaaggtgccaatgtcaatgatcagatcatattaaacaaggtgctactggtgtcaactagagaaaaagcttacattgggatgccagtggtgaccaatgctgctgttcacgcagtggttgaagaacagggacgggatgataaagttatagtgttcaagtacaagaagaagaagaagtaccagaggaaacttggtcacagacagccaaacacaaggttaagaatcacaggcataagtggatacgaagagtaccctgctgacccaatacttgaccctgctgcagctttaaattaaact

SEQ ID NO: 69110 - DNA, 444 bp, Zea mays
  Clone ID: LIB3078-054-Q1-K1-C8
gcggggagcgtatgtttgaccatgtcctattgcgagtgaaagggttggaaatcagggagagggccgaagatgggaactgtcgattcagagctgttgctgatcaagtttatggagacgcataagcttatgacatggctaggcagatgtgtgttgattatatggaaagggaacgggatcatttctctcagttcataactgaaattgaaagttttacattatactgtaagaggaaaaggagagataaggtttatggcaacaatgttgagatccaggcatttgcagagatgtacaatcgtcccattcacatatattcctacagtacagagcccattaatatttttcaaggaagctataacacagacgttccttcaattagattaagttaccatcatggtaatcattacaattcagtggttgatccccgactgcagacagttggggcag

SEQ ID NO: 69111 - DNA, 433 bp, Zea mays
  unsure at all n locations
  Clone ID: LIB3078-054-Q1-K1-C9
cttctctgcacccccaatcgacctcctcgcctgcagcagaccctcctggggtgcgccgggcgtgcgccggcggcgagatgtcgaagaaaatcgtggtgaagctgcacctgcaggacaacaaggacaagcagaaggccatgaaggctgtctcggcgctcaccggcatcgacgagatatccgcggacatggcgtcgcacaagatgacggtggtcggcatggtggaccccgtgagcgtggtgagcaagctgcgcaaggcgtcgtggtcggcgaccatcgagtccgtcggcccggccaaggagccggagaagaaggacggngaggcagccaagaaggacggcggcgagggcgagaagaaggaaggcggcgagggggagaagaaggaagcaagcgatggggagaataagaaggaagcaggcggcgagaaagacaagga

SEQ ID NO: 69112 - DNA, 435 bp, Zea mays
  Clone ID: LIB3078-054-Q1-K1-D1
gccacgcgtccggtgaagcgccagctgttcaacaacttcgcggggctcttcttcgggctgcccttcaccaagctcaacccggacttcgccctgacagtcaaggacaagttctcgccggaaagcaagctgctggttgtctgccaggaaggtctcaggtcagcagctgctgcagatgcactggagaaagaaggcttccaaaatattgcatgcatcacatcaggtcttcaaacagcgaagccaggaacgtttgaatctgtggtgaaaagtgagctgcagaacgcggtgaaagctgtccttgtgaccattcaagggaagatttctgcagtccttgggactgtattgattagtgcctacctgtttataacattctttccagaccaggctgacaagctttttgacttggctggcatcagcttgtgatcagagctgacgttc

SEQ ID NO: 69113 - DNA, 363 bp, Zea mays
  Clone ID: LIB3078-054-Q1-K1-D10
ctttgagggtgagcgcagtatgaccaatgactgccgtcttctcggcaaggtcgacctcaacggcattgcgccagctccaaggggcacaccccagatcgaggtgaccttcgaggtggacgccaacggtatcctgaacgtgaaggcggaggacaagggcacgggcaagtcggagaagatcacgatcacgaacgagaaggggcggctgagccaggaggagatcgaccgcatggtgcgggaggcggaggagttcgcggaggaagacaagaaggtgaaggagcggatcgacgcccgcaaccagctggagacgtacgtgtacaacatgaagaacacggtgggcgacaaggacaagctcgcggacaagct

SEQ ID NO: 69114 - DNA, 425 bp, Zea mays
  Clone ID: LIB3078-054-Q1-K1-D11
ggccaccgatttatttgcagcgtactgttggcatgtagtggatagacagtaaactacacatgcctaatacatagggtatcgtctttataaagatgagagtgctctccacactcatgcagattccgcgaagccaatcctgtcgttgccgaagtcgaacaccgtgtggtaagctcccatgaagacgtccccaagaatccagagaggaccacgcggcggtggcacgtcatacgccatgaacccactgatgcagacggtttggcctccttgctccagcttcacaatgtactgctggggtgttagggtgaaggtcttgtttgcgatggtgaacgcaaggctgggcatcttggagatctcctggcagctgactgttgactctccgttggggctcggcagacgctcacacagctggttagcgtactgcagta

SEQ ID NO: 69115 - DNA, 436 bp, Zea mays
  unsure at all n locations
  Clone ID: LIB3078-054-Q1-K1-D2
cgaaacaaccaatgcctccaccaaaaatcggaatgttagtgcgtagacttataccagttgcatacaaagtgtacaatgcaagaattttgctgatcaacaacttgaagaggcttatgaaagtagtaccagtaaaaggctgcaagtattgcagcgagatacatgttggatctgttggacatcctttccgaacatgccgaggaatgtcatcagatcaacgtagaggagaacatgactggngaagtactctagtggaggcagttttcttacccgtcgaagcctatcatctagaggaccgtctagggaatcgcattcctcatgatcagaggtttactgtaccccgcattcccgctctcgtggaactttgcatccaagctggagttgaccttcccgagtaccccacaaagcgtcgaagaaagcctatcattaaaatcggaag

SEQ ID NO: 69116 - DNA, 258 bp, Zea mays
  Clone ID: LIB3078-054-Q1-K1-D3
gctccccaacgaagtgcgagcgacccttttgcacacgacacgaaccaccaccaccaaggagcagccgcaccacgcacccagcgcaaagcgatggcgtcgctcaccatgatggcgtccttcgccgccgtggcggtggccgcgccctttcgccgcggcaccttcgccgtggtcaggttcgtcaaggtcgaccgctgccaggaacccggcacgcttgcagcaaccgaaggcaggcccggcgtcgacggacgccgcgccgtc

SEQ ID NO: 69117 - DNA, 391 bp, Zea mays
  Clone ID: LIB3078-054-Q1-K1-D4
ccgacgccgaagccgccgccgcctccgtcgccgtcgtcgtcgtccacgccgtgccctgcgccggcctactcgccgtcgccgtacacgccgacgggtaagtgccccgtgagcacgctcaagctgctcgcgtgcgtggacgcgctcaacggcctcgtgcacgccgtcatcgtgaccaacgtcagcgacacctgctgccacgtgctctccggcgtggacgacctcgacgacatgctctgcctatgcaccaccatcaaggccaaggcgctcagcgtcagcctcgtgctccacgtcaccatctaggtgcatcgtaacgagagcggcaagcatgtgccgtccagcttacagtgcccgtaatcacatcagctgcatatatgtgctactatgatgtatg

SEQ ID NO: 69118 - DNA, 303 bp, Zea mays
  Clone ID: LIB3078-054-Q1-K1-D5
ccacgcgtacgggtccccaacgaagttcgagcgacccatgtgcacacgacacgaaccaccaccaccacgagcagtctcacgagttacccgagtctctagcgattgcgtcgctcaccatgatggcgtccttcgccgccgtggcggtggccgcgccctcgcgccgcggcaccttcgccgtggtcaggtccgccaaggtcgaccgctgccaggagcccgacacgctagcagcaaccgaggccaggcccgccgtcgacggacgccgcgccgtcatgctcgcggctgctgcggccgtcgtggcagaca

SEQ ID NO: 69119 - DNA, 437 bp, Zea mays
  unsure at all n locations
  Clone ID: LIB3078-054-Q1-K1-D6
cttacagtcgacctggctgaaggaaatctcaaagctctaagcctgcaagccttgggtgagggggttgacatgcagctcggcttggctattgatagtccaaaggccactttagcagtcaaaaggcgcttagcctgtgagatggtcaaatattggcaacaagttcaagagagcattccagagcttccagtctctgatggatggggaaaaaagcaccggctatttgtaaagtggaagtatgttgaagccaaggctgcagcatactatttccacggtttgattcttgacgagggaaataccgagaaatcccatggaatggcaatagctgcactacaagcttcagaagaatttctgaaagaaagcaaaatggtttcggaagccttccatgcaactcctncaacatcgaggagtccgaatgcanttcgaacagcaaaatatct

SEQ ID NO: 69120 - DNA, 107 bp, Zea mays
  Clone ID: LIB3078-054-Q1-K1-D7
aacctatctggggctgcgattcgaggacctatatggacccatccgtaacaagtacgtcatcacactgccaagcttcaagaatgaatccatctatacggatatcaaat

SEQ ID NO: 69121 - DNA, 423 bp, Zea mays
  unsure at all n locations
  Clone ID: LIB3078-054-Q1-K1-D8
cggacgcgtgggtccggacgcgtgggctggctgttcctggcgaggaagttgtccctgacagatgggcgtgggacataatcatgcagtgcctgtgcgccatctgcagcgcgggcgtcgtcaaggggttccagcacgtgctgtacatgggcaacggcggcggcgcctacgtcgtcgcgcccggctacaccaagggcgacggcctcggcgccgagatcgtcagcaccttcatcctcgtctacaccgtcttctccgtcaccgacgccaagaggaacgccagggactcccatgtgccgatcctcgcccctcttccaatcgggtttgccgtgttcctcgttcacctggccaccatccctatcaccggcaccggcatcaaccccgcgcggagccttggcgccgncgtgatttacaaccagcaccatgcct

SEQ ID NO: 69122 - DNA, 232 bp, Zea mays
  unsure at all n locations
  Clone ID: LIB3078-054-Q1-K1-E1
gccgtctacgaccagaaggtcgtcccgttcatcacggaggagttcggctacaccaatgtgcaccaggttcccaagatcgagaagattgtggtgaactgcngtctgggccccgaaggcagggacttccaagggcttgattgccgccttgaagaacctggccttaatcaccggccattggcccttaaggaccaaggccagaaattccgtggccagtttcaaaatccgtgaggga

SEQ ID NO: 69123 - DNA, 373 bp, Zea mays
  Clone ID: LIB3078-054-Q1-K1-E10
cccacgcgtccgttttttttttttttttttttttaacggggcaaattaagatctgctggtggcataacattacgacaatagttcatccgttcgacaacaaattttggcacaacttccacaggttcagcacttgaacaatctaagttaccaacacaaggcattttaagttcagagaaaagtgagaaataaacacatggccatttctagtccatctttactccaacaaaaccttagatgctgctcgggtacatgaacactctgaccttgcgccccatggactcaggcgggaggttggacttgaacttggcacggacgacgcccgagtttccgtgcggacgggtgaccttgccccagatgcacctgtagcgggtct

SEQ ID NO: 69124 - DNA, 405 bp, Zea mays
  Clone ID: LIB3078-054-Q1-K1-E11
cccacgcgtccggtgatttgatctaccgtccagaggatgaagttcttgcagagctggagaatttcaaggctcatttggccagctgtgcaccgaagaattgagtcatgtgggttacctgcggaatgcaatcctgtggaaactgagtaggtgatgtagtttcatggccataagtatgagccccagttgacattgaatctgtcctctgatgctcctagagctgtacccttgaggggcttgtgcttttgtgagcttgtgttaaacctgctgtacgagtaaactagtatgtccgcaaacgcgtcagagccggatgtctgtgggccagctattgggatactgccggatatcgtcaacaattgttccagattggtgtattggatctaatgagattgtcagcaattgcttgtt

SEQ ID NO: 69125 - DNA, 401 bp, Zea mays
  unsure at all n locations
  Clone ID: LIB3078-054-Q1-K1-C5
gggtacccgcgatgaggcccgccgccgccagtaccggcgggttccatctcgtgctccgcgcggcgcacaggctgcctcctagtcttcctagcatcagtagccgaagaggtgtaaggatacgagcggcggcggcagcaggcggtggcggcgcgctgctggggcgtcccatggaggacgtgtacaaggtgcgcgtggagcgaggcgaggtggcgcgggcacggatggaggcgctgcgggtcatggagacgtggtcgtcgtggcgcacgggtggccggtgccggatgccgtgggactggcaggtcgaccagctcgtgtacatcgtgtccggngaggtgaaggtcatccccgccggcgctgtccacggcgacgactacatgcacttcgtggccggngatctggtc

SEQ ID NO: 69126 - DNA, 450 bp, Zea mays
  unsure at all n locations
  Clone ID: LIB3078-054-Q1-K1-B10
atcaggaaatggacctttgcagctatgttcagaatatgtgaggaatgttctcctgtgggggagtctacagggggctacactgctactaaattgatacttgatggatctgatgacaataatccttgtgataaggacctgctgcagaggaacaagataaatcaaaaataccaaggactgttcaaaggaaaaacaactaaatgccgacaccctgtacaaaagcaagaaccaggagatggagggctctttgaaggagaatgtagtagaacaagtcaacacgaagttaatggatcataagaagcgtagaaccaaggtaacattccgaagggaagtgtaatgcttgctcaaatttgttaactctnttttatgttcttctcatggaactcctcaccgacgccggttntatgctagctngaacactattcctccttagggttngatgaaacaacattg

SEQ ID NO: 69127 - DNA, 144 bp, Zea mays
  Clone ID: LIB3078-054-Q1-K1-B11
aatatatgcagaatgggccactttaagagagattacaaacgacaccagacctactaaaatgatactagatagatctcaacacaatcaaccttatgataagcacctcctccataagaacaacattaatcaattataccaactact

SEQ ID NO: 69128 - DNA, 436 bp, Zea mays
  Clone ID: LIB3078-054-Q1-K1-B2
ctcaggcattaccgtcagaaacatccacgtgttaacttgaaggcaataaagaattgggcaaggcagattcttcatggattggattacctgcatagccaccaacctccgattatccatagagacttgaagtgtgataatatttttgttaatggaaaccatggagaagttaagattggagatcttggactagctacagtaatgcaaacacctagggtgaggagtgttattggtaccccagaattcatggcacctgaactttatgatgaaaattatgatgagcgtgttgatatttactcatttggaatgtgtttgttggagatctttactcttgaatatccatacagtgaatgtacgaatccagctcagatttttaagaaagtatccacaggtgttaaacctgctgcattggctagaatttctgatctttaagtaaagc

SEQ ID NO: 69129 - DNA, 417 bp, Zea mays
  Clone ID: LIB3078-054-Q1-K1-B3
gcccactctatgcaaaactggggttcgacatattcggccttgggttcttgacctcccgggtgtgtatacttcttgttggaatctttgtgtcttcttgggtgggctcaactgtcttctgggtcggagaatggtttataaagaaaatgccctttgtcaggcacatatactctgcatcaaagcaagttatcactgctgtttcaccagatcacaatacaacagcattcaaagaagtagcaatcattagtcatccccgtgctggtgaatatgcatttggattcataacatcaaccatggttcttcagacagacaaaggtgatgaagaattgtgtagtgtatatgtgccaaccaatcacttatatattggtgacatatttttggtaaactccggcgaaattataatgcccaatttgtctattc

SEQ ID NO: 69130 - DNA, 354 bp, Zea mays
  Clone ID: LIB3078-054-Q1-K1-B4
tcgcaggaacctggagaggaatggcaggatcacctgcatgacgtttccccgggactggctggggagggacctgagcgtcatgggcttctggctcatcggctggatggggccgtgcagcgtgccgggcatcaacggctacagcctcacggggctcttcttctccagcatccgccaggagctggcccacttgcacacgctgtcgaccgtcacctaccagttctggctgtggctagtgacgtggcacctgtgcctgttcatcgtgctcaccttcagtcagatcggattcatgggcacgaccgatgactacttacagaagtgaagcggattagagcctattcattatgcctggtgctg

SEQ ID NO: 69131 - DNA, 342 bp, Zea mays
  Clone ID: LIB3078-054-Q1-K1-B5
tgtatcgtgcgccgacactttagctttcacccaacggcatcaaattatgggaggccgtgtctttcaagaccgaatacgacatctttaatgattacttgctttactacctctggaacccaagcctcattcacacacagatcatcattaccatctgagcctaacaggttgttctgatgggatctggtgatcgctaccataatctactttgcccgtatcatgaggtcgtagacccgttctacctcctgctcagctacgacccgctcgggcttgatacgacctgaaggccttcttcgagctcaaagacaatgagctcaagaactgtctactctccatgatctccat

SEQ ID NO: 69132 - DNA, 430 bp, Zea mays
  Clone ID: LIB3078-054-Q1-K1-B6
cccacgcgtccgcgcagaccaaagagcacattctcctcgccaagcaggtcggcgttccgaagatcgttgtcttcctcaacaagaaggacatggtcgacgacgaggagctgctcgagctcgtcgagctggaagtccgcgagctgctcagcaactatgagtacgacggcgacgaggtgccaatcgtcgctggctccgccctcaaggcgctcgaggccctcatgggcaaccctaccctgaagcgcggcgacgatgagtgggtggactgcatcttcaagctggttgattctgtggattcctacattccagtgccacagcggcagaccgacctcccgttcttactcgctgttgaagatgtcttctccatcaccggtcgtggtacagttgccactggccgtatcgagcgtggcaccgtcaagattggtgacacagt

SEQ ID NO: 69133 - DNA, 334 bp, Zea mays
  Clone ID: LIB3078-054-Q1-K1-B7
cccacgcgttcggcaagactttacatatgatcggctcggagcgcatcatgtgagggcgtgtcacaattgaccggatatcgctttgaagatccttacttggattaatactgatgactgcgaaggaacctatcattgccctgtacaagatggcattaacggacgagcctattatgactacatctcgtctgcgcacggatgaactactgtgtgtctaacatctactgataatggtctatattaccctgaccagacgacgtgtcattcggtggagattgatgctgaatatgatcattgggcagttcgatcatctttgtacgagctgcataggactggt

SEQ ID NO: 69134 - DNA, 395 bp, Zea mays
  Clone ID: LIB3078-054-Q1-K1-B8
gaaacaagttggaaattattactctaccaagatatggagcttcaccatgaaatcgccctgttgcaagcatgaaattgtcatacagacagacccaaaaaatactgaatatgtcataatcagtggggcccagaagaagacagaagattttgatgttgaggatgcagagacattgctgctgccagcagatgaagatcgagacaagcttgcggatcctatgtaccggcttgaacaccaggaagaggatcttcggaagaaaaaagaagctgagccagttttagttcgccttcagcgactctcggacagccggcactctgatgattatgccctgaacagagcactccgcgatcgtcttaggagccaaaaaaagagagttgctgaagagaagaagtccgcga

SEQ ID NO: 69135 - DNA, 414 bp, Zea mays
  Clone ID: LIB3078-054-Q1-K1-C1
cccacgcgtccgagaagcaggaggcgctcgaccggcttggcgccgacgccttcgtcgtcagcaaggacgccgaagaaatgaaggcggctgcgagcaccatggacggcatcatcaacacggtgtcggcgaacctcaccttggccccgtacatgggcctgctcaagcccaacggcaagatgatcatggtcggcctgcccaccaagcctctcgagatcccgccctttgatctcatcattgggaacaagaccctggccgggagctgcatcggcggcatgagggacacgcaggagatgatcaacgtggcggccaagcacggcgtgacgacggacatagaactggtggccgcggactacgtgaacacggtcatggagcgcctggccaaggctgacgtcaggtaccgcttcgtcatcgaca

SEQ ID NO: 69136 - DNA, 451 bp, Zea mays
  Clone ID: LIB3078-054-Q1-K1-C10
ggcagcagcaaccgcagtcgcgagggccaagcaggggggacaaggaaaggggccgacggggaggaaaaaggaagaacgcgtggcggagccatggggcttggccttggcgtgcgggcggcgcccttcacgtacgcggcgcacgcactggccgtcgcggcggcggccatggttctcgtctggtccatccagttccgcggcgggctcgccatcgagtccaccaacaagaacctcatcttcaacgttcaccctgttcttatgcttatcggttatgttattatcggcggtgaagctataatggtgtacagggtacttccaacatcgaatcatgacacaactaagctgatccatctaattctccacgggattgcacttgtccttggtgcggttggaatatactttgctttcaaaaatcacaatgagagtgggattgccaatctttacagcctgcact

SEQ ID NO: 69137 - DNA, 438 bp, Zea mays
  Clone ID: LIB3078-054-Q1-K1-C11
cccacgcgtccgctgtgaagcacttctctgtggagggtcagctggagttcaaggctgggctctttgttcctaagagggccccatttgatctcttcgacacaaggaagaagcaaaacaacatcaagctctatgtgcgcagggtgtttatcatggacaactgtgaggaactgatccctgagtggctgagttttgttaagggtattgttgactctgaggaccttcccctcaatatctcccgtgagactcttcagcagaacaagatcctgaaggtgatccggaagaaccttgtgaagaagtgtgttgagctcttctttgagattgctgaaaacaaggaggactacaacaagttttatgaggctttctccaagaacctcaagcttggcatccatgaggactcgcagaacaggggcaagattgctgagcttctgagataccact

SEQ ID NO: 69138 - DNA, 447 bp, Zea mays
  unsure at all n locations
  Clone ID: LIB3078-054-Q1-K1-C12
cacgtgctgaaggtgatttaagagaagcttggcacggcgaaccccgacggggaggacgagaagaagcggctggcagagctgctgaaggaggcggggcggtcgcggaaccggaagcagaagtcgctggagaacctgttcggtaccaactcacagcgggcgaagaaggaggccgggaggaggtggtccaacttcgggttcaggagctgagctgaggtgccctttttgtttgtaacattaaaaaaaaaggcacgtgtaaagatgttgctgtaggtgagtagtattgttagcaaggtgggtggtgattatgctgtttgcttggcactgcattgctgttactgttttgggttattttcgagttaaaatttgtttttttattattaactgcgagctgagctgctgtacccggatggatggagaaagagtctntgtggtgttgactggtgagtg

SEQ ID NO: 69139 - DNA, 329 bp, Zea mays
  Clone ID: LIB3078-054-Q1-K1-C2
gagacacgtgtgcggacgcgtttgcaggtgatagccgtaaaagctgcacatactgtggttgagccttctgtaatgcggttgctgatgatgcacatgaatgcttacacggccagggtcatgaaggcgtacaactatttgaggagctatatctgtgacctgacaagtgcaatcgagcccactacgtctaagacgaagactctgtaagtaataatactcatggattacaaactgtctggagcttgacaacgtggagaatctgacggtgttgcagagatagaaacactgagtatcttgacggacccattcggaagtacttctgatactgtgac

SEQ ID NO: 69140 - DNA, 326 bp, Zea mays
  Clone ID: LIB3078-054-Q1-K1-C3
aggcgacgcgtgggtgcggttcggcagcatagcaagaagagaaccagtgtgctagtgctgcgagctgcggcctagctacctactacggcgcagctagcagcggcggacatgagcggggggcgcgaggagagcaccagcagcaggtggccagagctggccgtcctgcgcgcgctggcgcgcgacgcggcggcccgggccgggagggagacggcggggtggcgcggtccggagcgggaggaccaccgtcacgggcacggtcacggcaagacggccaaggtcatgcacctgctgatctggggacccaagtgaggtgaagcgaatcgctg

SEQ ID NO: 69141 - DNA, 420 bp, Zea mays
  Clone ID: LIB3078-054-Q1-K1-C4
gatgaactcaatgcactacaaagcaagatggaagaaaaactgcaggaagagaagcaggttcgccaagagttaagagtgttacatgatgagcttgatgacctagaaagccaaagactttctataaaagaaagaaaggatgctgtcaagaagaaaaagaaagacacacagaaagcagaacgtacgctttccatgtgtctgtcggttacaaatatcatcccaaatttggaagaccaggataaggtttcaggatatattgtcgaccagaacaggaagaagatagagaagtttgaattcgagaacacgacgccaccagttgagatatgcgacgagctctggaagaagatttagcgtgtttcagatcattcttgttgtaaggcggcggaaacctgtgcctgtagattgtcgcggtgtggttgatgc

SEQ ID NO: 69142 - DNA, 316 bp, Zea mays
  Clone ID: LIB3078-053-Q1-K1-H11
gccaaatttggtgtcactgtgggcaagatggattggcttcaagatcggagttcgtggtcagtagctagcctggatgggaaagatctaggctattttgattatgttgtggcgacagataagaacatagcgtcaccagcattttctgggttgactggaagaccgccacctcttgatttgtcgtcatttccacgcctgcctacagcacttcaagatatcccagttcgtccatgttttgctcttatggtagcattctcggagccattggctacggtacctgttcatggtttctctttcaacaattccaattctctgagct

SEQ ID NO: 69143 - DNA, 217 bp, Zea mays
  Clone ID: LIB3078-053-Q1-K1-H12
gcagtatatataccgggaacaacggagcctgttctgcagagcgcgtgctggaccgacgcgggtggtttcacttcgtcgaatgtggtgaactatcttctatttgggggactatacacagagcaccgtgccctgcgcgaccctgttgctagcaataatgcgcattatactgtgcacgaacgagctgagacatgggtgcagacttcaatgctgatctgat

SEQ ID NO: 69144 - DNA, 113 bp, Zea mays
  Clone ID: LIB3078-053-Q1-K1-H2
acggaaatatgtgcacgtggagtctgtagctacattgaaccctgggaccatatcgaaccctgtcgcagcatgcaaataggaggtgtgacctaagaagctaacttcgatcgaca

SEQ ID NO: 69145 - DNA, 466 bp, Zea mays
  unsure at all n locations
  Clone ID: LIB3078-053-Q1-K1-H3
ctcaaaaaagagttctgctgcaatggtactgtagtccaggatccagagctaggccagggcattcaactgcaaggtgatcagcgtaaaaatgtcgctacttttctagtccaggccggaatcgtgaaaaaagatagcatcaagattcacggattttagactgcaaatttgaagtgcttgtgtgtgcctatcatatgataccatatgataccaggtattgaagcttcggaagcttgttggccttcgtaacatcagtagtcgttattcatctgaatatgtgtcattatttcatttgataagactggtattgatgcaagttgtccttgcagtatgttttgtaagtgttacctgcatgaaagtatcgtttgtctgcggagctgtctgctactgatattgaataacaagagagattgcntgttgtaattcgtctatgaattattatgaactttccccagacttgagctttaca

SEQ ID NO: 69146 - DNA, 393 bp, Zea mays
  Clone ID: LIB3078-053-Q1-K1-H4
gtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatctcgcaaaagattggaatgctgtgtttgaaaggagcatcaatacattgtttttgactgaaatggtccgtggcttgatgctaactctcaagtacttctttgatagaaatgtcacaattaactatccgtttgagaaaggtcctctgagcccccgcttccgtggtgagcacgctctcagacgttatgaatctggggaaaagcgct

SEQ ID NO: 69147 - DNA, 430 bp, Zea mays
  Clone ID: LIB3078-053-Q1-K1-H6
cggacgcgtgggcggacgcgtgggcggacgcgtggggctagctggtcaccagttgttgacatatacatcagcaagctccacgaaagcaagaagaagaagaaacatgacgaccactgctgcggtcgtcaagctcctgacagccgtactcctcttcttcgccgtctctcttcggggtaccaagggcgagccatgcggcacgtccagcatccacgtgcagaccgtcaacacgggcgcgacggcggctgccggcgacacgctgttcgaggtccaggtgaaaaacctgtgcttatgcagcgtcaggaacgtgcgcgtggacggtggcggcttcgcgacgacggtggaggtcgacccggccctgttccgcccagtggacggcggtgtctacctagtgaacgccggcgagtccatcgcgagcatgggcatcgtgagc

SEQ ID NO: 69148 - DNA, 456 bp, Zea mays
  Clone ID: LIB3078-053-Q1-K1-H7
cccgcctccccaccgccgtgcggttccagcgccagcgggggctcaccaccaccgcgctgctgaagaccgccgacctccagcccaaggagcagggcaagcccgagacgctcgactaccgcgtgttcctcgtcgacggcgggggccggaaggtgtcgccgtggcacgacgtcccgctgcgcgccggggacggggtgttccacttcgtcgtcgagatacccaaggagagcagcgccaagatggaggtcgccaccgacgaggccttcacgcccatcaagcaggacaccaagaagggcaaccttcgatacttacccgtccaacatttactgggactatggggtacttcctcaaacatgggaagacccaacttctgcaaattctgaagttgaaagagcatttggggataatgatcctgttgatggtggtgagataggtgaaaggcgtgccaatgtcggggat

SEQ ID NO: 69149 - DNA, 385 bp, Zea mays
  Clone ID: LIB3078-054-Q1-K1-A1
gtgggatcggggacggcgacggtggcagcaaccgcgccgccacggacgcccactaccggcagatgatcgaggcggacccgggcaactcgctgctcctggtcaactacgccaggttcctcaaggaggtggccggggacgcggcaagggcgcaggagtactgcgagcgcgccatcctcgccagccccggcgacgccgaggcgctgtcgctctacgcgggcctcgtttgggagaccagccgcgacgctggccgcgccgaggactactacagccgcgccgtccaggccgcgcccgacgactgctacgtcctgggctcttacgccgggttcctgtgggacgccgaggaagacgaggaagagaactccgagcccttgccaccgccttcgct

SEQ ID NO: 69150 - DNA, 451 bp, Zea mays
  unsure at all n locations
  Clone ID: LIB3078-054-Q1-K1-A10
cggacgcgtgggcggacgcgtgggcgaatagcgcgccgccgccgctccgtctccacctgtattttctgcccctcgcctcccccataccggggcccggtaaccagcatccctcggcagccgctgccgaccgatccgtgtccgtgcgagacgcgggagggattggcgccggaggctgaccgggatgttctccggcgactggacgccgccgtgcggcagctgctgcaccaagaaatacgcgagcctcgtgcagatcccatggagggtgttctgcaagaaggggtgcaacgcggacggcgacacctgggacgagtgcataggaaaatgtactgaaatatgctacaaagatccggtgttagaagatcgccagtggagcgcttacattgaccgatctccagggcaggatagttactctntggaatgcttcaatgcttgtgtgtctggctgtggattc

SEQ ID NO: 69151 - DNA, 459 bp, Zea mays
  Clone ID: LIB3078-054-Q1-K1-A11
ccgggcggacgcgactcgtgcgggggatgtcataaagtgactacgacctttcgctcccggcgatcgcgaccgagttcctggggctcatggtggcgctggacaagctctacttcacgccgctaggcaagttcatggatgagcgggacgccaagatccgcggtgagctcggcgatgtcaagggcgcctccgaggaggtgaagcagctggaggaccaggcggcggccatcatgaaggcggcgcgcgccgagatcgcggcggcgcttaacaagatgaagaaggagaccaccgcggagctggaggccaagctggacgagggacgcagccgtgtggaagccgagctcgtagaggcgctcgccaacctcgaggcgcagaaggaggaggctgtcaaggcgctcgacgcccagatcgcctcgctcagtgatgagatcgtcaagaaggtgctcccatccgcgtgatgaa

SEQ ID NO: 69152 - DNA, 419 bp, Zea mays
  Clone ID: LIB3078-054-Q1-K1-A3
gagccacgcgtccgtccacgcgtccgacggatctcagttttacataactactatcaagacaagctggttggatggggagcatgttgtcttcggcagggtgatccaaggaatggataccgtgtacgccatagaagggggcgctgggacttacaatggcaagccaaggaagaaggcggtgatcaccgacgctggtgagatacccaaggagaaatggggtgatcaggaagcgtagggtgttttctacttcttgtcaccttcaaatcaggtagccatgtacttcttttttccttgacctccatggtgtgccacggttcagcaagacttccggaatgttgtatatcgtagctagcttatggccagtcgaattgactctgatcccttgagttgtgatgtggagacgcatacatctgaaaaatctt

SEQ ID NO: 69153 - DNA, 439 bp, Zea mays
  Clone ID: LIB3078-054-Q1-K1-A4
ggcgcatcatcgacatcacgcacgcgtacgtgccggaccttctggcgttcgcgccgggggctgtcacggtgcccttggtccacctcaaggagtccatggcgaacgggtccgagtacaacctgtcggagctgcggttggagtgccacatgggcacccacgtcgacgcgccaggccacatgaaccaaggccacttcgccgccggcctcgacgtggacacgctcgacctcgacgtcctcaacggacctgcgttgctggttgatgttccgagggacacaaatataacagctgaagcgatggaattcctgaatatccctagaggagttcgccgagttctattcaggacgctgaacactgacaggaagttgatgtggaagaagggaggtgacatgagctatgttgggtttacagaggatggcgcacagtggctagttgacaacac

SEQ ID NO: 69154 - DNA, 412 bp, Zea mays
  Clone ID: LIB3078-054-Q1-K1-A5
cgcgtccggctccttgtgtcctcttctttgatgagcttgactcaattgctactgagagaggaagcagtgtgggtgatgctggaggtgcggctgatagagtgcttaatcagctactgacagaaatggatggcatgaatgccaagaaaactgtgtttattattggagctacaaacaggcctgacatcattgaccctgctctgctgaggccagggcgtcttgaccagctgatctacattccactgcctgatgagcagtctaggctccagatcttcaaggcctgccttaggaagtcccctgtggcgaaggatgtggacttgaatgctcttgctaagtacactcaagggttcagtggagcagatatcacagaaatttgccagcgtgcgtgcaaatatgcaatcagagagaacattga

SEQ ID NO: 69155 - DNA, 290 bp, Zea mays
  Clone ID: LIB3078-054-Q1-K1-A6
tcgtccactcgtccgcccacgcgtacgaaattttgtactgtctcagatttgaaggatccaaacaagaaatttaattttactagatttgaaaggaattggtttgagaagtaaaaaaaaaaaaaaaaaaaaaaaaaaaaaaaaaaaaaaaaaataaaaaaaaataaaaaaaaaaaaaaaaaataaaaaaaaaaataaaaagtaaataaaaaaaaaatatataaaaaataaaaaactgttgacgaacaattagaagatagtaaaaaaatataattgaaacaaaaaaaattgga

SEQ ID NO: 69156 - DNA, 410 bp, Zea mays
  Clone ID: LIB3078-054-Q1-K1-A8
cgcctttaaccgagtttgaccaccctgagaaaggagatgctctgtacgctatggagctggctctggccctggaaaagctggtcaatgagaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataataatgggtcaactgacaactctgggtcggtggatttgtagttggtttgggttttttagttgta

SEQ ID NO: 69157 - DNA, 296 bp, Zea mays
  Clone ID: LIB3078-054-Q1-K1-A9
aagtactcgttcgaccgacgcgtacgcccactcattcgcttgtgcaatagtcattaatattgcgtttgagtcagcgaagcttagggggtaaaaagcttattcatgttcggactttaactttgatttatgttctaaagtacttgaaagacttttcctgtggtaattctaagcgtaagttgctgagctggttgaggtttactggtgaaccaaagtttctctattccactatgaatacgttacctcaagttacctgcatattcactgttatgacgattaaaaagaagaaaaaagacttg

SEQ ID NO: 69158 - DNA, 404 bp, Zea mays
  unsure at all n locations
  Clone ID: LIB3078-053-Q1-K1-H10
cccacgcgtccgcgcgctgctcgtggacgcgctgtccccgctcggtgacgacaacgtcgggggcgggcagggcgccatctacctgtgggcgaagctcccggacacctgctccgacgatttcgaggtcgtcaggtggctcgcgaacaggcacggcgtcgccgtgatccctggcagcgccagcggaggccccgggcacatccgcatctccttcggagggctcaaggaggaagacaccaggctggccgctgagaggctacggcgcggcttgcaggaactggtggctgatggaacggtacagtaacggctccattggtgtaagtaaaaagcacagcattgtaattttacacaacgactncgatttttcaatggcataactccggcgggattgattcgagagaagaact

SEQ ID NO: 69159 - DNA, 408 bp, Zea mays
  Clone ID: LIB3078-045-Q1-K1-G9
cggacgcgtgggttgggggccagcctgagttcgtccaggtcgacacccgcaacgcaggcgtgttggaggaagcgctgcagggtcagtatcatactagcagtcatgtggtagctgttcgcggagttgccaaaccggaggcagctgcgacgccggcgaggcgctcgcgccccatccctctggcttccgtggccgtgtggagtctggttgccactggcgccgcaaatgctgccgagctatgggaccccttggccctgcacggatcatcaggactcgtcttggctgaccttggtattggagattggtttgggggtttgctgttttcagctgggcagcaggctaatgaggctgtccaagatcagttgtctgctcttagtttctctagcctagcagttatttttggtgctggac

SEQ ID NO: 69160 - DNA, 122 bp, Zea mays
  Clone ID: LIB3078-045-Q1-K1-H1
accacgcgtacgtccacgcgtccgcggactcgttggctaacacctcttccgttgcgaggggcaatcggatgctgtacaagggaatctatcctaccataaatgatgaatacatcagatacaat

SEQ ID NO: 69161 - DNA, 326 bp, Zea mays
  Clone ID: LIB3078-045-Q1-K1-H10
attgaaggaaagggggaactctgctggtcttgatgaggatctccacgtgagataggaaggcgtgtgcagatgtcgccttatggtattgagttgaggaaacttggaagttccattacttgtctgtagtctatactttatctagatgcgaagaagcttgagatacacattgactacaatgtcttttgatgaataataccagacagcaccgaaccgaactcgtcctacacacggtagctttgccatctaggtagttctgtcgtggtggagatggtcgtgctgcctataagtctaaggctaatggcatggatgacatttatacaagctct

SEQ ID NO: 69162 - DNA, 457 bp, Zea mays
  Clone ID: LIB3078-045-Q1-K1-H11
cccacgcgtccgcttggtcgagcattccactatgttgatggcatcattccgttcagctgtggtggtgctgatttcccagttgatgacattgctgcggcatgtctcttggtttattatggggttactacattacttgatgcagcctcaggtgatgatgaaaagatcaatgaggagcaagaggaggctgagttagcagtatcgaaattttctggaaatggtgcgggggtcatgtctgctgctggtactattgctagcacattcgtattggtttttgttgctgaatggggtgataaatcatttttctccacaattgcactagcagcagcttcatcccctctgggtgtcattgcgggatcactagctggtcatgccattgcaacattgattgcagttcttggtggctctttgctgggaacattcctgtctgaaaagattatagcatacattggagggagcc

SEQ ID NO: 69163 - DNA, 209 bp, Zea mays
  Clone ID: LIB3078-045-Q1-K1-H12
tctgactcgtgggctgtgttcccggccaattcttgcaatgaccttgtcgtcaagttctcgaaggctctttccaagactgcggctccaatgaacttgctcacgcctgaaaaccctgatccattcatttctgttcaccacgctatgtacgtatgtgtagcatatggtttacatctacctgttataaccccgagagctggagaaactagcta

SEQ ID NO: 69164 - DNA, 186 bp, Zea mays
  Clone ID: LIB3078-045-Q1-K1-H2
tccacacagtgccgatactgtaccacaagtatcaggaccacgtggacgatttcgccgcagaggcacacatggagctctgggagcaatacgcggtcctggatgccaaagttctgagcaagatcccaagagcttcaccaaaagataagaaacagaacttgaacctggaggatgacaagcgccttggtt

SEQ ID NO: 69165 - DNA, 443 bp, Zea mays
  Clone ID: LIB3078-045-Q1-K1-H3
gacaaatacgtggagacacagcagcttctcctccagatcgctgggcacaaggatattctggaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagctttcggatggtggcgttttgtcagttttggatggaaatgccgaactggcagcgtctgttttccctatg

SEQ ID NO: 69166 - DNA, 293 bp, Zea mays
  Clone ID: LIB3078-045-Q1-K1-H4
cggactgcgtgggcttgagcctgcacctgttgtcgttgttccacggcgtatcgtcggttgagtgccgggggcgatggcggcgggcgcaggtggttgcttatggcggtcctgcctgctatccaatttattcagggcacggacgatcagacggtcccggtcgtgctgctgacctagttccgcgacggcacctacggcgtggccgtctttcgttttcaacgtttctcggtgttttactcgtctgcttgatctgggctacattacgggcttttacatggtggacgactagggcgtgc

SEQ ID NO: 69167 - DNA, 276 bp, Zea mays
  Clone ID: LIB3078-045-Q1-K1-H5
gccgtggaagggcagggctgcatcacgccgctgagcctgaagcggatgctcgccaggctcggctcccaccaggacgttgccgagtgcacggccatgatctgcaggttcgacctcgacggcgacggcgtgctcagcttcgaggaattcagggtcatgatggatgcatagctaacggattgtgttgtgtgaatacgtgtgattatttacttgctgcttgtttttgcctgtcgtccgaattcaaacgtcaattaattactactagtttgtttctgtgtc

SEQ ID NO: 69168 - DNA, 297 bp, Zea mays
  Clone ID: LIB3078-045-Q1-K1-H6
cccacgcgtgcgcccacgcgttcgcgcgagcggacggccttttgtttttcggttacacgcgatcatgctaccagcttcaaaactaaacgaacacaggacgacacaaacatgtttcgaacattacagacaaacttaaaggatcaccacgacaggcaacttgatcaactaaacgatgcatatatcctacttaacagtattgcagtcacatagatgcagaggatagcataagaggtcagcaaggtgccatcagtgaggaaactactggggaattaaacacaaagccatagctagatctac

SEQ ID NO: 69169 - DNA, 270 bp, Zea mays
  Clone ID: LIB3078-045-Q1-K1-H7
gcccgccgactcctgcatcatcataaatatatatactataactatactactacgtacctaccgatatgcacccgagcaatgtgaatgcgtcgagtactatctgttttctgcatctacatatatataccggatcaacaatcgtccaatgcgaatgtaatatgcaatatcattttctaccacttttcattcctaacgctgagctttttatgtactatatcttatatgatgaataataatatgaccttcttgtgatctaataatttataaaaa

SEQ ID NO: 69170 - DNA, 243 bp, Zea mays
  Clone ID: LIB3078-045-Q1-K1-H8
tccacgcgtccgcaggcctggagcggcattccgtggttcgaggccggcgccgacccgggcgccatcgcgcccttctccttcggctcgctgctgggcacgcagctgctgctcatggggtgggtggagtcgaagcggtgggtggacttcttcaacccggactcgcagtccgtcgagtgggccacgccctggtcccgcactgtcgagaacttcgccaacttcaccggctaccagtgctacccgggc

SEQ ID NO: 69171 - DNA, 199 bp, Zea mays
  Clone ID: LIB3078-046-Q1-K1-A1
ccgggggcctggtcgccaagccgatcctgaccaggcctcgaggctgttcggcgtctctagcggcatgaagcggatgcgcgacgacgacgacaccggcgaggaacaagccgaccaccgggccccaaccgatgggaaaaccggagccttcgatcccgaaccatcgcatggagccgtcgccgaagtcgccggaccagcatcc

SEQ ID NO: 69172 - DNA, 334 bp, Zea mays
  Clone ID: LIB3078-046-Q1-K1-A10
cccagccttaggctcacgcagtagatcacctagcctaagacgcctctcaacaggcccatgcgacacgtacctccagcatgtgaccaggactggcagtattggaactgtacacaacggtaacatgctacactgtcgacaagaaacactgccatggaattaaccaccaatacagctcaccagactactgaggcgaagactgaagatatgcactacaagacgcatcaggatgctgcactagtcaacatactcgtactcatgctctcgaaccctattccgaccgatctcaggctgctgttggcttgtgttagaagctaggacgctcgatcaaaggaga

SEQ ID NO: 69173 - DNA, 439 bp, Zea mays
  Clone ID: LIB3078-046-Q1-K1-A11
cccactcgtccgaccacgcgtccggtgcacagactctggcacggctcaagcggagcagcgtacactactgaatgcgattgacgtgctctttcaggagtccgtcttgacacaacatcaacatgctacatctcgacaagagacagtgccactggattatgtaccaatacagtgcagtaagtccagacggccttaagagaagatatccactacaagatggatccggatccggcactagtgagcctactcctactcctgcgctcgtgaccgatgccggccgtgcccagtttgcagctggcttgtgttctgagctcccacgcttgatttgtggagaatttcggcgatcagctccgtcgctaccatctcacgagtcacgaactacatccgcttccatagaaacatgatatctagaatcctaagtcatgaatcctgagtcagaaac

SEQ ID NO: 69174 - DNA, 426 bp, Zea mays
  Clone ID: LIB3078-046-Q1-K1-A2
gaaaaagataaagagaaggaggatcatatatataagaaagacaaggatcacaaagaggaggaggtatagaataaagagaaggaaggcagccagctacacaaggagctcaaggcgggtgtcgccgacatggtgcacacgctcagctcttcggcaccgtcatccgggggcggccacgagcgtgctgtctctgcggcggcgggaacaacaatcatcactctggccggccagaacaaggacacgtccatgaaggttgacagcaatgccgtagcctacggcacagcggacgctgtacgcatcaaggagcgcctcggccacaagctcgactgcagcgtcatcgtgagcgggaaggagcaagctggggccgacaaagggctgacagctttcgtcaacagcaacgtgcaggtcatcaacaacttgcttctgctg

SEQ ID NO: 69175 - DNA, 431 bp, Zea mays
  Clone ID: LIB3078-046-Q1-K1-A4
gtacgcacgcaccgggacaccagcaaccctcaacagcgccactgtccagtgcgcgcgtcgagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcg

SEQ ID NO: 69176 - DNA, 320 bp, Zea mays
  Clone ID: LIB3078-046-Q1-K1-A5
cccgcaacggcgtcaagttcggcgagtgccgtgtggttcaagggccggttcccagatgttgggcttgggcgggctggactacctcgggaacccgagcctcatccacgcgcagagcatccttgccatctgggcctgccaggtcgtgctcatgggcgccgtcagggctaccgcatcgccggcggcccgatcggcgaggtcgtcgacccgatctacctaggcggcagcttcgacccgctcggccttgccgacgaccccgaggccttcgccgagctcaaggtcaaggagctcaataacggtcgtctggccatgttctccatgtt

SEQ ID NO: 69177 - DNA, 433 bp, Zea mays
  Clone ID: LIB3078-046-Q1-K1-A6
cgcgactcgggggacatctacatccatgagtatcggacctggatagtatgcgcgacgagggcgttttgatacacatcctgcgctctgtcgcactggactgagacgagcacgctgttgttgatggtgctgatggtagttggatgtgccgagggcagctggtggtctgaagtcataaagcccggtacattcaacagccacgagctgtcgccgaggtgcacgcttaccggcaccagagcgagtaacgctacctggacgtcgtctgacacactagcgtgcagcgggacctctacggatatgacgcacgatctgcgtacaaccgagttcagagccagacttttagacggctgggctcctgtgaccaagagaggcctgctgagtaagttgctgctgctcggtggacgatcacttttggcatacgtgagagcgtcggcat

SEQ ID NO: 69178 - DNA, 369 bp, Zea mays
  Clone ID: LIB3078-045-Q1-K1-E4
ggcttacctacaccagaaagatcatcgactccatccactccggcgagctcctcaccgtggactaccagaagaccgatgtgtgttgcctggagatccccactgagatcaacggcgtgccgtcggaaatcctcgagccgatcaacacctggacggacaaggccgcgtacaaggagaatctcctgaggctcggcgggctcttcaagaagaacttcgaggtgttcgccagctacaagatcggggacgacagcagcctgactgacgagatcctcggcgcaggccccaacttctgaactaaagcaatggatccggatgaataaaacgatggcgtgcgtgcgtgggtgcgtgtgaagatgattacgacgacgacga

SEQ ID NO: 69179 - DNA, 447 bp, Zea mays
  Clone ID: LIB3078-045-Q1-K1-E5
gccgcatcgaactctacctgcctttctctcgtccctggcggcggcggcaggatggcggcttctactgcgaggacggtgaaggatgtgaacccccacgagtttgtcaaggcctactccgcccatctcaaacgctccggcaagatggagcttcctgagtgggttgacattgtgaagactgcgaggttcaaggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccatttcacgcaacatcctacagcagctgcatgagatgggcatcattgatgtcgatcccaaaggtggacggtgcataaccttccaaggaaggcgt

SEQ ID NO: 69180 - DNA, 429 bp, Zea mays
  Clone ID: LIB3078-045-Q1-K1-E7
cggacgcgtgggcggcagcttcgaccccctcggcctggccgacgaccccgaggccttcggcgagctcaaggtgaaggagctcaagaacggccgcctcgccatgttttccatgttcggcttcttcgtccaggccatcgtcaccggcaagggcccgctcgagaacctcgctgaccacatcgctgacccagtcaacaacaacgcatgggcctacgccaccaacttcgtccccggcaactaagctcaacggctatgctatgcgacttcattgtctttcggatcggagagggtgtacgtacgtggattgattgatgctgcgagatgcatgtgtgtcttttgtttcacgttgcattgcataggcaagtcgagatgatgagttggcgttgtacactaagatgaaccatgtttgtgcaatagtggtggtttttgttt

SEQ ID NO: 69181 - DNA, 177 bp, Zea mays
  Clone ID: LIB3078-045-Q1-K1-E8
attttgtgcttgaaatttgggtaactaggaccgggcagaacatatctatggggtgggctgatggcactgacatctgaacatatgccctaagtctgttgtaatcgcaaaatatttttgcttataaaatcagttaataaaaaaagaaaaggaaaaaataaaaaacataaatgataacat

SEQ ID NO: 69182 - DNA, 201 bp, Zea mays
  Clone ID: LIB3078-045-Q1-K1-E9
ggaaaagctcaatgagaggattgcgaagcttgctagcggtgttgctgtcatggacgtgggagcacaaacagaatctgaactaacagagaagaaattgagagttgacgatgccctaaatgcaactaatgctgccgttgatgaaggtatcgttgccggtgcagggtgcactcttaggcggcttgcaccttacgaagaccccat

SEQ ID NO: 69183 - DNA, 304 bp, Zea mays
  Clone ID: LIB3078-045-Q1-K1-F10
cggacgcgtgggttacgaaccaacctctgaaggaccttggcgtcaagttcacgccagtgcatgggtacctgtacgaagcagtgaagtcccttcaagacaaggggttcctcccgaagacatctggcgccaaggtgcctgaacgacgcagctgcctgcctcaaacgacatcacagccaccacccgaaatcgtttcgaaactttgaggtggatctgcacacgtgctcaaactggccatgtgtttttttgtcagaacaagccgttcatttgattggttattaaaagattttgggcagtctgttcttag

SEQ ID NO: 69184 - DNA, 304 bp, Zea mays
  Clone ID: LIB3078-045-Q1-K1-F11
cgagaaagagatcgatcgtattcgtatccgcggaacaagcagcgaaggatcggagcctggccaatgggcgagggcaagagcagctccggcggcgacctgttctccagcggcaagctggtggcgggggccgccgtgtcggtgttccagcagaagagcgtggagaacgtcgacaagcaggaggtcgccggcgcggcggccgagctcctgcacgcggcgtccgcgtacggtaagctcgacgacaagccggccgggcagtacgtcgagaaggcccgagggtacctgaaggagttcagcgcgggacacg

SEQ ID NO: 69185 - DNA, 434 bp, Zea mays
  Clone ID: LIB3078-045-Q1-K1-F12
ggaactttcatggcctgggtggatgatgggagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttgg

SEQ ID NO: 69186 - DNA, 434 bp, Zea mays
  unsure at all n locations
  Clone ID: LIB3078-045-Q1-K1-G10
ggataacagcaacgaggagataaagcccgaggaggctcaggaagcttggaaggtaatgctggagcagttcaaggctgaggccctgcggatgcaggccctgtcaatgcaggcatatgatgtctactccaagagggcgagggaggtcttgctggaagcctctgagaagctgaagatacaggcagacaaagcacaaaaggacctcagcgtgatcgctaccgaggttagtcaggagggacaggaatatctggtgatggcagctcggaactccccagactcgatcaaggatattacaacaacgttcagggctcttgggagattgaattggccatcagagtatgaggattatcatgttggcattccgtttggtacctttcttacagtanggggtttcctcaacttcatgttgactggaagtacctctgcttctcgttttg

SEQ ID NO: 69187 - DNA, 421 bp, Zea mays
  Clone ID: LIB3078-045-Q1-K1-G11
caagaacggcgtcaagttcggcgaggcggtgtggttcaaggccggcgcgcagatcttctgggagggcgggctggactacctggggaaccccaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgtcgtcgagctcaaggtgaaggagctcaagaacggccgccttgccatgttctccatgttcggcttcttcgtgcaggccatcgtcaccggcaagggccccatcgagaacctcttcgaccacgtcgccgaccccgtcggcaacaacgcctgggcatacgccacg

SEQ ID NO: 69188 - DNA, 445 bp, Zea mays
  Clone ID: LIB3078-045-Q1-K1-G12
atgtttctaagccaatgatcgcagccggattacttcgatcattgaggttgttaggggatgcatctgtgtccttcgagaaaaattgtgtcaggggaattcaagcaaaccacaagagaatttcacaacttttgcatgagtctctgatgttagtgacatctttgaaccctaaaattggctatgacaatgctgcagctgttgctaagaaagcccacaaagaaggaaccacgttgaaggaggctgcattagaccttggagtattaacggagcaagaattccatgagcttgtcgttccagagaaaatgattggtccttctgattgataaccccatgttcactatgtttctttgaagcattcaggttgccacatccacgagttctggtggccctgtgtttccaagttaatgattctagcgcatccataaataaagcaaataatttttcatat

SEQ ID NO: 69189 - DNA, 395 bp, Zea mays
  Clone ID: LIB3078-045-Q1-K1-G2
acgcgtccgcggacgcgtgggcggacgcgtgggttccgagtcgtcgcatcaggtccgatcccctcgagtgcgccggcggcgccaccaaccagcaagctgccagagttccagatcggtcttggaacaattgttgtccagtctagtaatcttctttcacctcaggaggcacaacttgatggcaatgtagtcacagatttgccaagtgatcctatattgcacaacatgagaactcgaagggttcaagctgccagcatgggcatatcagaatcaagacaaaagcaagtctaccttattttactgataaacaaaggcagagttgtggccaaagggaagttagtgactacagatagccaaagagatatattaggagcaaagcttggaccataatattgtgg

SEQ ID NO: 69190 - DNA, 176 bp, Zea mays
  Clone ID: LIB3078-045-Q1-K1-G3
catggccgtctccggcttcaccgtctcctttctcgcctgcgccttcctggccagtcgaggggcgttgtgcaccagctacacgctaggcagccgagtgtcagataggaaccccatcattagcaggaacctgtagaggaatggcttgatcacatgcatgacattttcctgggactggc

SEQ ID NO: 69191 - DNA, 188 bp, Zea mays
  Clone ID: LIB3078-045-Q1-K1-G4
cggacgcgtgggttctcctgcccgctctttttctgcgtctgctgcttacgaccgaaccggagcccggagccctaactaaccctatgaggcaggcggcggctatgatggtgtactacacgctgttggtaggcgcggagctggatggccttaccaacctgcagtccctgcacggttgcaacgacctcaac

SEQ ID NO: 69192 - DNA, 442 bp, Zea mays
  Clone ID: LIB3078-045-Q1-K1-G5
gccaattagaaaagttgctgttattggtggtggtctgatgggctctggaattgctacatgacttcttgttagcaatatttctgttgtgctcaaggaagtgaaccctcagtttctgcaaaggggagagaaaatgatagcaggtaatcttgagggcctgataaaaaaaggttcactaacaaaggataggatgcacaaggccatgtcgcttttcaagggcgctttggattattcagatttcaaggatgttgatatggttattgaggctgttattgagaagattcctttgaagcaatcgatattttctgacattgaaaaaatctgtccgaaacattgcatacttgcgacaaacacatccaccattgatttgaatgttgttggcgaaaagacatattctcaagatagaattataggggctcactttttcagccctgctcatattatg

SEQ ID NO: 69193 - DNA, 447 bp, Zea mays
  Clone ID: LIB3078-045-Q1-K1-G6
ggaagaggtagatcatatgggagaggttatggtgctccacatggaaaggatgtgattagtattgatggagaatatgttcaccgaaatgacccaaatctgtcgccaagagaaggtgattggatatgccagaaccctaattgtggaaatctcaattttgctcggcgaactcactgtaacaactgcaacaagttccgctattcagcacgtgaagcatatgaacctaggcgcagccctcccttcaggagttaccccagccctccacgagggcctccaaggatggttggtccacctggtgatcgagcccctgcaagagagatggccaggtacagatcctcacctcatggttggtgagcaagtgatcccagggcatatgcatgtcgatcccctccagaacgtgcaggaccgtttacagatccatcaactaagggaagaatgggcttccgtggt

SEQ ID NO: 69194 - DNA, 445 bp, Zea mays
  Clone ID: LIB3078-045-Q1-K1-G7
cacgcagcagcagacgttcagcgtcatctacgacgtcgcgcaatccaggatcggcttctgggccggaggatgcagctgaatagctgatgggtgaactgattattgagctctatgaaaagggcagctcaagcttggtaatagaaaatgcgtacaaaacacaagtaaattcgctgaagtttatgaaatggtaatgttacaagctattgtattgttgattttacactcctgacaaattgtacatccttttacaggtaaattggagtgtctagatttttacatgtgtaaggtcaaaaacagaaatctgttttggatgatttggtctattatttatattgttacccttcaaaataaaaaaataagggcggtcgaccccagttcgatattcatttcttgcttgagtctggagttaataagttcatagcttttggatgtatactgtgattac

SEQ ID NO: 69195 - DNA, 397 bp, Zea mays
  Clone ID: LIB3078-045-Q1-K1-E3
cgctcaccatgatggcgtccttcgccgccgtggcggtggccgcgccctcgcgccgcgggggcttcggcgtgatcaggtccggcaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggccccaagaacgggacccccgaggcgaagaagaagtacgcgggcatctgcgtcaccatgcccaccggcaaggtctgccacaactgagcacgcccgcgttgcatctgcatggccggggggtggtatataattaatgtacgtgccacggagttggtggccctattgttggttcgagc

SEQ ID NO: 69196 - DNA, 421 bp, Zea mays
  Clone ID: LIB3078-045-Q1-K1-C6
cccacgcgtccgcccacgcgtccgcgtggcggcgcctcaggtgaaaaagatgctcagcgtaagggaaagctaactagcaaatggaagccgaccaccaaaggcacactgaaaagaacttacagagtacgatcaacggatgaaggaaggcgggtcctcaaggagatcgcttcagttctgtcccaagatgaccattttgtggatgcctcgtctcacaagggttgccaagttaggagggaaagtgctcatggcgaaagtgtttgctgctacaacgtgagagcgttgttcgatgagcttccaactcctcacctgcttctggagattacacctttccctgctggacaacttaccgacaacgactaccgaaaggcggagaggcttgagatggtgcttaggctcagcgcttctatttaaaaaactgggg

SEQ ID NO: 69197 - DNA, 426 bp, Zea mays
  Clone ID: LIB3078-045-Q1-K1-C7
gagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcagccgtcggcgccggcggctacgtattccacgagcaccacgaggagaagaaggaccacaagg

SEQ ID NO: 69198 - DNA, 386 bp, Zea mays
  Clone ID: LIB3078-045-Q1-K1-C8
tgcgtctcgtgcgcgatccacgctcacatcgtccgcgtccgatcccgtgagaagcgcagggaccgcaagccgccggagcgcttcaggcgcagggaggataggcctgctggtggacaaggaggcccccgccctggtcctggtgctgctgctacagctccatctccagcaccggttgctgctcgcccataggctttagcttttcgaccgtgttaagtcttctgcccactcagtttcggagttgtcccctgtgcgtgtgtgaagctgctatattagagttactttttgtctaaagtctgaacattttcgaagaatttgaatatctgaacatttgaatgtttgtgctgagtttttcaaagaatttgaatatctgaacaattgaatatttc

SEQ ID NO: 69199 - DNA, 245 bp, Zea mays
  Clone ID: LIB3078-045-Q1-K1-C9
tcccactcgtccgcccacgcgttcgtacagctctagtggaggaggaggaggggactattggaactgtacttggtgaaaggtgatggatgccagggagtacttgtacaggaagaggaagagagactcgtgtgattgtagtagaatagaatggaatggaacgtaatggattgcatgtgcaactgtaagcagctgcaaactgcaatacttgcagtggagtgatggacaactcaatttataagcaacct

SEQ ID NO: 69200 - DNA, 341 bp, Zea mays
  Clone ID: LIB3078-045-Q1-K1-D1
cccacgcgtccggtccatggaagtgatagtcctgataatggcaagcgtgaaattgaacggtggttcagagaaggcgagctgtgccaaaatgggaatcagttcaagcaccgtggcttatagaataactcttgctaatcatttccagagttgtattcaatgttttattttgtgttcgtcttgattcaaggagccatgcaagagtgtatgagtttagttcggctaagtaattagctcatgagggcttgaattatcggttctttttgaggattgatgatttgtgcaactgaaacctttgatcaattgctcaatgtgagaagctaatttcttgtcaaaaaaaatta

SEQ ID NO: 69201 - DNA, 230 bp, Zea mays
  Clone ID: LIB3078-045-Q1-K1-D10
cccacgcgtccggacgaccactccctccataacgccttcagcacctactgcgaggtcctgtagtccgagatcattctcgagcggtagacgcacacttcccgcggcttcggcttcgacaccttctccactgtggacgcgatgctgaactccatcgagggcatgaactgcaaggagctgaacagccgcaacatcaccgtcaactaggcccagtcccgcagcggccgtggagg

SEQ ID NO: 69202 - DNA, 233 bp, Zea mays
  Clone ID: LIB3078-045-Q1-K1-D11
gcggcttcggcttcgtcaccttctccactgtaggaggcgatgcggaacgccagcgagggcatgaacggcaaggagctggacggccgcaacatcaccgtcaacgaggcccagtcccgcggcggccgtggaggcggcggcggtgggtacggtggtggccgtggaggcagcggctacggcggtggctggcgccgtgatggctgcggcggctacagccgtggcagctgctactgtgg

SEQ ID NO: 69203 - DNA, 361 bp, Zea mays
  unsure at all n locations
  Clone ID: LIB3078-045-Q1-K1-D12
gaagcgcgagaagaactcgatcaagaagctcaccgcgtcgctgaagaagtacgcgcccggcagcgcggccgcgctcgccatcaacgccaccatcgagaagaccaagcgccggttcgagaactacggcaagttcgggctgctgtgcggcgccgacggcctgccgcacctcatcgtcagcggcgaccagcggcactggggcgagttcgtcaccccgggcctgctcttcctctacatcgccggctggatcgggtgggtcggcaggagctacctcatcgccatcagcggcgagaagaagcccgccatgagggagatcatcatcgacgtcgagctcgncacccgtcttctccccagggggttcatc

SEQ ID NO: 69204 - DNA, 236 bp, Zea mays
  Clone ID: LIB3078-045-Q1-K1-D2
cactcttcctgtccatttaacttatggttttgattattgcaatctttaaattcaactgtgcttcttaaaaggcgtatctgtgccaaaattttaatcacttcaatcaccctagcttatacaataactctttctaatcatttccatagttgtattcaatgtttttttttgtcttcatcttcattcaatcaaccattctttatttgtattattttatttcctctaacttatttatctca

SEQ ID NO: 69205 - DNA, 383 bp, Zea mays
  Clone ID: LIB3078-045-Q1-K1-D3
cggacgcgtgggcgacaacgcgcgctgggacggtgtgccgttcctgatgaaggcaggcggggcgctgcacacacgacgcgcggagatccgggtgcagttccggcgcgtgccgggaaacctgtaccggcggaacatcggcgcggacctggacaaggcgaccaacgagctggtgctccgggtgcagcccgacgaggccatctacctcaaggtcaacaacaaggtgcccgggctgggcatgcgcctcgaccgcagcaaccttaacctgctctactccgagcgctaccgtcgcgagatccccgacgcgtacgagcgccttctgctggacgccatggagggcgagcgccgcctcttcattcggagcgacgagctttaccccgcctggg

SEQ ID NO: 69206 - DNA, 436 bp, Zea mays
  Clone ID: LIB3078-045-Q1-K1-D4
cccacgcgtccgcccacgcgtccgctcggtgatgtcaagggcgcctccgaggaggtgaagcatctggaggaccaggcggcggccatcatgaatgcggcgcgcgccgagatcgcggcggcgcttaacaagatgaagaaggagaccaccgcggagctggaggccaagctggacgaggggcgcagccgtgtggaggccgagctcgtagaggcgctcgccaacctcgaggcgcagaaggaggaggctgttaaggcgctcgacgcccagatcgcctcgctcagtgatgagatcgtcaagaaggtgctcccatccgcgtgatgaaaccaaaccggcccttgccttattctacgactatagttacatgaacatcatatattaatgatattttgaagaaattggccgatgacttcgacactgtcctcatgaaagattattggat

SEQ ID NO: 69207 - DNA, 424 bp, Zea mays
  Clone ID: LIB3078-045-Q1-K1-D5
cccacgcgtccgcccacgcgttcgggggctcaggaagaggagagcctaaaaggctaacgggccgaatcggatccggccgccggagcgcggaaccccaccccggccgccatggagatgggagggatgagcgacgctgagcggctgatcttcttcgagatggcctgcaagaactccgaggtcgcgtacgagcagaaccccaacgacgccgacaacctgacgcggtggggcggcacgctgctggagctgtcgcaggttcgaaccggtcctgacagcctcaagcttcttgaaaatgcggaagccaaactggaggaggcactttaaattgatcccaacaagttcgatgcactctggtgcttgtgaaatgcctagacctttcatggattctttacttcagacaatgccaattcttatgagttctttacaa

SEQ ID NO: 69208 - DNA, 383 bp, Zea mays
  Clone ID: LIB3078-045-Q1-K1-D6
cccacgcgtccgcgcgagtggccgccctttttttttttttttggtagggaatatatcgagtacttatttgtagtgagttgaacagcgcaacacatgtccatagtccatacataattggcagataacaaggaattacatgatagatccaaaccttcatggtcttctggaagccatgaggatctttttacacagcaacaaacccacaaatcaccaaagcagtctttcgcagcaccaagtctataatggcgtacaaatccacagtagtaggcgagtccatgatgcgtgaccccacgcgtccgcaggaagcttggaaggtaatgctggagcagttcaaggctgaggccctgcggatgcaggccctgtcaatgcaggcatatgatgtc

SEQ ID NO: 69209 - DNA, 411 bp, Zea mays
  Clone ID: LIB3078-045-Q1-K1-D9
acccgttctagtacgcgtgctgctactgctctgtactctgcaacttgctttgcccatgggaaatatgggaatggcaaaccattccctgtgaacctaagtcttgccgatggtcttaacggctggcttccatgtgccaggacctcgtagaacagaattgaagcctcaccagagtgttcacaaaaggcttcatcaatacctatttcgctctgtcatggaaaagctgatgatgtggttgcctacaagcacggcgagagatctgctggtgccttgaaagcaaatggcttttccaatgtgctcttcaagtcatacaatagtcttgggcactacactgttccagaagagatggatgaagtttgcaaatggatcacagcaaattaggcgctcggcacttactcatcttgattggaaaat

SEQ ID NO: 69210 - DNA, 369 bp, Zea mays
  Clone ID: LIB3078-045-Q1-K1-E1
tgaaggatctgaagcgtgggtatgtggcctccaactccaaggatgaccctgccaaggaggcgtgctagcttcacgtcccagggcatcatcatgaaccaccctgggcagattggcaacggctatgccccagtgctggactgccacacctcgcacattgctgtcaagtttgcggagctcattaccaagattgataggcggtctggcaaagagcttgagaaggagcccaaattcctcaagaatggtgatgctggtatggtgaagattgttcccactaagcccatggtcgtggagaccttttctgaatatcctccttttggtcgcttttctgtcctttacattatgcaaactgttgctgtcggagtcatcaat

SEQ ID NO: 69211 - DNA, 420 bp, Zea mays
  unsure at all n locations
  Clone ID: LIB3078-045-Q1-K1-E10
caggtggtggggcgcgcgctgccgacgcccggcgatgagcaccccaagatctaccgcatgaagctgtgggccaccaacgaggtccgcgccaagagcaagttctggtacttcttgaggaagttgaagaaggttaagaagagcaacggccaggtcctggccatcaacgagatctttgagcgtaacccgacgacaatcaagaactacggcatctggctgcgctaccagagcagaaccggctaccacaacatgtacaaggagtaccgcgacacaaccctgaatggcgctgtggagcagatgtacaacgagatggcctatcgccaccgcgtgaggtccccctgcatccagatcatcaagactgcgacggtgcacttcaagctctgcangaggggacacactaaacagtttcacaacagtgagatc

SEQ ID NO: 69212 - DNA, 324 bp, Zea mays
  Clone ID: LIB3078-045-Q1-K1-E2
gtggtgtgcagatctttgtgaaaaccgttactggcaagaccatcactcttgacgtggaggcttcagataccagggacaatgtcaaggccaagatccaggacaaggagggcatcccgccggaccagcaacgtcttatctttgccggcaagcagctggatgatggacgcacccttgcggattacaacattcataaggagagcaccctacacctggtgctgcgcctcaagggaggaatgcagatcttcgcgaagacattgactggcaagaccattaccttggaggttgagagctccgacaccattgataatgtgaatgccaagatcc

SEQ ID NO: 69213 - DNA, 438 bp, Zea mays
  Clone ID: LIB3078-045-Q1-K1-C5
tgtacatcaacaatgctatccagatggatgttaccgggagtaggaaggctgttgtcattgacgtcccataccgcctgcgcaaggccttcaggaagatccatgtcagactcgtcagggagctggagaagaaattcagcggcaaggatgtggtaattgttgctacacggaggattgtgaggccacccaagaagggttcagctgttctgcgccctcgcaccaggactctgactgctgttcacgatggcatcttggaggatgttgtctacccagctgagattgtggggaagcgtgtcagataccgtctggatggttccaagattatcaagattttcttggacccaaaggagaggaacaacactgaatacaagctggagacctgcactgcggtctaccgcaggctgtgtgggaaagatgtggtctttgagtaccctatgaccg

SEQ ID NO: 69214 - DNA, 330 bp, Zea mays
  Clone ID: LIB3078-049-Q1-K1-F12
cccacgcgtgcgcccacgcgtgcggcaattgatctgtcatccctaaattgtgttgatggggaatgtgtgctgtgatctgtgcgattgatgggcttgttgtcagttctgatggtaatttgctagatgcgctagctgttgcgataaaggttgctttgagtgatacaggtataccaaaagttaatgtttctgttagtgctgcatctgatgaggaacctgaagttgatgtaagtgatgaggaatttctgcagtttgacacattcggtgtgcctgttattattacattaaccaaagtgggtcggcactacatcgttgatgccaccttataagaag

SEQ ID NO: 69215 - DNA, 440 bp, Zea mays
  Clone ID: LIB3078-049-Q1-K1-F2
cggacgcgtgggcggacgcgtgggttgcagcatcacaagcaaactgaagtcactcacaggtctccagcttccatccagaaaggagaaggaaacaagctagtggacaaccaaccatgatcagcgccaagaagattgctcatctcgccaagaagtggcagaggatggctgcacaagggaggaagcgcctcgccttgggggcggcagcaaagcaagccgacgagtgctgcagctatgtggcgagcaagggccactgcgcggtgtacacggccgacggggcacggttcgaggtgccgctggcgtgccttagcaccccggtcttcggggagctcctacaaatgtcacaggaggagttcggcttcacgggcggcgatggcaggatcacgctgccctgcgacgcggcgatcatggagtacgccatgtgtttgctcaggagaggagcc

SEQ ID NO: 69216 - DNA, 440 bp, Zea mays
  Clone ID: LIB3078-049-Q1-K1-F3
cccacgcgtccgcccacgcgtccgtgttgatgttgtgcaacaagtggatccttattttgggcagcgcccaaattgtgcgggtgagattggtctttctgctctacagaaagttgttgttgctgttcgaatccttgcttacggtattccggctgatgccgttgacgaatacgtacgtattggggaatctactgctcatgaggcattgaaacacttttgcacggtcgtccaaaccgcgtttgctccgtattatctctgtgcaccaaatgcagaagatatcgcacgccttctccaagttggcgagtcacgtgggtttcctgctatgcttggtagtgttggtaactgcccaagttcatggaacgggatgtttacagggcgtggtaaacatcctaccatgatcttggaagcttgtgcgtcgtatgacctgtggatatggcatgcat

SEQ ID NO: 69217 - DNA, 439 bp, Zea mays
  Clone ID: LIB3078-049-Q1-K1-F4
ggagcaaactgcttcaaacacaggagaatatgttcatctgacaaaggagcttctgatcagctgtgagagtatcgagtggcaggtagatgagctagaaaagacaatctcagttgcatcaagggatccggcatactatggacttgatgaagttgagctttccagacgaagaaactggactggttcttctcataagcaggtcggtacagtcaagagagctattgaaaagggcaagagcaatgcagcaacttcaaaataccaggatacaagcaggaccaaccactattctgccgaagataatgatgactttctttcttcagaatcagatagacagcttctactcatgaggcagcaggatgaagaacttgatgagctcagtgaaagtgtccaaaggattggtggcgtgggactaaccatacacgaagagctgtctggacaggaa

SEQ ID NO: 69218 - DNA, 232 bp, Zea mays
  Clone ID: LIB3078-049-Q1-K1-F5
cccactcatcatatcactcgattccttttatatagcccacaccaagctcatgtaacgtggtaaacgcactagggagatcggtccatgtcctctacaaaaagacactgacaatcaatacaatccttgctcatagcacatactgattacaccttggacgaatacctaaccattggggaacttactactcatgatgctataaaacactatgacactgtcacacaaaccatatatg

SEQ ID NO: 69219 - DNA, 435 bp, Zea mays
  Clone ID: LIB3078-049-Q1-K1-F6
aggttttgcatatggacagaaatgactactatggaggagattccacctcactcaaccttggtcagctctggaagaggtttagaggggaagacaagcccccagcacatctaggtgcaagcagagactacaatgtggacatggtgccaaagtttatgatggcaaatgggacattggttcgaaccctcattcacaccgacgtgacaaagtacttgtcattcaaagctgttgatgggagctatgttttcagcaaagggaagatttacaaggtccctgccactgatatggaggctctgaagtcccctttgatgggcctattcgagaagcgcagagcaaggaacttcttcatttatgtccaagattacaatgaagctgatccaaggacacatcaaggattggaccttactagggtgacaactagagaacttatagcaaaat

SEQ ID NO: 69220 - DNA, 449 bp, Zea mays
  Clone ID: LIB3078-049-Q1-K1-F9
ccaccacctcgccggccacactcgtctttctcacgagccacaggcacaggcagggtctcgagctcagtccacccatggcaggggatggcagtcatcgttcgccgtggcaacagtcccgtcgctggcggacccggcggccaagaagcggtccggtggcgtcacgtacgtggagggcatgaacgcctacagcggccttaaggggctcaacaaggtgaacatgctcggagtgcgcaagaccgccgactactccttcgccaaggtcgtggcgtcgctcagccccgcgtggaggaagcggcgcggctgcgcgttctgcgcccagatgaacgccgacgccgagatcttcaagatcgacgacaccatgaacggcctcgtgctcgtcggcgtcgccgtcgggttcgtgctgctccgggtggaagccgacgtcgaggagtccgagtagggtgcgtggg

SEQ ID NO: 69221 - DNA, 436 bp, Zea mays
  Clone ID: LIB3078-049-Q1-K1-G1
ctgatgtcgaggacaagaagcagaaggccgtatgcatggagaattacagaaagaaatatgaggatggacgggacaccttatctgatattgatgttgagagggaagaggagtgtgggatttgcatggagatgaacagcaaagttgtgttgcccaactgcacccatgctatgtgtatcagatgttaccaggactggagttcaagatcgcagtcctgcccattctgccgtgacaacctgaagaagacctgtcctggtgacctgtggatctatgttgaggaccaagatgtggttgacatggagacggtgtctagcgagaacctcagacggctgttcatgtacataagcaagctgcctctgattgtcccagacgtcatcttcagtgtgtatgattcccacatcaaatgacttccgacgcgacctttccgacgaccttcagc

SEQ ID NO: 69222 - DNA, 372 bp, Zea mays
  Clone ID: LIB3078-049-Q1-K1-G11
cccacgcgtccgcccacgcgtccgcccacgcgtccgtcaacatcaactaaaagacgccaggcgccgccatccatgctgccgtccgcgcatggccggaggaggaggagaggaggaggaggaaaatacatgaaaaataaaacttgtacacgtgtatgtctccagattgtgccgccgtcgttctcgtcgttgacttttcgttgtattggtcgatccatatgtgtgtgcgtgtgtggcgatgttctttcttctttgagtagctgccctgccaccgcctgcaatgcgcatgccatggcaggtagcgttgtctaagatcctatactgttgtattttggggtgaactacatcttacgtgctcaatttcttcttctaagt

SEQ ID NO: 69223 - DNA, 319 bp, Zea mays
  Clone ID: LIB3078-049-Q1-K1-G12
gtcagccacggcgggcggatacggcgcatgcacgtgtggccggcctacggcaacaagatgtgcgagacgcatttccacctggcgccgctgtcgaccgacgacctgctgaatcatgtgcactacctgttgcgcatcggctggatactctgccttgagttcagcaaggtctgcttgcagtaccgctagaacttcacctgcgcgtgctactaccacagtcgttactgtaccatgtgcaaactgcccatgatccgctaggacgacgctaaccacgtgtacaaggagctgcacgatgccatcaaatactagctggacacctttc

SEQ ID NO: 69224 - DNA, 436 bp, Zea mays
  unsure at all n locations
  Clone ID: LIB3078-049-Q1-K1-G2
cccacgcgtccgcccacgcgtccgcgcaagccggagaaggtgttcgtgcgcaccatcacgagccagttccaggccctcgtcggcatctcgctgctggagatcctgtccagccactcctccgacgaggtgtacctcggccagcgcgacaccaaggagtggacgtcggacgccaaggcgcaggaggcgttcaagcggttcggcgcgcggctgaccgagatcgagaaacgcgtcgtcaccatgaacgcggaccctcgcctcaagaaccgcaacggcccggccgagttcccctacacgctgctctaccccaacacctncgacacgaagggcgacgccgncggcatcaccgccaagggcattccaaacagcatctccatttgagttttgtctgtctgagctgaggacgtacggtcgtcgcactagttggttgcgtttcccc

SEQ ID NO: 69225 - DNA, 407 bp, Zea mays
  Clone ID: LIB3078-049-Q1-K1-G4
cgacgaggccgaggactacgtggtcatcaagcacgccgcgctcttcacgtccacggtcatgagcctgctcctggcgcgccccaacgtcaagctgttcaacgccgtggccgtggaggacctcatcgtcaggggagggcgcgtcggcggcgtcgtcaccaactgggcgctcgtgtccatgaaccacgacacgcagtcctgcatggaccccaacgtcatggaggccaaggtcgtggtcagctcctgcggccacgacgggcccttcggcgccaccggcgtcaagaggctccaggacatcggcatgatcagcgccgtgccggggatgaaagcgctcgacatgaacaccgccgaggacgagatcgtgcgcctcacgcgcgaagtcgttcccggcatgatcgtcaccggaatgg

SEQ ID NO: 69226 - DNA, 404 bp, Zea mays
  Clone ID: LIB3078-049-Q1-K1-G5
cccacgcgtccgcagcgccatggtcacgtcgacgaccgccgccgccgtgctgtccccggcgtccgtggccgggcttcgcctggcgccgactccccgggcgcgcgtggcgttccgcgcggcgcgggcgcggcggtccgtggcggcgcgcgcggagctgagcccgtcgctggtgatcagcctgagcacgggcgtgtcgctcttcctgggccgcttcgtcttcttcaacttccagcgggagaacgtggcgaagcaggtgcccgagcagaacggcaagacgcacttcgacgccggcgacgagcgcgccaaggagttctagggcctgctcaagtccaacgaccccgtgggcttcaacctcgtagacgtactcgcctggggctagatcggccacatcgacggctactaca

SEQ ID NO: 69227 - DNA, 434 bp, Zea mays
  Clone ID: LIB3078-049-Q1-K1-G6
ccgatggggagctccccgccgacgcgactgccaccaagaagcagctcttcatgcgcctgtgcgaccccgccagacccgtcctcctcgccgacggcctcacgagcatgtggctggacagggccaccgtcgccaagtgctacatgctgtccgccaggaagctgaccatcatatggggtgatacgccgcagtactggcaatggatccccctcaccgactccaggttctcagaatgcgcagaactccagcacgtttgctggctggaaatccgcggcaagataccctgcgacatgctgtaccggaacaccacttacgccgactacatggtgttcaagatgtccgacgaatcctatgggctggactatccgctccaggaagcttaagttagcatcggggcaaccaggtccactcgtcaagtctgcctaaggtacgttgac

SEQ ID NO: 69228 - DNA, 461 bp, Zea mays
  Clone ID: LIB3078-049-Q1-K1-F11
cgccaccccaagctgaaggcgttctacaggtcgatatcgccccggcacttcttgaacggtgactgggacaccggaggcagctgcgacaacaccagccctctggccaagggagggagcggcgtccacctcgaccgttcggaggacgccgacgccgagggcgccgtgaggggcaccggggtcaggctcctggacgtcactgccctatcgcggctgagggacgaagggcatatttcacggtacagcatcaaggccacttctggcgttcaggattgcctgcactggtgccttcccggcgtgcctgacacctggaacgagatccttgcggcccagctatagcctgtagctgaatttgaagatgccaagggttatgtcgaattgtttatgggtgaagctcgtatatacagtaactaccacggagtactacgtcgttgccggagacccaatgctgctggtagtgaaac

SEQ ID NO: 69229 - DNA, 333 bp, Zea mays
  Clone ID: LIB3078-049-Q1-K1-D3
cttccttttaggtctggaggccatttcagctaccccgtgccttcatgctcctttgatctggaaaattcatgcactttcggtctctatccgctctagcatgcatttgctacaggaagacagaagtagggatattttctgtgctttacaggaactgtatggcctgcatctgaacaggttataccaaaaattctgtaaaccaaactctatcgaggaagttaagggcgttgtactgggcacttcagaggaagcgatggagatcagtagccttgaaattctcaggtttcaggagaaaattcatggaagctatactactttggttgaaagcctggttga

SEQ ID NO: 69230 - DNA, 125 bp, Zea mays
  Clone ID: LIB3078-049-Q1-K1-D4
gcccgccgctagctcggcacctcaagaagttcgacacctgggacgccggcccggcccgcgttcccggcggaaccggaaaggtcattccaccggcggtggccccgccggggccgttccggaaggcc

SEQ ID NO: 69231 - DNA, 438 bp, Zea mays
  unsure at all n locations
  Clone ID: LIB3078-049-Q1-K1-D5
cccacgcgtccggtggatttctactctgggctaatttatagggcaatgggattccctacagaattttttcctgtgctgtttgctattcctcgcatgggtggctggctagcgcattggaaagagtcactcgatgatcctgacactaagattatgaggccccaacaggtatacaccggcttctggcttaggcactatacccccgtcagagaacgagtgctatcaagccagagtgaggaacttggtcaggttgccacctcaaacgcaactaggcgccgncgtgctggttctgccctgtagaagctgcagcgtataaacgcaccggcatactcaataaacatcgaccacttttgtgcttgaaaaggccacaaatgctttttagcttggttggagttgtaagccttttgttgtcgagtatataggcaataatgcagtgagaac

SEQ ID NO: 69232 - DNA, 197 bp, Zea mays
  Clone ID: LIB3078-049-Q1-K1-D6
cgacccaccgtcgccaccgtccgaattattctctgttctaacaacgcaatgcagggcacggaaatttcaaggctgaggctatcaagcatggtggctggctagcgcatgaaagatactacatatcctgaactaaaaatgagccccacagtatacaccgctatgactcagcactatcccctcaagaacatgctataacc

SEQ ID NO: 69233 - DNA, 404 bp, Zea mays
  Clone ID: LIB3078-049-Q1-K1-D7
ctcaatgtcgacgacccccacgtcccgggctccgctcgggtcacggagcttgtgtggggcgacgatcctcaccatgaattgctcgaggagccactgcccgatttcgtgcttggctccgacgtcatatacaacgaggaagctgtggacgatcttctgatcactctcaaccaactctcagggaagcacactactatacttctagctggggagcttcgcaacgatgctgtgctggagtgcttcttggaagcagccatggaggacttcctaattgcgtgcatcgagcaggaccaatggcaccctgaattccgcagcaaccgtgtagccttgtttatcttggtcaagaaaccagagaaacctagcgcagagtagtcgtctgttcctcgccttggtgtagaacatggata

SEQ ID NO: 69234 - DNA, 431 bp, Zea mays
  Clone ID: LIB3078-049-Q1-K1-D8
ccttggtttagaattggtcttgatgcaagattgtttgattctacaacgagagatcatgtgcctagtgacatggatttggctttgaattccttaaatagcaatatggtcgagtgtaattcagcggcagagaaactgactattttgaatgcttttgatatcatctccctgtctaacgggtttgatctctctggtatatttgagaactcaaacaaggagtctaaattcatgtctaccaacacagctatgacaattatcaccaagctaatggaagttgcaaagagcttggatctgaaggttataacaaaaactggtgggttgttgaatatggaagctgccaaatcaggaataaaaagtgtgatgtctataaatgctgagatatttcaaatcacaccaaattatcatctcgtggagatcaagaaaatcaatggtga

SEQ ID NO: 69235 - DNA, 344 bp, Zea mays
  Clone ID: LIB3078-049-Q1-K1-D9
gtggagcagctgtatttaacaatgtcatttcactgtcacaaccatggcgatgaatgttggctttctcagttttggtccagtttcgttactgaagttaccttttcaaaagagcaggtgaactatcattgtgcaattttgctgggagaaactcttgaacttaaatctttttgatatcactagacttcatcaatcatggtggagcctgttattgtcatgcagatgctcgctaagaagtctgcaactgttggttggtcaagggtgattggcgattttgcacatacggatccgcaattactgctgcctcaggttgctcagcaatgtgctgctggttgggcaccgaggaa

SEQ ID NO: 69236 - DNA, 438 bp, Zea mays
  Clone ID: LIB3078-049-Q1-K1-E1
actcgaagaagccgcgtgcgttatcctttgagcagtttgggcgctgagcaagtccagtgagagagggagagcggcgagaggatggctgggatggcatcgctgcagggcgccatggcgtcgctctccatctccgcgctaggcgcggcgacggcgagcagcagcagcttctggggcaaccggctcgccacctactccgcgccgcagcctggggtaaggtttatggtcaagatatgcccaattgaaatgagacttaagagatgggagcgaaagaagtgtaaaccaaacagtcttcctgtgctgcacaagatgcatgttaggatcggggacacggtacaggttattgcaggccgtgagaaaggaaaggttggagaagtcacacgccttttcaagcacaacagcacggtgatcgtgaaggacctgaacttgaagtcgaagcac

SEQ ID NO: 69237 - DNA, 375 bp, Zea mays
  Clone ID: LIB3078-049-Q1-K1-E10
ggggaagaagatggtgcgggtggcgacctacttcgcgatgaccttcggggcgttcctcttctgggagtccatggacagggtccacgtctggatcgcccttcaccaggacgagaagaaagaaaggatggaaagggagctggagataaagagaatgcaggcagagttactggcccaagctaaagagaacgaatcatgattgtcatttgtccaatggtttcaggcagttcctttatcgtatttcctctgctgtattttccatgcaatatcttgactgatgtatgctcatgctcaacacctccaataaagcgagacatgctatagcattgttgaatgcaagtgggtatgcagtaatgctcatgttgaattgatgtaact

SEQ ID NO: 69238 - DNA, 388 bp, Zea mays
  Clone ID: LIB3078-049-Q1-K1-E12
tgctcatgggcgccgtcgaggggtaccgtgtcgccggcggcccgctcggggaggtggtggacccggtgtaccctggcgggggcttcgacccgctcgggctcgccgacgacccggaggcgttcgccgagctcaaggtgaaggagatcaagaacggccgcctcgccatgttctccatgttcggcttcttcgtgcaggctatcgtcaccggcaagggccccctcgagaacctcgccgaccacatcgccgaccccgtcaacaacaacgcctgggcttacgccaccaactttgtccccggcaagtgagcgagggcatgatgcttgcatgcgtgtaccgtagacgtaccgtattcctacgtactgcaagttgcaccaggttttgtgaagggagc

SEQ ID NO: 69239 - DNA, 428 bp, Zea mays
  Clone ID: LIB3078-049-Q1-K1-E3
cccacgcgtccgctacactcccggcggcggcggcggcggcgcagcagcggcagcagcatgcgaagatggtgaagttcctcaagcccggcaaggccgttatcctcctccagggccgcttcgccggcaggaaggcagttatcgtgcgcgtgttcgaggagggcacccgcgaccgcccctatggccactgcctcgtcgcaggcctcgccaagtacccaaagaaggtgatccgcaaggactccgccaagaagactgcgaagaagtcgcgcgtcaagtgcttcatcaagctcgtcaacttcactcacctcatgcccacccgctacaccctcgacgtcgatttcaaggatgtcgccaccggtgggcccgacgcactctctacccacgacaagaaggtcgccgcctgcaagacggccaaagcgcgccttgaggag

SEQ ID NO: 69240 - DNA, 108 bp, Zea mays
  Clone ID: LIB3078-049-Q1-K1-E5
gcaaaagctcctgcaactctggcccaacctgctgcccctgtggcccctgctgcatcagtggcaagaacaccaacacaggctcctgttgccacagctgaaacggcacct

SEQ ID NO: 69241 - DNA, 431 bp, Zea mays
  Clone ID: LIB3078-049-Q1-K1-E6
cgccgttccgccccaccgccgcatcccaactcgagtctggcgctgcgccagcgcggccgggcctggcccggtgccctccgaagagccggcatccgcctcctacgccgtcgtcgtcacggacaagcccgatacgcctgccgacgacaaggccgaggaggttagcgccgcgcctagtggctccgcggaggcgcctatggcagagctggtgccgtcagaggcgtcatcatccccagatgatggcggcctggatgagattctaagcaagttgaacattgaagtgactccgactttaatcctcactggatttggtgcttttattgctttatggatcctatcttctgttgttgctgcagttgattcagtccccctgctcccaaaattgctggaattaataggaactgcttacacaatttggttcatcgcacggtatc

SEQ ID NO: 69242 - DNA, 425 bp, Zea mays
  Clone ID: LIB3078-049-Q1-K1-E7
gtgcggccccctttttttttttttttcctgaaagaaacgattatatatgtctgtcatcgggtataatgtatgtacatcgatagaatgacgacgagccaaacgattcgattgatctccgcaatactacgtacaatgcaatgcaaactcatcaccaccagattgcttgagctgaacaatacaatgaaggatcatcatcagtagacttcgacgttccattgctcgatcttcttgagctgcttcttgtagtccaaccagttgatcccgtccttggctgcgaggtcgagcatgatgtcgtcgatgcccttctccatgcccttgagcccgcacatgtagacgtaggtgttgtccttcttgagcagctcccacagctcctccttgtactccgccatgcgcgtctggatgtacatcttctgcccggacgcgtt

SEQ ID NO: 69243 - DNA, 189 bp, Zea mays
  Clone ID: LIB3078-049-Q1-K1-E8
ttgactcctactatatcaccttatctcacttctaacacaacactaaatcattgcaaactggtataatccatacaactgtgtacaactagcatacatactaatatatcctcctgattaccaaaatactacgccttacttaacgcccactacttatccaccattatcaactgacttaccgcccataaaatt

SEQ ID NO: 69244 - DNA, 318 bp, Zea mays
  Clone ID: LIB3078-049-Q1-K1-E9
cggacgcgtgggcggacgcgtgggcagagcagctgcagggaggccgccattatggcagcgcgccgccgcgtcatctaatcgaggcgagggggagacagagaggaggaggaggaaaaacgggaaataaatcttcatcaagcaacaggtagcgggagcggacgcggggtgaaccactagctggccagtgccggccgaggctagggttccggggatcgcgggcgcgggctcgggctcgactttcgtagcctagccgtcgccgccggccgcgcgggggaaccggatgctatgctgctgagctgcgggtcgctctcctcctgg

SEQ ID NO: 69245 - DNA, 441 bp, Zea mays
  Clone ID: LIB3078-049-Q1-K1-F1
gcgccccctccactccggccatgagctcctcccagtgaatccctctagtcccctgctcatgtcccatggtggccgcagggagctctggatccatggccgtcggcctctgggcgtgagcagcccttggctctctcccctgcgacagacttcctccacggtgtctctttccccaaccatggtggccggctccctgctcctccattcggtgcccctggtttagggccggtcgacctccggcgacctcctccccatggcacagcaggccgacgcccctgcctctactccatcttccccattggacagcacgagctcctcctcgccgatacgccagcaaccctgcagcagcgccactcgatctcctctatacgtgaacaacagcaacccggatcccatccacgtcgtatgcgtcgatccgatctgtgcagtcccaacccacgacgt

SEQ ID NO: 69246 - DNA, 468 bp, Zea mays
  Clone ID: LIB3078-049-Q1-K1-D12
acccacgcgtacgcgtgcactgacaaacaacggcctaatgcccatatttgacactatctactgctgggttaggtatggcgccatccaaaatgacatatgtatgacacctgcattatcaccagggggaggccctgaacgtgacatatacgcgttgcctaatcaagaagacaaattgcgaaacatacactccgcagacgcctttgagatgatacaaaaccatctcaatcttatcatgggagaaaagatagcatcaccgcccgatactgttgttgagatcagcaacttgaatcttggaaagctgtatgcagcatccatcatgtatggttactttctgaagagagtggatgagcgattccaacttgagaaaactatgaagactctcccaccaaagcctaaccagcagatagtatttgaaaacctacagcctaatccattctgggatatggagtccttagtacagaattcacc

SEQ ID NO: 69247 - DNA, 289 bp, Zea mays
  Clone ID: LIB3078-049-Q1-K1-F10
cccacgcgtccgctgaagttgaggatgttatttcgatgagcttgacagttgtgaagtcgctcctgaaaaattataacattgacccaaagtgcattggacgtttggaagttggcagtgaaacagtaatagacaagagcaagtctataaagacatggctgatgcagatatttgaggaatctggcaatactgatattgaaggagtggacttctcaaatgcgtgctatggtggaacagctgcattggttaattgtggtaactgggttgaaagcaacttatgggattggcctta

SEQ ID NO: 69248 - DNA, 431 bp, Zea mays
  Clone ID: LIB3078-049-Q1-K1-B6
gccagcttagcgcgcttctcttcacgtatgtggaccgttttgatggcgtgttgctgatgcatgaagtttcattccttattggcaaagacaaagagggcaaacccatatatgaaaggagtgaccgtaatgatcaaattgctgaacccgtttcttatggcaaaatcatgaatggcttggtgccatatttcagcgtccaagtgcatgccaccctgctgctgttctctccccagccggacatgatcctggaagggatggttgaaatgattgggaaggagtcaattcatgccattgtattaggggttttctcagtggcaattatgtctgaagatattaagttcaaattcaaatggaaaagtgatggagggaaatttgtgagcctcacagataaaaaacatgtgattgaaagaggaacaatgataaggttttctgtc

SEQ ID NO: 69249 - DNA, 326 bp, Zea mays
  Clone ID: LIB3078-049-Q1-K1-B7
acactccgcgctagctgaggacggtacagcggcacagaggtgcgacgtacggcgacgacgacgcatgcgccacacatggcatcccagctctccggcgccgtgccccggttccacggtctacggggctacgccgcgcccaggtccgcggaggcagcgctgccgtccgtgagggtggtcaggacgaggtcgtcgtcgcatggcatacgctgcgactacatcggctccgccaccaacctgatcatggtgactacgacgacgctgatgctgttcgcggggcagttcgggctggcgccgtccgagaaccgcaaggcgacagcggtgctgaa

SEQ ID NO: 69250 - DNA, 431 bp, Zea mays
  Clone ID: LIB3078-049-Q1-K1-B8
gtggattcattttatttcaggtataaagaagctgagctcaatatgggtgagaacagttgcattgatcgatgtgtttcaaagtattggcaggcatgtttgttggcaccctttctcgttggcctttgccgattcaattttacgccgattcctacactatgcagtctatcataacttggctgtgcactgatcgaatttatcaaaaaatgtccttgatggtgtctttcctactttaggacttaggttggaaaataacgatgtatttctagtgtacctcaacacctgcttattgtgaacaaatagttgatctccctccacaggcaacagatgcctggagatatgctcgatcgatgttttttctgtagcatggtgatcttgatgctctgtaaccttcactttagcggtgccacttgcagatttatagttctgcttat

SEQ ID NO: 69251 - DNA, 461 bp, Zea mays
  Clone ID: LIB3078-049-Q1-K1-B9
cccacgcgtccgcccacgcgtccgggcacttatgtatcacgcgatcccgctgtcccagcagctggagtacttcagggagtaccagacgaagctggcggcggtggccggcgccgggcaggcgcgctccatcctcagcggcgcgctgtacatcgtcagtgccggcgccagcgacttcgtgcagaactactacataaacccgctgctgttcaagacgcagacggtcgaccagttctccgaccgcctcgtggccatcttcggccgcaccgtgcaggagctctacggcatgggggcgcgccgcgtcggcgtcacgtcgctgccgccgctgggctgcctgccggcgtacatcacgctgttcgggcacggcgccggcgggtgcgtgtccaggctcaacagcgacgcgcagagcttcaaccggaagatgaacggcaccgtggacgcgctggcgcggcggtacccggacc

SEQ ID NO: 69252 - DNA, 448 bp, Zea mays
  Clone ID: LIB3078-049-Q1-K1-C1
cccacgcgtccgcccacgcgtccgcatggttgctgctggtgacacattgcttggtttgggtgagaaagagcggttaggcctgttgcagtatgccgacgacgagtctaaagaagagaggtactgggaaaccttggatgctgatttgcgttactggaccagatccctgcgcccagtgcagtggtatcctggtcatattgcaaaaacagagaaagaattgaaggaacaattgaggctcatggatgtcgtcatagagatccgtgatgctaggattcccttgtccaccagccatcctaagatggactcatggctaggcaaccggaaaaggatcatagtcttgaatcgcacggacatgatctcaactgaggatatgaatgcatgggctacttactttggtaatcagggcatcaaagttgttttctccaatggccagctgggtatgggtacaatg

SEQ ID NO: 69253 - DNA, 364 bp, Zea mays
  Clone ID: LIB3078-049-Q1-K1-C10
ggcgtgcctattgagctcatgatggcgcttatgctgcggctcaaggtcttccagcccgtgctgctggccatgctcttcacgttcaacgacatcgacatggggatccacgtgcgaagccgcgtgcagacctcccagatctacgccatccgctacgccgtcggcaaggggctcgtcaactagtaccagaagtacttcgacaaggccgtcaacaaggacgtcaaggacgtcttcaccgacttcgaccgcacgcttgtcggcaccgacctcatgcgctacgagccgaactagtagcctggtcatggcgcccgtgccaggttccagaagtgctaccattgagcgctccgctgagcgctcttgtccgaca

SEQ ID NO: 69254 - DNA, 460 bp, Zea mays
  unsure at all n locations
  Clone ID: LIB3078-049-Q1-K1-C11
cgagctccttgtgtcagagctgcataatacgcttgatcaaaaatcaaaacagttgggtgaagctgaaattaaacttagtgccatgatggatgaggttaattctctgaagaaagaacttgaacaaacccggggtcttcttgacgaatctcagatgaattgtgcgcaccttgaaaactgtttacatgaagcaagagaagaggcccgaacaaacaaatgttcagctgacagaagggctgttgagtatgatgctctgcggtcgtctgctttgaggatacatggtttgttcgaaaggctaaataactgcatcactgcaccaggtgtgactggctttgcagagtcactgcattctttggctgcctccttggcaagctctgtaaagaaggatgaagctgataccactgttcagtttcaacaatgcatcaagatcctggcngacaaagtttatntactgacacgacag

SEQ ID NO: 69255 - DNA, 455 bp, Zea mays
  Clone ID: LIB3078-049-Q1-K1-C12
tgctctactgtggcatcgcctcatggggaccaaagttctagcagtaacattcaacggcgcgaacaagatccgcgcgtacgcgcactgcgcgagagattcaccaggaatcactcttctgctgatcaacctgagcggcaacgccaccgcgcgggtctcggtgacggcccaaggggctgccgcggcgcacgcgcacaggcacaggcacggcgcgaggaagcacggcggcggcaggaagttccggcacgtgcacgtgcacgtccccggcttcgccggcggcggcgaggcggcggcgggcgccgtgagacacgagtaccacctcacccccaaagacggcgacctgacgagccaggtcgtgatgctcaacggcagggcgttggccaccgacgcggcggggaacatccccgccctggaggcggtcgaggtggacgcggcgcggcccatcgtcgtcacgccct

SEQ ID NO: 69256 - DNA, 344 bp, Zea mays
  Clone ID: LIB3078-049-Q1-K1-C2
cattgtttgcccaattccataaagccggatccggttgcaccaaattttattaccctggtggggaatggccctttacaaccattggtccttgccttcaacctgggattgattagaaaaaagcttttttcctccgtcaacccttttccatatttaagggctctatgtgtcttttgctctgagagaaagtgcatatgagactctgctatctcgtgaaaaaactcttgcatgaggacccctatacacatgtagaaatatagagaatttcacgagaaagcctcacatctgtctttcacagctctcatacgacattgtatgttataaaagcggcgaagcactactagcta

SEQ ID NO: 69257 - DNA, 415 bp, Zea mays
  Clone ID: LIB3078-049-Q1-K1-C3
ctttgttttttgtttactttttttgcttttaatgacaatgaacacaattattccttggggattgagcgaatagtttacatcatggtacaaaccgaaaaccaacgtgcgctcacatgcatccggacacctaaaggtcaccggcggcgcctcccttacttgccggggacgaagttggtggcgtaagcccaagcgttgttgttgacggggtcggcaatgtggtcagcgaggttctgaagcgggccctttccggtgacgatagcctggacgaagaatccgaacatggagaacatggcaaggcggccgttcttgagctccttgaccttgagctcggcgaaggcctcggggtcgtcggctaagccgaacgggtcgaaactgccgccggggtagaacgggtcgacgacctctccgagcgggc

SEQ ID NO: 69258 - DNA, 255 bp, Zea mays
  Clone ID: LIB3078-049-Q1-K1-C4
cggagtcgttcagggacgccgcgcatagcttctcacaaggcggcctggactacctgagggaccccaggactttgcacgcacagagcatgctcgacatatgaacctgccacgtggtgctgatgctcttctcaagggctaccgcgatgcttgtggatcactacgtgaatggctggacctggtgtcaccgggtggctccttatatccgctgtgcctggtctacgacatggacatatgacaacgagctcaatgtgaggg

SEQ ID NO: 69259 - DNA, 381 bp, Zea mays
  Clone ID: LIB3078-049-Q1-K1-C5
ggcggccggacggcggggcgccgtcgctggcgtccgacgcgttgggggcgcggccgtgggccttcgcggggttcggcggcctgctggcgggcttcgccaggcgcgggctcaacctgacggacctggtggcgctgtcgggcgcgcacaccatcggcgtggccagctgctccagcgtcaccccgcgcctgtaccaagggaacgccaccagcgtggacccgctgctggactccggctacgcccgcgcgctcatgtcctcgtgccccaacccgtcgcctgcgtccgccaccgtgggcctggacgccggctcgcctgccaggttcgacagccggttctacgcccgggtgcgcctgggccagggcacgctggcctgcgacgccgagc

SEQ ID NO: 69260 - DNA, 419 bp, Zea mays
  unsure at all n locations
  Clone ID: LIB3078-049-Q1-K1-C6
gacaagcgcaagaagaagaagaacggcggtaggaaacctgaagaaaacgtggaaactttggagggcctaatccgcgaatacttcgaggccgcgcctccttggatcatgacgagcagcgtgaccaaccagggccgcgacgagatactcctgcacatgtctcagcttaggaattattggctcaagcattgagatgcaatgataaccaaaccagggcgaagcaactagaacagcatgcaaagcactgtcgtccattgatgcatggacattcagcagtcggcgccttcgcaatcaggcgttcgcaccaactaatccagccttttgagctgttgactgtccaatatggcccnctgtacatgattacccaatcaacactctggggatgcngacaaggtgctaaaatcagctgatcatggtttttt

SEQ ID NO: 69261 - DNA, 433 bp, Zea mays
  Clone ID: LIB3078-049-Q1-K1-C7
gcagtctccttggctagcctgagtggcccctattgctcatgctaggctcaggggagacggtttgacttgctgcacacaattagacacaggagcctcctcgacctgtgcatgggtgcatacaattaccgtgtgattggttgcccagctctcaacgcctaggctcctcacgagtgttgactgcgcctgcatttctgattggttggctgcacggctgcgcccggaatgtgcgggtgcaagcaaatctattttacgctcctcggcggatgccggcaaccaatcaagagaaagatgcttcaggcggagagtttcactgctcatcgtgtctactgatctattgttatgttgctcgccagcccctttggtcaccgaagtccaaaccctaaagctgttcaacatagagttgtactcccttcctcggttccaaataaaattc

SEQ ID NO: 69262 - DNA, 434 bp, Zea mays
  Clone ID: LIB3078-049-Q1-K1-C8
gaacttattacaattgaagaggatctttatgcatcacttggacttcatttcaggactctggacatggcaactggggatctgggtgcaccagcctaccggaaatttgatatcgaggcgtggatgcccggcctagagcgttatggtgagatctccagtgcatcaaattgtaccgactaccaaagtaggcgactaggcatccgttaccgcccatcaccctcggagcctccatcaacgagcaccaagaaagggaagggagctgcctcaggccctacgcagttcgtccacacgctcaacgctacagcagtggcggtgcctcgtctgatagtttgcattctagagaattttcagcagggcgatgggtcgattgtggttccagagccactaagaccctatatgggtggactagagttgctctccccaaaattcaagtgacc

SEQ ID NO: 69263 - DNA, 325 bp, Zea mays
  Clone ID: LIB3078-049-Q1-K1-D1
gcgcctctgcctacctactctcgcggatttcgacagacagactacgggttcggtcccggggtgcttatcctgccccttggggcatgtacaatcatggatggaaggccaacactgaagcccgaagactacagaagagtcaacgagacggatcatgcatatatgcatacgacgatagacgaggaataagcactgacagagctcaatgccaatgcacataatgtgcgcgataggatgcatgtgctctgaagaaaagcgtgcagacatgagactggtcacccgtcttcattacctagaggatgataaggcagctgcctatcagcgttgc

SEQ ID NO: 69264 - DNA, 337 bp, Zea mays
  Clone ID: LIB3078-049-Q1-K1-B5
cgccacgcttggcatgtggagcgccggtggagtagtgtcggcaatcgataggctccccgtggttcctggtctgatgcaaggccgtggaaatggatacaactggtggttcgcgtaccgaaacctgctattcaagcctgacagggatgctttctttgcgaaagtcaaggagatctacgaggatattatcagcgcttaacagatgggagcaccaatgcaaagctcatccaaattaatggagtccactttaagacatccttctagtttgctgctgatcagatgtttctgctgtgatgtatttcagtgtagcatatggataagtaatctggatgtttaattt

SEQ ID NO: 69265 - DNA, 456 bp, Zea mays
  Clone ID: LIB3078-057-Q1-K1-C3
gcggagctgagctcggcgctggtgatcagcctgagcacgggcgtgtcgctcttcctgggccgctgcgtcttcttcaacttccagcgggagaacgtggcgaagcaggtgcccgcgcagaacggcaagacgcacttcgacgccggcgacgagcgcgccaaggagttcgcggccctgctcaagtccaacgaccccgtgggcttcaacctcgtcgacgtcctcgcctggggctcgctcggccacatcgtcgcctactacatcctcgccaccttcagcaacggatacgaccccaactttttctgagcgggtcgtcgggatgtactctacagacagccgtgtgcgtgtgcttgtcatgtatccgatcaaagttgggtaatttggacaagtagtgcaacttgcagaataatgggtattgtatagtgcagcatgccaacatgaatttgatctgtctctggtctc

SEQ ID NO: 69266 - DNA, 452 bp, Zea mays
  Clone ID: LIB3078-057-Q1-K1-C5
cccacgcgtccggaagctgctcgcgctgtacctcactggagacaaggaaggtgctatctccagtctcaaggaatggttgagtgattcagcaattggaagcaatcctgttctgcggttgattgctggaattgtatttatgcatgagcaggactacaatgaggctctcaagcacacacactctggaggaactctggatttgcatgcattgaatgtccagatcttcatcaagatgcatcgttcagactatgctgagaagcaattgaagatcatgcaacaaattgatgaagaccatacacttacacaacttgcaaacgcatggctgggcattgctgttggtggctctaagatccgtgaagcttatctcatattccaagactttgctgaaaagtacccaatgacagggatggttttaaacgggaaggcagtctgctgtatgcacatgggaagctttg

SEQ ID NO: 69267 - DNA, 298 bp, Zea mays
  unsure at all n locations
  Clone ID: LIB3078-057-Q1-K1-C6
gagcgatattcctctgcagcgccactatcgcctgatgcaaggcaacgtatcgtatcagagcgagttgacatgatacacaatgttgtcatctcggtctcgattgggccaccgaattcacgttttttgccttcaaaagacaagagctcgtgggatccaaaagatgttgctgattgcattntatctgatagatctaccatgaaggtgacaactggccagcgcatgacagagagttctgtccttgacgcacacgttgcagaggttgatggagaaccatactggtattatgagtatcttggtc

SEQ ID NO: 69268 - DNA, 393 bp, Zea mays
  unsure at all n locations
  Clone ID: LIB3078-057-Q1-K1-C7
acggagctccagaaggagaacatcaagaacgccgtctcctccaccggcaacatcacgttgagcgtcaccaagagcaacccggagaccggcgaggtcatcggcgtcttcgagagcgtgcagncgtgcgacaccgacctcggggccaaggcgcccaaggatgtcaagatccagggggtctggtacgctcagctcgagtgattcaagtgtctaactgctaggtgtccaaccgccgtaatggatcttgggaaggtgtatgtttaccatggaaacctttgaaaagcagaggaggaatcaagtttgtaaggaactggttaatgcaaattcggcctgtcgcttttttaaaagaaataacccatttggatttggaaacctttaaaaaatattcccaaccct

SEQ ID NO: 69269 - DNA, 93 bp, Zea mays
  Clone ID: LIB3078-057-Q1-K1-C8
gtcacaataccacaaattgggagcagctgggattggtatgctggaacatggagtgacaaagtcaaagaacaagaggacaagaaaaggaaagat

SEQ ID NO: 69270 - DNA, 437 bp, Zea mays
  Clone ID: LIB3078-057-Q1-K1-C9
tctagatccgttcatcctggtggttttgtgaggtcgaaagcggcgagcgaattagaagatgctggacaagctgtgggacgacgtggtggccgggcctcgcccggagacgggcctcgagaagctccgcaaggccaccaccgcccgtccgctcgtcatcaacaaagacgcggacggcggcagctacaagcgggcgcagtcgatgccgtcgaccccgacgacgccggtgacgccgtcgtcgtcgtcgtcgtcgacgacgccgcgcggcgccggcaacgtgtggcgcagcgtcttccacccggggagcaacctggccaccaagggcatgggcgccaacctcttcgaccggccggagcccaactcccccaccgtctacgactggctctacagcgacgagaccaggagcaaccaccgctagatcgggcgagatggatggacag

SEQ ID NO: 69271 - DNA, 206 bp, Zea mays
  unsure at all n locations
  Clone ID: LIB3078-057-Q1-K1-D1
nccacgcgtnncgccacgcgtncgcggcgctctnctctnccgacgacagctacacctnacaaccgtgagctcgcgaaggaacgctgttcgcaattccggcgccggcaccatgagtaagctgcagagtgattctctgagggacgcgattgcctcaattaccaatgattcccgtgagaagcagcgcaaatttattggaaccattgagc

SEQ ID NO: 69272 - DNA, 400 bp, Zea mays
  unsure at all n locations
  Clone ID: LIB3078-057-Q1-K1-D10
cggacgcgtgggggagaagcagccaacgtgttcggcaagcccaaggcgagcacggagtgcatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaggtcgactacctgctcggcaggcaggcctacggcggcaagaccgactccgagggcgggttcgagaccggcgccgtggccaccgtcaacgtcctggagagctccacccncgtgatcgacggcaagcagtactacgccgtgtccgtgc

SEQ ID NO: 69273 - DNA, 239 bp, Zea mays
  Clone ID: LIB3078-057-Q1-K1-D11
gtacacttttttttggttagtcgtctcaagttcagagcgttatgccatgttttgggacgtgattagtacactgttttctaaaagcgattgagctctagtccaatgtattgataatatctgctgttgtcctattgcggtgatgatgatttgccctgttcgctagctgcaatagttcctatttgttgatgaatttgtttgaagcataaacgcagaacatgtcgtaaagaaaacctttctgt

SEQ ID NO: 69274 - DNA, 439 bp, Zea mays
  unsure at all n locations
  Clone ID: LIB3078-057-Q1-K1-D12
cccaaattcaacgtgtttgtcaaaaatgtatctgctcatctgggagtagctgtgcgcacgcattgagttgaagcatgtgattgctgctacaattggtcttaagggtcttggaagcctcctttttattttgagcagctctctcggtgcttatctcctgctgctgtaccttgctttgatcactcctatcatccatgacttctacaactacgatatggagaaggcagaatttgcaggcctctttgcgaagttcacccaggatttggcgctgatcggagctctgctcttctttctgggcatgaagaactccatcccgaagcggcagggcggcaagaagaaggcccncaaggcgaagacgaactagggctgcttagatagctgcacgcctcangtggggtgtatcangagacaggtctatttcgaagcaggcttcacgcgatgc

SEQ ID NO: 69275 - DNA, 72 bp, Zea mays
  Clone ID: LIB3078-057-Q1-K1-D2
ttcttgtggaggaacaagaacatctctgctggaatacttggtggtgtcacagcaatctggatctaatttgaa

SEQ ID NO: 69276 - DNA, 452 bp, Zea mays
  unsure at all n locations
  Clone ID: LIB3078-057-Q1-K1-D3
cgcgtacacccgtacaccgtacgcagccatggcatcagtaggcttcggcacggtcgcgccggccgtggcatcatcgccggcggccaggacgacgagcatgggccgcccctctgcggcgcacgtccctgcggcgacgaccaagttcgtcgcggcggcggcgggtaagcgggtggaggagaagggcctgttcgacaccatcttcggcgcgctgtacaaggaggagcagctgctggagacggaccccgtcctgaacaaggtggggagcaagggcaaggccgtcgccgncccggcgcccaagaaagccgctgaagagggcggcaacggcgggctcagcctcggcgggttcttctccaggcccaagaaaggttgatctcgccctgtgttctgcaagcacacaccccagccagcatcagtggttcactgctggctggtgatcatcatcatcatcacta

SEQ ID NO: 69277 - DNA, 326 bp, Zea mays
  Clone ID: LIB3078-057-Q1-K1-D4
ggttcttgcatttgatttactactcatgcttagtaattgtcatatgtaatttagtagattgctcacccgcgctagaaattggagaacaggctaccactgtcctaggatctgataccctctcatttagttagcaatgaatgtggaattaaagggccatcttagaaagtgaagagatgagaaagcgaacgagaaattttcattgcctgagattctgtgctatataggtgagtattagataatattaggcacattttcttttggtagtatcttacttgatgttggccgttggcattacatcgtggtgttgctttaagctagttagcaac

SEQ ID NO: 69278 - DNA, 431 bp, Zea mays
  unsure at all n locations
  Clone ID: LIB3078-057-Q1-K1-D5
ggccgaagcagtttgggatcggcggcgcccttccgcccaagaaggacctccaccgcttggtcaagtggcccaaggtcgtgcgcatccagcgccagcgccgcatcctcaagcagcgcctcaaggtgcccccggcgctcaaccagttcacacgtaccctcgacaagaaccttgcaacaaacttgttcaagatgcttcttaagtaccgncccgaggacaaagctgccaagaaggagaggctcttgaagagggcccaggttgaaaacgaggggaaaactgttgagtcaaagaaaccaattgttgtgaagtacggccttaaccatgtgacttacctcatcgagcagagcaaggcccagctggttgtcatagctcatgatgttgatccgatcgagctggtcgtgtggctcccggccctttgcaggaaaatggaggtt

SEQ ID NO: 69279 - DNA, 176 bp, Zea mays
  Clone ID: LIB3078-057-Q1-K1-D6
ctttcgggctgttcttagccaggaagctgtccctgactagggccctcttctacatcatcatgcaatgcctgggtgccatctgtggagctggagtggtgaagggcttccagcagggactttacatgggcaacggtggtggcgccaaggttgtcgaacctggttacaccaagggtgat

SEQ ID NO: 69280 - DNA, 451 bp, Zea mays
  Clone ID: LIB3078-057-Q1-K1-D7
cccacgcgtccgcccacgcgtccgcccacgcgtccggtttttgaatacggttgtcaccgatatccttcatctgcatggtagaaaactacatgcttacaaaggtgactatgacacatttgagaggacaagggaagagcaccttaagaatcagcagaaagcctttgaaacaaatgagaaggccagacagcacatgcagacattcattgacaagtttcggtacaatgcaaagagagcatcacttgttcaatcaagaatcaaggcattggagcgaatggaacatgttgatgcagttgtcagcgatccagactataaatttgaatttccaaccccagatgaccgtcctgggccaccaatcatcagcttcagtgatgcctcatttggttaccctggagggcctaccttgtttaaaaatttgaattttggtatcgacctggacagccgcatagcaatg

SEQ ID NO: 69281 - DNA, 204 bp, Zea mays
  Clone ID: LIB3078-057-Q1-K1-D8
gcaaaaaacgcaaaagcacataatgctgcagctgctaatgatggtcaaccaattgctaaggagggagaagagaaagtaaagctgcacacacattcatactgttgcttggattatgctcagatctgtgatgttgtaaggtaccggattcaccgcatgaagaaaaaattgaaggatgaattggacagcagaaatacaattcaacat

SEQ ID NO: 69282 - DNA, 402 bp, Zea mays
  unsure at all n locations
  Clone ID: LIB3078-057-Q1-K1-E10
gtcaccatcaccacccgcaccacacacgagcatacgcgacgactgacaaggcgaggggagcactcggcggcgatgggcggcggcggcgcacatggcggcaccacctacaagggctacaccatcccgcacaacaagcgctggcacaccgtcgccggcaagggcctctgcgccgtgatgtggttctgggttttctacagggctaagcaggatggtgctacgctcttgggtttgcgtcatccttgggatggacatgatgaccactctcatggtcatggacacgggcatgaggcatcatcatcgtcatcttcacattaagttccttactggctgcggacgatgctnggcatgttccaacaagctaaagtttgagtaataaattctatcaccctgcatgggactcat

SEQ ID NO: 69283 - DNA, 375 bp, Zea mays
  Clone ID: LIB3078-057-Q1-K1-C2
aggctacagctcccgtctctccgccgcttgcttggaaaacgaagaaaccctcctccaccaacccaatccagctacatccgtctgggtgaactccagggccaggagcagttcgccgccttcgttcgcatcacctacgcggttcgatccaactggcaggaaggaacgtgatggccaagacgagctcgttcaagctggagcacccccttgagaagaggcagtctgaggctaatcggatcagagagaagtaccctgacagaattccagtgattgttgagaaggctgagaggagtgacattcctgacatcgacaagaaaaagtacctcgtccctgctgatcttacggttggacaattcgtgtatgttggtaggaagagaa

SEQ ID NO: 69284 - DNA, 425 bp, Zea mays
  unsure at all n locations
  Clone ID: LIB3078-057-Q1-K1-A7
ctacctcgatggcacgctgcccggcgactatggcttcgacccgctgggcctctcggacccggagggcaccgggggcttcatcgagcccaagtggctggcctacggcgaggtgatcaacggccgctacgccatgctaggcgcggtgggcgccatcgccccggagatcttcggcaagatgggcatcatccccccggagaccgcgctgccgtggttcaagacgggcgtcatcccgcccgcgggcacctacaactactgggccgactcctacacgctcttcgtcttcaacatggcgctcatgggcttcgccgagcaccgncgncttcaggactggtaccaacccgggctccatgggcaagcagtacttcctcggcctcgagaagttcctcgccggctccggcgacccgtcctaccccggcgggcccctc

SEQ ID NO: 69285 - DNA, 176 bp, Zea mays
  unsure at all n locations
  Clone ID: LIB3078-057-Q1-K1-A8
gtcgcagctgacggacgactgaaccaccgacagacaacatggccgnctccgcctccaccgtctccggcctggccggcgcctccctggccagccgcccggcgttctccaccagcttaacgcggggcagccggttgtcggcaaggaaccccttgatgagcaggaccctgaaaaggaat

SEQ ID NO: 69286 - DNA, 437 bp, Zea mays
  Clone ID: LIB3078-057-Q1-K1-A9
gttgcttctactacacgacgacaaacatggggaagcctgcgaagatcggagagtgggggggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccacgctggcacggagtacaagattgatctgtgcaggttcgacgagagcttgacggagatctccgggaccacgggcccagcctacaacattgacaatctggtcaagtctctcaaattcgtcaccaacaaacgcgcttacggaccgtacggcaaggacgagggcaccccgttccgtgtcaaggtgatgaacaacggccacgtcgcttgcttcttttgccgctct

SEQ ID NO: 69287 - DNA, 312 bp, Zea mays
  unsure at all n locations
  Clone ID: LIB3078-057-Q1-K1-B1
ccattattgccgtctcccttttgcgtgagcaaagaaagagagcgagaagaacaatcgccatgtctgggcatatncacaggatcgaggagaagctccacatggggggcgaccacaagaaggaggatgagcaccacaagaaggccgaggagcaccacatgaaagatgagggggagcaccacaagaaagactgctgggagcataaggaaagcatcgtggagaagatcaaggaccagatcaccggcgagcactgcgacaagtccggcgaccacaagggaaaaaaggacaagaaaaagaagaggagaagaagagcac

SEQ ID NO: 69288 - DNA, 434 bp, Zea mays
  unsure at all n locations
  Clone ID: LIB3078-057-Q1-K1-B11
cgctcgggtgcgtgttcccggagctgctcgcccgcaacggcgtcaagttcggcgaggcggtgtggttcaaggcgggctcccagatcttcagcgagggcgggctcgactacctcggcaacccgagcctggtccacgcgcagagcatcctggccatctgggcgtgccaggtggtgctcatgggcgccgtcgaggggtaccgcgtcgccggcgggccgctcggagaggtggtcgacccgctgtaccctggcggcagcttcgacccgctcgggctcgccgacgacccggaggcgttcgccgagctcaaggtgaaggagatcaagaacggccgnctcgccatgttctccatgttcggcttcttcgtgcaggctatcgtcaccggcaagggccccctcgagaacctcgccgaccacatcgccgaccccgtcaacacaacg

SEQ ID NO: 69289 - DNA, 433 bp, Zea mays
  Clone ID: LIB3078-057-Q1-K1-B12
cccacgcgtccgcccacgcgtccgcccacgcgtccgcggacgcgtgggtgggcgcagagaatccccaagcaaacaaacagggtagagggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaagatggtgacttgtacctcttcgaatcacgagcaatctgcaagtacgctgctcgcaaaaacaagccagagctgttgagggaaggaaacctcgaggaggcagcaatggtggatgtttggatcgaggtg

SEQ ID NO: 69290 - DNA, 458 bp, Zea mays
  Clone ID: LIB3078-057-Q1-K1-B3
gcgctgggccgccggcgccggcggcgaagcggaaggagggagggaaggcggtgaacctgttcacggccgtcaaccaggcgctccacatcgccctcgacaccgacccccgcgcctacgtcttcggagaggacgtcgggttcggcggcgtcttccgctgcacgacaggcctcgccgatcggttcggcaagagcagagtgttcaacacgccgttgtgtgagcagggtattgctggatttgccatcggcctagcagcgatgggcaatcgagctatcgcagaaatccagtttgcggactacatatttccagcctttgatcagattgtcaatgaagcagctaagttcaaatatcggagtggaaatgaatttaactggggaggcttaacgattcgaactccctatggtgcttgtgggcatggtggtcattaccattcacagtcaccagaggctttcttctgtcac

SEQ ID NO: 69291 - DNA, 334 bp, Zea mays
  unsure at all n locations
  Clone ID: LIB3078-057-Q1-K1-B4
cagctctatcagatagagagctgacgtgaggtgtgaaacgcggatcgtggagtactactcagtaggagaggtggngagggggaagaaaggcgatagccgggaggatggtgcttgtgcttgcgctgggggatctgcacatnccgcaccgggcgcccgaccttcccgccaaattcaagtccatgctcgtgcccggcaagatccaacacatcatctgcactggcaatctctgcatcaaggaagtccatgactacctgaaaagcctttgccctgatctccatattaccagaggtgaacatgatgaggatgctcgatacccagagactaagacacttac

SEQ ID NO: 69292 - DNA, 452 bp, Zea mays
  Clone ID: LIB3078-057-Q1-K1-B5
cggacgcgtgggttttggtttcaggtggagccgaaccaagacttccatgggctggtatgcgagggcgccaacatgctaccgtccaagttcatggaagatgcatttcgcgatcgccatggaaaaattattaacattaggcatctggatcaagtgatcaagtctgttaacagatggtatcaggagcgtggcctaactgggttggtttcatatgctgagatactttctggagggattctgaggctgcaggtttcagaagctgaggttaataacattagcattcgctttctagacaggaagaccggtgaaccaactgttggaaaaacacagacggaaaccatccttcggcagcttaccaccaagaaagggcaggcttacaatagagcacaagtgaaaagggatgtagaaacaatacttactatgggaatcatggaagatgttacgataatcccaca

SEQ ID NO: 69293 - DNA, 327 bp, Zea mays
  unsure at all n locations
  Clone ID: LIB3078-057-Q1-K1-B6
cccacgcgtccgaaaagggccatcggtgagttcaggtcggaggagcggctcatgctggagcaagccttattgcaggaggaaaagcaagctatgctgggactgagggcagagatggagtcgagagagaaagctggtcgcgaggctgccgaagtgaagatgcgtttggcaatggagcatgctcgtgctgaggcacaagctcactctgagatgatgaatcatggtcctataagggccagtgctgttgcttcgcaaggggaggatggtccgagtcatgacatggtgcangaacatggcgaaaatgggtgggggaattctcaaagggatgat

SEQ ID NO: 69294 - DNA, 406 bp, Zea mays
  Clone ID: LIB3078-057-Q1-K1-B7
cccacgcgtccgcccacgcgtccgtgagacggctgcaaattccgagaaagccagcattgccgaagttgagccactggtaaaggatttcgcgagccggtataaggccgcgatcgagctgatgcactatgatgtgatcacatctttcagcaacttcctgtgcgggatggagatcttgaaagcgacgctggaacagttcctgctatactacaccaggctctccgagtgtgtcaggagaatcaacggcggctctgctctaaacagggaccttgtgtccatatcctccatcctgttcgaaatcaagaagtattctaggacgttatagttgtttcaccctcttacatgtacactaggacggctagctgaggggtagctgtgtatccttactttgtaactggtatgtgctact

SEQ ID NO: 69295 - DNA, 251 bp, Zea mays
  Clone ID: LIB3078-057-Q1-K1-B8
ccgagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtcccgcccctccgcgtcctgctgtagcggcgtcaggaacctcaagagcgc

SEQ ID NO: 69296 - DNA, 320 bp, Zea mays
  Clone ID: LIB3078-057-Q1-K1-B9
acgcaggcacgtgtgctctcttgcatcatggcatgtccctacaggttttgagttatggggtgtgtctctatggatgccaaaaagctcctgcagctggtcgaagagaagaaaaggaggatcctcgagaagaaagaagccccactaaagtggcagcagaagcttgaagcaccagttaacgtcaaagctgatgcagaagcgaaggcgaaaaaactaacatcaagatagcataggaggagaggagattcttcctcggactctgacagtgactatgacagcgaatgtgatcggaaacaccggaggaagaaggatcgtagaaggaa

SEQ ID NO: 69297 - DNA, 249 bp, Zea mays
  unsure at all n locations
  Clone ID: LIB3078-057-Q1-K1-C1
ttggagatgattccgtattacaatttggtggaggaactntaggacatccttggngaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccatat

SEQ ID NO: 69298 - DNA, 445 bp, Zea mays
  Clone ID: LIB3078-057-Q1-K1-C10
cccacgcgtccgcgacgatgcgctcgccggacggcaagaagctggacatgctagcggaggaggacctcggcagcatgccctacctcaaggcgaccatcaaggagacgctgcgcctgcacccgccggcgccgttcctcctcccgcactactccaccgccgactccgagatcgacggctacttcgtcccagccgggacgcgcgtcctcgtcaacgcctgggcgctcgggagggaccgcacgacgtgggagaagccggaggagttcatgccggagcggttcgtgcaggaaccgggcgccgtggacgtccacatgaagggcaaggacctcaggttcatcccgttcggctccggccggaggatcttgccccggatgaactttggattcgcgaccatggagatcatgcttgccaatctcatgtaccattttgattgggaggttccgggctc

SEQ ID NO: 69299 - DNA, 438 bp, Zea mays
  unsure at all n locations
  Clone ID: LIB3078-057-Q1-K1-C11
actggatgtgccaatagaaggttgtgacctgtttgtttaaaccgaaaattaggccatgggcttatttagtgaaccatgccccaaatttgaatttaccattatccctctacgactaaactcatgtaaatgaatgtttagataatttctttgttggacataaaatgtacccaagcttaaaccaagaatctcaaaccatgtctccttctagaaccattcccttgttcagttgatgcaggttgaggtctctattgtatttggcctctccttgcggattgcattgttgctttatcaacccaacctgngaaagtcatgcctgatcattttccttaatttggtgtcattgatttcttcatatctattgaaggcataccaacttcatcttgtgattgttttcctctgtatctaatcggatactaatccttgaccttgtaatctctg

SEQ ID NO: 69300 - DNA, 443 bp, Zea mays
  Clone ID: LIB3078-057-Q1-K1-C12
cccacgcgtccgcctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttggttatgaataagatttgtttttt

SEQ ID NO: 69301 - DNA, 334 bp, Zea mays
  Clone ID: LIB3078-057-Q1-K1-A6
gaggaatttaaagaagccttggctgattgttaagagaagccagaatttattcctggagagcaaggtgtaatacaagtagctggtcattcagatgcagttacagttgtgacacggatagtaggttgagcatgtctgaaaactacagtatgctgcattgtgaactggtcaagacatcaaattgtcaaacatcgagacactcattgcataatggtacttcttgagcttccccttgctcacaagcacaaaatgaccaatattccaggtgatgctaatcgctttgcgatatatcatattatacagagcttatactaaggtgcactatagactattatta

SEQ ID NO: 69302 - DNA, 419 bp, Zea mays
  unsure at all n locations
  Clone ID: LIB3078-056-Q1-K1-H11
cccacgcgtccggcaggagaccctcctcagctagtacctaccggccagtagtcgtcgcgtctgcaggcagatctgagttagccggcggatccgatccgtgcgcgtgctgctgtgtgtgtgtcggtggagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgacccgttcatcggcagcctggagacgccggtcacctccagcccgctcgtggcgtggtacctctccaacctcccggcctaccgcaccgncgtgagcccgctgctgcngggcgt

SEQ ID NO: 69303 - DNA, 451 bp, Zea mays
  Clone ID: LIB3078-056-Q1-K1-H12
aacccaactacttctcctagtcttgttgcatctgcacagggtctacagaatgaggacttctccgcaagccagctaagtaaaatgttcggatctcatgcaacgatgatggccaacacccttcgcacaccaatcattgtatttacacagacaggctccatggctgtcctcctgagccactatcgtccctcgtctacactatttgcatttacaaacgaggaacgagtgaagcaacggctagcactctaccagggcgtcatccctattcacatgcagttctctgacgacgcagaagaaactttctccagagcaattagcagcttgctgaaagcacaatatgtgaagaagggagactacgtcactcttgttcagagcggagtgacttcaatctggagagaggaatccactcaccacatccaagtgaggaaagttcaggtctgatgtgccggtggga

SEQ ID NO: 69304 - DNA, 360 bp, Zea mays
  unsure at all n locations
  Clone ID: LIB3078-056-Q1-K1-H2
cccacgcgtccggtcgggtcttcaagccacaccaaaccacactgcgacacacagtaggcgaggcgaatgagaggcaaggcggcgcggcgggcaagatgtttgacgatcaagacctgngcttctttgccaatttcctgggcatcttcatctttgtcttggttattgcgtaccacttcgtgatggcagacccgaagtacgaaggaaactgatgtcctctagtgcaaagatcctattatctgcaggccgaaatagggctatactggtagctaatgctagtgagatcgcttgacactttgagtgcatatcatggaagctggacatgcaattcctggcattttggttttgcccatgttttaatct

SEQ ID NO: 69305 - DNA, 268 bp, Zea mays
  unsure at all n locations
  Clone ID: LIB3078-056-Q1-K1-H3
cccacgcgtccgcccacgcgtccggttcaagcgaccgacggcgaacatggcggcggacggcggcccagcgacgtcggcgctggaagaggccctcaagcccttccaggaaagaccctccgaggctgagatacgcatagcgaagctggaagccttgctgtacaacaaagatggtccgagcggtggatccgaggcaacttactctgccgtgaaggatctccagtcgaagctagatgttgntactgcagaatgcttgactgaaagggataag

SEQ ID NO: 69306 - DNA, 402 bp, Zea mays
  unsure at all n locations
  Clone ID: LIB3078-056-Q1-K1-H4
cccacgcgtccgcccacgcgtccggcttattcagctgttgcctgtcctactgctgctggtgctcaactttctgccatcctcggagcctgtctactcgctctctcgttcctacccttatgagcataagttccaaaccccccgtggagttccatactatgtcaagatgtctaattttgaggagcagtatccacaccaaagcactgagcgagcaacagtggagcggcatgttgagagggattattattccataatcacacagaattgtanggtcgagctgcagcgtcgccaatggggcttgtcataccagacaccacattgtgatatgcttccaaagtttgaggcaacagcacaataataattcatccaatgggggaaagggagagagaatgctgggctcatgaa

SEQ ID NO: 69307 - DNA, 391 bp, Zea mays
  unsure at all n locations
  Clone ID: LIB3078-056-Q1-K1-H5
tgctcgtactcggttccgtgaattcccggcgtcgactccacgtccgtccgtgctttatctccannttccaagnnaagatntgtnngcatccgtgatnngtgaagactgnnnaaaatatgctgtctggtgacaaannacgagaaccccgtgtaagaatcgcnttgattttgnnngtgttgcttcngnnccttgnannagcttnncaaatcncnncagtgacctatgaaacgggcngnaaatactggaaccgctnnntggttaccanntggcacnnctgaggggttcttcnnaatggannaatccctttacatacagnngaaatgcngnnatgtttaccagnncttcgggaaatctgtnnttgtgggaagaaatatactgctnnngtgatatg

SEQ ID NO: 69308 - DNA, 378 bp, Zea mays
  Clone ID: LIB3078-056-Q1-K1-H6
cccacgcgtccgcccacgcgtccgcccacgcgtccgggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttggttgctcccgctatgaaacgagacgagagaagaatgagcaaggtttttgttcgcagctaaaaaaaacttataggcaacctctctattataacttattcaaacggtgaaaggaaaaa

SEQ ID NO: 69309 - DNA, 425 bp, Zea mays
  Clone ID: LIB3078-056-Q1-K1-H7
gttataatgccggcaggggggcccacttgacactcaaaaggactgaaaaagctggtagggtggttaacaggatcccaggactggtagatgttgtgaccacaaaaattgtagcttgggagacagaacgaagaaaggagttcacatatgatggtgtccacctgcggtctatgcttgtagactacataatcattctccatgagtgagagctatagaataagaagcacagggatcagaagaagatccaggatcaactgaaagctgagcacgaagcgctgtatggatgaaaaccaagtacatctaagactgaaagtgcgaacaaagtgcctagacaattcatgggtggtgcgaaccgaagactgtctattggtggaatcacaacgcaggcccccaaaactgatataatgcacttgaagacagcttgcgct

SEQ ID NO: 69310 - DNA, 374 bp, Zea mays
  Clone ID: LIB3078-056-Q1-K1-H8
caagaaccaggaaaagttctacaattctgccacatcatctctctcgggccctggcgtagctctaggaatgtcgaagatggctgcgcagactgttggtaactcagtatccgagtttctgtcgggcttcagcgatgggaagacagactcggcagcgagagtttctttcaagtacgggtgcacgaggggagtctttggcgcgccgttcttctttgtgaatggcttcctccagcctgggggcggatcgcctatcgactacagcacgtggatcggcatcctggacccccttgtttcccagaacggtgaacggatcgagatgtttacttcgatgtgagtgattgaagtggccttgctacggaggatacggtcgtacagat

SEQ ID NO: 69311 - DNA, 443 bp, Zea mays
  Clone ID: LIB3078-056-Q1-K1-H9
cccacgcgtccgcccacgcgtccgaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccggcggatccccccctccgtgcccgggatcatgttcctctccggcgggcagtcggaggtggaggcgacgcagaacctcaacgccatgaaccaggggcccaacccgtggcacgt

SEQ ID NO: 69312 - DNA, 294 bp, Zea mays
  unsure at all n locations
  Clone ID: LIB3078-057-Q1-K1-A1
ccacgctcaagcccatcctcgacgagatcgagtccggcggccccgccgccatgatgaagtactggaacgaccctgaggctctgcagaagttcggccgcgcgatgggcgtcggcgtcggcccgtccggcgaggccggcggcgcagagcacgccgaggcggaggacgacgccggggaggaaggcgagtacgaggacgagtccatcgtccaccacaccgncagcgttggcgacgtcgagggcctcaagaaagcgctggaggacggcgcggacaaggacgaggaggactcggaagggc

SEQ ID NO: 69313 - DNA, 311 bp, Zea mays
  Clone ID: LIB3078-057-Q1-K1-A11
acgtacgaccgtgtccatgttcaacgacatcaacacgcagctggacgtgaaccagacctactacgggaagctgggcgagctccgctgcctgttcgcctacgacgtcgccatctggagtcccgtcaccaggtctttggcaaaggtacggctgccacagcatcagcttgtcgaggactactacctcgggaagcacaggctgagccacgcgcagagcatgatcgggatctcagggctgccacatggcgctcatgggagccctcgacggataccggattgtcgacgggccggttgattaggctattgagccggtg

SEQ ID NO: 69314 - DNA, 184 bp, Zea mays
  Clone ID: LIB3078-057-Q1-K1-A12
ataatgattgtcatcaagtgtacattcattcttgcttgacagtgttagacgtgtaattaatataagctgtccgattgtgtaaacagtaaacccatatggcatctgttgtgttacaacttacactttctaacttcattctcataacatcatgatcaaagattcgatgctacccattgattgtcac

SEQ ID NO: 69315 - DNA, 108 bp, Zea mays
  Clone ID: LIB3078-057-Q1-K1-A3
gtccggtgctcggaccgacaaagcgcttggctacaaaagttggaccgtggggtgggagcggcgggtctacggtggacatcacggcagagcctcagcgtctgaagagca

SEQ ID NO: 69316 - DNA, 363 bp, Zea mays
  unsure at all n locations
  Clone ID: LIB3078-057-Q1-K1-A4
gttttcctcagctcanagaaatctggcaagggtaagaagcctggcaagggcggcaaccgattctggaagagcattggccttggcttcaagactcccagggaagcaatcgaagggacctacattgacaagaaatgcccattcactggaactgtttctatcagaggcagaattattgctgggacatgccacagtgctaagatgaacagaactatcattgttcgcaggaactacctncactntgtaaagaaataccagaggtatgagaagaggcactccaacattcctgctcacatctctccatgcttccgtgtgaaggaaggtgaccatgtcatcattggccagtgcaggcccctgtcaaaaact

SEQ ID NO: 69317 - DNA, 454 bp, Zea mays
  Clone ID: LIB3078-057-Q1-K1-A5
gatgaattgaaagaagccttggctgattgcgaagagaagccagaaattattcctggggagcaaggtgtcatagaagttgctcgccatccagatgcagttacagttgtcacagggatagtaggttgtgcagggctgaagcctacagttgctgcaattgaagctggtaaagacatagcattggcaaacaaagagacacttattgcaggtggtccttttgtgcttccccttgcacacaaacacaaagtgaaaattcttccagctgattctgagcactctgcaatatttcagtgtatacaaggcttgtccgaaggtgcacttcgtcgcattattctaactgcatcaggtggtgctttcagggactggccagttgacaggctgaaagatgtaaaagttgctgacgctttaaagcatccaaactggaatatgggaaggaagatcacagtagattctgcta

SEQ ID NO: 69318 - DNA, 259 bp, Zea mays
  Clone ID: LIB3078-056-Q1-K1-H10
ctcacgcgtccgatcacgcttctgatcctaccgtgtgagctcgacgcctcgggggacacgtccagacttacaccctaagctcaactattacaacacaacatcatcttgccgatcacataacctcaaatactaccttacatgtatcatctcatcgatcagctttcatatgactttgaatacggtcgttgatccaaatgctgaagactatgctgcatacactggaacgaatgatgatatgcatgtgcacatgcatctgctc

SEQ ID NO: 69319 - DNA, 376 bp, Zea mays
  unsure at all n locations
  Clone ID: LIB3078-050-Q1-K1-C10
atagggccggaccgactggtgacggaaagcgacctccctcgcctcccctacatcgaggcggtgctcaaggagaccatgcgcgtgcaccctgccgcgccgatgctggcaccccacgtggcccgcgaggacacatccgtggacggatacgacgtgctcgctggcacggtcttgttcatcaacgtgtgggcaatcggccgcgaccctggactgtgggacgcgccggaggagttccggccggagcggttcgtcgagagcaagatcgacgtgaggggccatgacttccagctgctgccgttcggctctggccggcgaatgtgccccgggatcaacctcgcgctaaaggtgatggctntgagtctggcccatctgctacacg

SEQ ID NO: 69320 - DNA, 387 bp, Zea mays
  Clone ID: LIB3078-050-Q1-K1-C11
agcagccaaagcagggccggcccgacgggagcctgcaagggctacatcttcgccatgggggtcacggaggagctggacacgtggccggagcaggacacgcacgaccggcggtgggtcgctcccgccgaagcctaccagctctgccggtacgactggatgcgggaggcgctcaccgcgctgctggagaggctgccggtgctcgaaccggtggtggctgccgcggcggctgcagccacggcggaactgacgaccgaccaagctggcatgtacatgatgctgcaggcgacctcggacggcgctgtggcgctgtgctagctgattgatggacgacattggtgttcgattctcagctagtcacgaggtcttagtatgccctgcaagtgtcgt

SEQ ID NO: 69321 - DNA, 343 bp, Zea mays
  unsure at all n locations
  Clone ID: LIB3078-050-Q1-K1-C12
ctgccatctaccagcgactcagctagcgttagcagcacacacgcacctacctaggagcagcatctccggcnctggaaacggcggcctacatgatctcctcgtcagctctggccgtggcgcctcacggtctgccgcctctcagtcgccgcgcctcctgcttcgccgtcgtctgctccaagaataagatcaagaccgacaagccctactggattggaggtggactgaccgtcgacgtccacgcctaccgaagaaaggccaagggcaagggcgtgtaccagtttgtcgacaagtacggtgcgaacgtcgaccgatacagnccaatctacaacgatgatgactggtc

SEQ ID NO: 69322 - DNA, 211 bp, Zea mays
  Clone ID: LIB3078-050-Q1-K1-C2
cccacgcgtccgcgggctgctagtattccctgctgtttggtgttttcgtatcggaggacgtctgtagatgtacaattcctcaggccccttgtgttcggcttgaggaagtttccgttgtaccctggacctgctatagccggttgattcttcaattgtattcctaaaagttactacacagtcgatatgttccttttcttttttgcatagtagc

SEQ ID NO: 69323 - DNA, 365 bp, Zea mays
  Clone ID: LIB3078-050-Q1-K1-C3
gccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgagggcgggcttgactacctcggcaacccgagcctgatccacgcgcagagcatcctggccatctgggcgtgccaggtggtgctcatgggcgccgtcgaggggtaccgcatcgccggtggcccgctcggggaggtg

SEQ ID NO: 69324 - DNA, 387 bp, Zea mays
  Clone ID: LIB3078-050-Q1-K1-C4
accagaaaggatgctcctcggcgtctgtgccgtgctgatggtggtcggcgtcacgaacgcggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgccgacctccacggcgccgactgccacgcgcagctgcacagcgccgccaataacgcgccttgccctgggcaggagccgtccaggatcgcgcccatgtcaggcggcaccttcgtcgccgtgcctggcaagatgca

SEQ ID NO: 69325 - DNA, 393 bp, Zea mays
  unsure at all n locations
  Clone ID: LIB3078-050-Q1-K1-C5
cccacgcgtccgcccacgcgtccttccacgcgtccgcccacgcgtccggtatccgttggttccgcgcctgttggtccgctgcgcacgccggatttttgcatcgagcacggagatctacaacaaaaacatggagctacgacgcgactcccaagcatgtttgaaccatagcaattggtggacgtgtgtagagaagattgcaaaactgcagtatgatggattccactattcatcaaccgagatcatggcgcgcttcaatcgtggctacgctgatggggaattgatccgttatggctcgtggctgtggagatgtggaactcatgggttatagtgtgcttcaatcatgggtcatggcgatgctgatggaacttgattgntaccaaggtttaagttttc

SEQ ID NO: 69326 - DNA, 411 bp, Zea mays
  Clone ID: LIB3078-050-Q1-K1-C7
gtggatgctctacattctcgctatcgcgtcgttaattgccgttggaaaggaaggtttggggttttggagctgatgaagtaagcgaagctcgaacgacgctctctaggtgtccgtcggatttccgatgccagacgtcgtcctctctgttccgtgtctccctgcatcttcatcgatgtagcatcggtcgtcaacctcgccgtggcagctctcaaactaggagtgttggtgcaaaaccgtcgtcaccccgtcattgcaggtcgctgcgctatcgtttgcttatgtttcatcatctacgccatggcacttgttattgtccctagtttaattctatgtgtggttaatggtcgaagtgtagattgcaaatgccaattttaatgaagggtatgtgtaggcatatatgtgatgagctgt

SEQ ID NO: 69327 - DNA, 418 bp, Zea mays
  unsure at all n locations
  Clone ID: LIB3078-050-Q1-K1-C9
cccacgcgtccgcccacgcgtccgcccacgcgtccgggtggccgtcattggcagcggcgactggggcagcgtcgcctcccgcctcatcgcctccaacaccgccaagctgccctccttctatgatgaagtaaggatgtgggtgtttgaggaaatactgcctacaggcaggaagctatctgagtccattaacgaacagaatgagaactgcaaatacttgccaggtataaagcttggaacgaatgttattgccgaccctgacttggagagcgcagtcaaagacgcgaatatgctggtttttgtgacgccccatcaatttgtggagggtatatgtaagaagcttgtanggaagctaacaccaggagctgaggctatctccctcatcaagggcatggaggtcaagatggaaggccatgcatga

SEQ ID NO: 69328 - DNA, 395 bp, Zea mays
  Clone ID: LIB3078-050-Q1-K1-D1
cggacgcgtggggtcggatatgagtgcagatgagtgggatgtattcctcgaaaaattggaggagctgctgaaagaggcactgcacgagagcgcaagggcagcagcaggtcaaaggatgaagcagcggctgggcacttcatgcaagttttgagcagggcaatagcgcatcagagaagaaaaaaaatatgcagtgctacttgtactgcttgcttatggagtgagtacatgatgaagatatcatcgtatgcggcaccttcaaccttaccttgtgcaacgatctaggttgcagcagccatgtccagcaggtagataggaccacaagcatatgtagtgacggtgtggagaactgcgacgcgtgtttattagctatatgtttacgaaggggaatgcttaat

SEQ ID NO: 69329 - DNA, 361 bp, Zea mays
  Clone ID: LIB3078-050-Q1-K1-D10
tcggtgcgccgctgacacttccgttccggggcgacttccgcccgctcgccccgagcgccggaggatgatgtgcgttttggacggttcttgtccggtccgtgcgtgaatggaggggaggacgtgtcggaaggtaatcagcttctcgtcggcgggacaggggggcgaggaggctgcgaggcgagagacgccggatgagacacggaagcggctggaggagctggatgcgctgctggaggggctggtcgaggcgtcgagcccatggtgcggccttcaacgccaccttgtcctccggatccgtacttggaccgaggcaccgagccaccgagccatgataacgggacggggatcatcagccgatgag

SEQ ID NO: 69330 - DNA, 436 bp, Zea mays
  Clone ID: LIB3078-050-Q1-K1-D11
aattccgtctcgacgcactcgttcgcgctcaagaagtctgtcaagccacctggtcgcccatttggctctggccctcctggtgagcgcccaaggggcccatgtcgttttgacggcgacaggccaaggtttggtgacagggatgggtaccgtggtggtcctcgtggtgctcctggtgactttggtggcgataagagtggagctcctgctgagttccagccatcattcaggaggcctggctttgggcgtggtggctgcagcggcttctgcgcatgcccaacctcttcttccatggagtgaagttgcccttggtttggacatggtgtttcccttcgcatgtggcctttagttctgaaggacagttattatgtactagtaatattactcggatcggccagtgctgacatatgcaaaaaaatgttctgtcggtatacaattg

SEQ ID NO: 69331 - DNA, 291 bp, Zea mays
  unsure at all n locations
  Clone ID: LIB3078-050-Q1-K1-D2
cccacgcgtccgcagacgcgtgcgctctgccagcgggcggtgatatgggagtagcacgactggcgagccaacgtggcgagaggtgtctggctgctctgaccatacctgttgctggcgctcgtgaacctaagcgctcggtgctcactcgcggcctccgcagatgagcctgctggatgccaacangagctggatgaggagaagaccagtacgagggccgcttaccaggaattcggtggcgctgaaacgtcatgggctatgtctgacatcgcttgggcgtttaatacgacattt

SEQ ID NO: 69332 - DNA, 391 bp, Zea mays
  Clone ID: LIB3078-050-Q1-K1-D3
cgcactcgtcctccgacggggagaggcccgaggtcgaggtcgaggttgaggccgccgatcaggtggaacgggccggggtcacggcggcggctgacgcgggcgagggggctgtggcgaagggaggagggccggcccagtggtggaggctgccgctggacgtgctgcgggtgtgggcgctgcgcgcggccaggagcgtctggtcggtgccgctcgccgtcgcgctgctcgggttcgccgtgctcgggcgccggctgtaccggatgcgccgtcagagcaaggccgtcgcgcgcgtccgcctcgtcctcgacgagaagaaggtctcccaattcaagggccaaggatcacgtctgaatgaatccatgacggtggcgcggcgaactcctatcataaa

SEQ ID NO: 69333 - DNA, 402 bp, Zea mays
  Clone ID: LIB3078-050-Q1-K1-D4
cggacgcgtgggacgtcgacatgatcatgctcgcgcacaaccccggcggcaaggatcggcaggagcgccagttccgcgagctcgcaaagggcgccggcttctacgggttcaaggccacctacatctacgccaacgcctgggccatcgagttcatcaagtgaaccaccgtcgccgcgatgagatggcatggctgccacatgctttgcttgcttggtcctcgtatcgtacgtcgccgtcgtcgtcttcttctggttattgcgctgctacctcgctgctctcgcgtatgcatgtacttttgcttaattgtctttcttcatatcatgcactctggctggcctagactgcccccgatccatggtggccggtacgtcttgtcgagctcttgcatgtcgtggattctaa

SEQ ID NO: 69334 - DNA, 404 bp, Zea mays
  Clone ID: LIB3078-050-Q1-K1-D5
caaggataggatggccagccaaccagccgcggccaacgctaggccagcgaccgtgcagatccgcgggcaacccgtcaaccagaagacgtcttgctgctcgtcctaagattgcctcatttctttggttccttgtgactatttctacggtttgtgcgcgcacgcaaatgtatttgcattattcctgatagcatctattcgttggccagatgattagagagctgaaaatatgttaagaacaataccatagagagaagttcctcagtgctctcgcagcttaaggagcaaacagcaacactttacttcgttttttatactttattatagccgcactgtttattactcgggctacatttgtgaacagcgactgtaatatttttttactctatattcgtagtgagatgaat

SEQ ID NO: 69335 - DNA, 387 bp, Zea mays
  Clone ID: LIB3078-050-Q1-K1-C1
cttggcgtggccgggatgctcatcccgtaggtgctgaccaaagccgggctgatcaacgcgccgcagtggtacgacgccggcaagtcggagtacttcgcgtcgtcgtccacgctgttcgtggtcgagttcatcctgttccactacgtggagatccggcggtggcaggacatcaagaaccccggcagcgtcaaccaggaccccatcttcaagagctacagcctgccgccgcacgagtgcggctacccgggcagcgtcttcaacccgctcaacttcgcgcccacgctcgaggccaaggagaaggagctcgccaacgggaggctggcgatgctggcgttcctgggcttcctgatccagcacaacgtcaccggcaaggggcccttcgacaac

SEQ ID NO: 69336 - DNA, 315 bp, Zea mays
  unsure at all n locations
  Clone ID: LIB3078-050-Q1-K1-A3
gtcgagaaggatactgaagagacacctaagactggcagtaactctaagaaggaaggtgcaaagccctctcgatctactggaaaggctaaggattctgttgtcaaggcaagcagcaaggatgaggctgatagcaccgacaactcaaaggatgctgctgccagtgaagacaaggattcaaaagatgaagtgaaatccagtgaagctatcgatggatccaagacaaatgacctttcaaccaaaaggaagccagatgagaatgaaggtgagtcatcagaggaggagaaggcgtctactaaaactactaccaganagaag

SEQ ID NO: 69337 - DNA, 365 bp, Zea mays
  Clone ID: LIB3078-050-Q1-K1-A4
acgcgtccggttccgcaggatacttacaagacacctttttttagcagtaactcctcaatcgctatcggtcgccatctctagctactggaaggcctaaggacttagcaatcatggcactcatcaacaataaggctaatatctccgtcaactcacacgatgctgataccatttactacacagaatcaaaacacgacatcaaatccagtcactctatactcatatccaagaccaatgaccctgcaaccaaaagcaagccatattataatgaacgtcattcatcataggcctagaatgctgtctacttacactactaccagagagatccacactacaatgagccgcatctagatgaccacaagctatgc

SEQ ID NO: 69338 - DNA, 321 bp, Zea mays
  unsure at all n locations
  Clone ID: LIB3078-050-Q1-K1-A5
ggcggcgtgggcgccacgctgcacgccatcacgtcccgccacccgcacatctccggggtcaacttcgacctgccgcacgtcatctccgaggcgccgccgttccccggcgtgcgccacgtgggcggngacatgttcgcgtccgtgcccgccggcgacgccatnctcatgaagtggatcctncacgactggagcgacgcgcactgcgccacgctgctcaagaactgctacgacgcgctgccggaaaatggcaaggtcatcgtcgtcgagtgcgtgctgccggtcaacacggaggccacccccaggcgcaaggcgtgttcaacg

SEQ ID NO: 69339 - DNA, 381 bp, Zea mays
  Clone ID: LIB3078-050-Q1-K1-A6
gccggcctcgtcgccacgctgcacgccttcacgttcggcgacccggacatgtcggggggcaacttctacctgccgaacgtcatttcagaggcggcgccactcaccaccgtgcgccacgtggccgcggacatgttcgcgtccatgccctccggggactcgattctcatgaaggcgatcctgcacgagtggagcgacgcccactgcgccacgctgctcaagaactgctacgacgctctcgccgcgaatggcaaggtcatagccgtcgagtgcgtgatgccggtcaacacggacgtcaccgacaaggcccacggcgtgttacacgtcgacatgatcatgctcgtgcacaacctaggcggcaacgagccatacgagcgcgagttc

SEQ ID NO: 69340 - DNA, 289 bp, Zea mays
  Clone ID: LIB3078-050-Q1-K1-A7
cggacgcgtgggcggacgcgtgggcggctacgtctacgtcggtggaaccactgggcggctgatctgggccggcaccctggctgggatcctcggcggtggcgccctcctcgtctacaacaccagcgccctgtccggctaaggatatccaatgcatgcgctgcttgcgattcgtcatgtaaaatcagggtgtctgtctataatctagccttcatggatgctcaaccttcgtcatgtaacaataatcagtgctactcttcattacataattttgatgctatatatatatacc

SEQ ID NO: 69341 - DNA, 396 bp, Zea mays
  unsure at all n locations
  Clone ID: LIB3078-050-Q1-K1-A8
cccacgcgtccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggcggggctgaagctggaggcgcgcgactccggcctgcagacgggtgaccccgncgggttcaccctcgccgacacgct

SEQ ID NO: 69342 - DNA, 278 bp, Zea mays
  Clone ID: LIB3078-050-Q1-K1-A9
ctggcgcgtgagctgcgaggccgtgtggttgaaggccacgtcgcagatcttcagcgagggtgagctggactaccgttgggacccgagcctgatccacgcgcagagcatggttgccatctgggcctgacaagtagtgctcatgggcgccatcgaggggtaccgcgtcgccggcggcccgctctgataggtcgtagacccggtctaccccaggagctgcttcgaaccgctaggcctggccgactacaccgatgccttctgggagctcaatgtgaaggagc

SEQ ID NO: 69343 - DNA, 400 bp, Zea mays
  Clone ID: LIB3078-050-Q1-K1-B1
ggaagatgcaaaatcgaaggaaatgctcgataagttgcatgaagcactgaaagagaaagatgaagaaatggagcatattgattctatgaaccagacccttattattaagcaacgaagaaccaatgatgagctggaagaagccaagaaagaactgactactgacctagttaatatgtcatcagctcgatccattgttggtgtcaaaaaaatgggtgagcttgacaataaagctttccttgcctcttgcaaagagaaaacagcagacgagttgtcattgtcaattctgtgctcgaaatgggaagatgagatcaggcaaccagaatggcatcctttcaaagttatagatgttggtggacaggcaaaggaaataattcgggaggatgatgagaagctgcaagct

SEQ ID NO: 69344 - DNA, 377 bp, Zea mays
  unsure at all n locations
  Clone ID: LIB3078-050-Q1-K1-B10
ggaatggcaggatcacctgcatgacgtttccccgggactggctgcggagggacctgagcgtcatcggcgtcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacgtggcacctgngcctgttcatcgtgctcaccttcggccagatcggattcaagggcaggaccgaggactacttcgagaagtgaagcggttaagatcctatccatcatccctggtgctgcgctgcgttgcgttgcgtgcgtgctcgccgcaatcgaacc

SEQ ID NO: 69345 - DNA, 287 bp, Zea mays
  Clone ID: LIB3078-050-Q1-K1-B12
tcgcaggaagaggcttcagcttctggtcctcgttccatagtcgaactggctactgcaaccagagaccaagaggaaacaaaagccacaaaaagagattcaaaacaaaataaagttggtatcacagagatggaggaaatttgtgtgggactgcaatgaatcaaggaacacgcaagccataagacgatgtgtttatggatgaagatgatgatgccatgccttcagataatgttgcaaaagatgacactaatgggttggcagagatggaagaggatgctctgacagaaata

SEQ ID NO: 69346 - DNA, 399 bp, Zea mays
  Clone ID: LIB3078-050-Q1-K1-B2
gggaaaggttatcctctgtgccttcatgtggtggtgcaattgacatgggagctccagcagcggtagctggcggtggcgcagcacctgctgaagaggcaaagaaggaagaaaaggttgaagagaaggaagagtctgatgaagatatgggtttcagcttgttcgattaaaacaccactgccagtttacagtttctctcgcgaatggtctcacaatattcgctggtttccacaaaataagattgtcaatagctactacgtacttatgctattctgcatgtgatgtacgagtgtgcatcttcaagaatctttaagttgaatggtcccataataatattgataacaatgtaaattgtatgtcctgtacgtactttggtatcgcgacatctcagtgtgcatcttc

SEQ ID NO: 69347 - DNA, 402 bp, Zea mays
  Clone ID: LIB3078-050-Q1-K1-B3
ctgatttactatcgctggagctgcttgaggaaaagggtaatacttggaagaatgatatgatgcaagctacaagcagcctatgtttgaattagtgaaatcggaaggccttgttgccattatagagtgtagacgcacctggatagataaacaggtgtgccggtgctgaaactattgcttgagatgtcaataaacactggaattatgttgttgtttgggggtggtataatgattcatacgtgtgtaatgcagtgtggattcattcccttgtacagattgtagataggtgagattctgcaataagtgacaatcacagatgtacatgtgtggtattcttgtctctgcgtgccgcaggtaggtcatgatagtttgtggctgacgattggggtatatcttctcttaaag

SEQ ID NO: 69348 - DNA, 374 bp, Zea mays
  Clone ID: LIB3078-050-Q1-K1-B4
cgtgcttgccgccggtaccgggctgggcgcggcgctgctgctggcgctggggccggcgcgcgcggcgtacgaggagtacgtgagcgagacgaaggaggtgatcgggaaggtgcggtcgacgatcgggctggacaagtcggacccgagcgtggccgacgcggtggcggagctccgggacctgtccaactcgtgggtggccaagtaccggcgggagaagtcgctgctggggcgttcgtcgttccgggagatgtactcggcgctcaacgccgtgtctggccactacatcagcttcggccccacggcgcccataccggccaagcgccgcgcccgcatcctcgaggagatggacaccgacgagaaggcgctccaacggg

SEQ ID NO: 69349 - DNA, 404 bp, Zea mays
  Clone ID: LIB3078-050-Q1-K1-B5
ccaaaatgaagagttttctgtgatagggaaagaaccaaaggatgaagttcagatgtacacatggaaggatgccactctccgtgagcttactgatcttgtgaaagaggttgctcttccagcaaggaaaaggaacgcgaggctttcttttgcatttgtatacccagacaagaatggtcgttttgttgtcagacaggtgggttcgaccttcgcttatggccatggaagaggtgatgatgccaaaactcttgcagagcttgggttccagattggcgattatctgagcgtcgcgatcatgtaactgcagattggcgattacctgagcgtcgcgatcatgtaagccggtgcccgcaatgagttccggtgactgcaccggatagaactgatgtgatgtaaaaaatgcattg

SEQ ID NO: 69350 - DNA, 385 bp, Zea mays
  Clone ID: LIB3078-050-Q1-K1-B7
gatgattcaataagcagtgaagttgatgacatcgatattatccctaacgaggaaatgcttttgattcttagtgagaaaggctatgctaagcgaatgaaccccgacacattcagtttacaacatcggggaaccataggaaagtctgttggaaagatgcgaatgaatgacagcacgtcagatttcattgtttgccagacgcatgaccatgttctttatttcagtgacaagggaattgtatactcagcacgtgcttataagataccagaatgtactagaactgctactgggactccgttggtacagttgctacctttatctgatggagagcggataacctccatcattcctgtgagtgaatttggtgagaaccaatatctagtgatgc

SEQ ID NO: 69351 - DNA, 401 bp, Zea mays
  Clone ID: LIB3078-050-Q1-K1-B8
cccacgcgtccgcccacgcgtccgatcgtctctcccacacccctctgccccaacccaggaaaaccctcgaaaagcggcggcggcgcgacatggcggaggtcgaggctccagctgctgcggttgcggcggcgacccctgaggtggcgacggtgaccgagggcggagccgctacggaggcgaagggtccgcataagctgcaccgccagtggaccttctggtacgacatccagtccaagcccaagcccggcgctgcgtggggcacctccctcaaaaaggcgtacaccttcgacaccgtcgaggagttttggggcttgtatgatcatgttttccgtccaagcaagttgcctggaactgctgattttcacctattcaaggctggagtagagccaaaatgggaagac

SEQ ID NO: 69352 - DNA, 313 bp, Zea mays
  Clone ID: LIB3078-050-Q1-K1-B9
agacgaatgcaccaagcttgatgacggcatcttccgtggtgttaatagcttcggtttcaagtccgaggggacggaaaggaagctctccaaggatgacgactgagcgatatatcgtccatatagtctctcgatataaacttcgagcggtgtgatttataaataagccatattaatgtaataatgctttaataagcagttcatatgtgtgtcgaaaatacgttttaattttatactactactacgtgtgcatgcactcttcatgtgtaatgctttacttgtaatttattgcgaataaataaagagagtatgtctc

SEQ ID NO: 69353 - DNA, 385 bp, Zea mays
  unsure at all n locations
  Clone ID: LIB3078-050-Q1-K1-A2
cggacgcgtgggcggcaccctcgatcccgagcgtggttaatccacgcatcgaccggcgaacgccaccgtatcccatctcgaatacctccgcgctcagcgtcatggacggcttctccaaaacgatcggcggtggtggccctaacgttccggcgggatcccaccccgcgggcgggagccaggcggcggcagggggaggcgcgacgcagcggacgcagtatccgtatgtgactggtacttcagtcattgccttgaaatacaaggatggtgtgatcatggcatgtgacactggagcctnctacggatcaactttgagatacaagagtgtggaacgcattaaggctgttggcaagcatagcatcattggagcaagcggagagttcagcga

SEQ ID NO: 69354 - DNA, 409 bp, Zea mays
  Clone ID: LIB3078-049-Q1-K1-G8
ggaacaacagccagcgccatgggcacgtctactaccgtagtcgtcgtgctggacacgacgaccgtggccgggcttggactggcgccaactgccctatcgcgcgtggcgtaacgcgcggaacaggctctgctgaccgtggcagctcacgcggagatgagtccgttgatcatgatcagcctgagcacggacgtgacggtctttatgggacggagtgccttctgaaacttctcaacgggtagaacgtgtgagagaccattgtgcgccgagcattaacggtaagacgcactttgacatcgacacgaacgcgccaatgagttctagaccgtgctaagtccaaagacgacgaaggctttaaccgtggtcacatcctcgtgtagggctcgataggtcacatagccgtctactacat

SEQ ID NO: 69355 - DNA, 439 bp, Zea mays
  Clone ID: LIB3078-049-Q1-K1-H1
ggttgctctagatccgttcatcctggtggttttgcgaggtcgaaagcggcgagcgaattagaagatgctggacaagctgtgggacgacgtggtggccgggcctcgcccggagacgggcctcgagaagctccgcaaggccaccaccgcccgtccgctcgtcatcaacaaagacgcggacggtggcagctacaagcgggcgcagtcgatgccgtcgaccccgacgacgccggtgacgccgtcgtcgtcgtcgtcgtcgacgacgccgcgcggcgccggcaacgtgtggcgcagcgtcttccacccggggagcaacctggccaccaagggcatgggcgccaacctcttcgaccggccgcaggccaactcccccaccgtctacgactggctctacagcgactagaccaggagcaaccaccgctagatcgggcgagatggatgg

SEQ ID NO: 69356 - DNA, 435 bp, Zea mays
  unsure at all n locations
  Clone ID: LIB3078-049-Q1-K1-H10
gagctcgccatgtgggacaagctcggggcggtcgtcaggctcagctatggcattgggatctacggggccatggcactcgccgggagattcatatgccaaatggccgggatagactgcacggggggcttccatccgtctctcacggcactcgtcgagggtcttggctatgcagctccaccaatcatggctctgctcttcatcctcgatgatgaagttgtcaagtattcgcctcacgcgcgtgccatccgtgatgtggaggatgaggagcttcgcagcttcttctgtggcatgtcaccatggcagttcatcctcatcgtggctgctagctcaattggcgaggagctgttctaccgcgccgncattcaaggagcactggccgatattttcctgagaagcacggagctaatgaaggatgctcgagggattgcatcactg

SEQ ID NO: 69357 - DNA, 360 bp, Zea mays
  Clone ID: LIB3078-049-Q1-K1-H11
tacgcgtacgcccacgcgtacgcctacgctttcagtcatttctctgccatccataagatcctgagaacaggcgtctatagcctttcaggcgagttccaccaagacttcccagcggctgcatacctcgacagtcacgtaaacctaccactcaatgtgctgggaacccgatggctcacatagatgcacagcgctatgcattccatcccctgatcagccgtggagcccgaccgcgtggtgcctgagcaaccgaaagagctcctcccgaggctggtctacgagttcttccgcattaccgcaacttcctcttgctccacgtactccgactcggacagctccatggacctgtgcagctgtccgttc

SEQ ID NO: 69358 - DNA, 345 bp, Zea mays
  Clone ID: LIB3078-049-Q1-K1-H12
ctcgacttccgccccgagcgcttcctgcccgggggcggcgcggagaaggtcgacccgcgggggaactgcttcgagctcatcccgttcggcgccggccggaggatctgcgcggggaagctggcgggcatggtgttcgtgcagtacttcctgggcacgctgctgcacgcgttcgactggcgcctgcctgacggcgaggagaagctggacatgagcgagacgttcggcctcgcgctgcccaaggcagtgccgctccgcgccgtcgccacgccacggctcgtgccggaagcctatgcctgagcctgagttagctgtcagagttcttcacgcgtgctgtcccaacaagca

SEQ ID NO: 69359 - DNA, 429 bp, Zea mays
  Clone ID: LIB3078-049-Q1-K1-H2
ggttgaggcaccagcagaagaggaagcaccaaagccaaagccaaagaatcctcttgacttgctgccaccaagcaagatggtccttgatgactggaagaggctatactcaaacacaaagactaacttccgggaggttgccatcaaaggtttctgggacatgtactgacccagagggctactctttgtggttctgtgactacaagtacaatgatgagaacaccgtctcctttgtgaccctgaacaaggttggtggattcctgcagcggatggacctgtgccgcaagtacgcctttgggaagatgctcgtgataggctctgagccacctttcaagctgaaggccctttggctcttccgtggccaggatgttcccaagtttgtaatggacgaggtctatgacatggagctttacgagtggaccaaggtggaca

SEQ ID NO: 69360 - DNA, 439 bp, Zea mays
  Clone ID: LIB3078-049-Q1-K1-H3
cccacgcgtccgccttcatcgcgcggcgcgtgctgaaccggcgcgtgaagccgtacctgccggacttccgcacggcgttcgagcacttctgcatccacgcggggggccgcgcggtgatcgacgagctgcagcgcagcctgggcctgtcggacgaggacgtggaggcgtcgcgcatggcgctgcaccggttcggcaacacgtcgagcagctcggtgtggtacgagctggcgtacatcgaggccaagggccggatgcgccgcggcgaccgcgtgtggatgatcggattcggctccgggttcaagtgcaacagcgcggcctgggagtgcatcgcgccggcgcgcaccgccgaggggccctgggcggagagcgtcagccgctaccccgtggacatccccgaggtgctcaagcactagccgctatcccgtggacatcaggccgg

SEQ ID NO: 69361 - DNA, 424 bp, Zea mays
  Clone ID: LIB3078-049-Q1-K1-H4
cccacgcgtccggagcaagccagttccccctgtcaattgttcttgtcggggttggtgatggaccatgggacatgatgcaccagtttgatgacaatatacctgctcggtcatttgacaatttccagtttgtgaatttcacggagattatgtcgaagagcatagcagctgacagaaaggaggcagaatttgcattgtcagcgctgatggaaatccctacacagtacaaagcaacaattgatctccaactcttaggccgtcgccaaagaataaccccaagaattgctctgccaccaccaacaaggaccgcgtattcgcggtccagtagctttagccaacagtctggtgtttattcgcgatcaagtagctttgaccaacaaacaagtggcgcctctcagcaacgttctgagaagcttgaacagcagaa

SEQ ID NO: 69362 - DNA, 406 bp, Zea mays
  unsure at all n locations
  Clone ID: LIB3078-049-Q1-K1-H5
cccacgcgtccgcccacgcgtccgacgatggcgacgatgtctcttgccgcggcgtcacccctcgcctccattccccgcggcatcgccgctcaggctccttgcgcggcattcctgtccatccgcttaggtggcgcgacggcgacgcggttcgctggactggcggtggcctcgcagccagcggagcgtcgcgccgcggcgatggtcgcgatggcgaagagggagcaagagctggaggagatccgggccatgacgacggaacagatggaagaggaggtggtagacctcaagggggagcttttcctgctccgccttaagcgctcggcgcgccaagagttcaagaacagcgagttcagccgcatgcgcaagaagatngctcgtatgctaaccgtgaaaagagagcgggaaa

SEQ ID NO: 69363 - DNA, 397 bp, Zea mays
  Clone ID: LIB3078-049-Q1-K1-H6
gccaagaagaaatttcttggaaaatatgcaatatcagccgaagaattctctgaggaaatggttggggccaagtctcggaatatagcatacctcaaaggaaaagtaccttcatgggtcggtgtcccaacgtcagttgcgataccatttggcacttttgagaaggttttgtcagatgggcttaataaggaagtagcacagagcatagagaagcttaagatcagacttgcccaagaagattttagtgctctaggtgaaataagaaaagtcgtccttaatcttactgctcctatgcaattggttaatgagctgaaggagaggatgctaggctctggaatgccctggcctggtgatgaaggagacaagcgtttggagcaagcatggatggctattaaaaagt

SEQ ID NO: 69364 - DNA, 445 bp, Zea mays
  Clone ID: LIB3078-049-Q1-K1-H8
cccacgcgtccggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaagaagtcgctgccgcggcggccgtcggcgccggcggctacgtattccacgagcaccacgagaagaagaaggaccacaaggacgccgatgaggctagcggcgagaagaagcaccaccaccttttcggctgaccgtagtaccggccggcgcgcgaccgagctagctagcttcggcgcacacaaccacacacctgtttaattctgtactgcatgc

SEQ ID NO: 69365 - DNA, 458 bp, Zea mays
  unsure at all n locations
  Clone ID: LIB3078-049-Q1-K1-H9
cccacgcgtccgccgcctctctcaatctgataccgcagatccgtcgtccggtgagtggaagccgcacgaacccatggcctccggcgagcttgcctgcacctacgccgctctcatcctcagcgacgatggcatcgccatcaccgccgagaagatcgccacgatcgtgaaggcggccaacatcaaggtcgagtcctactggccggccctcttcgccaagctcctggagaagcgcaacgtcgaggacctcatcctctccgttggatctggtggcggagctgctccagttgctgctgccgcacctgctggtggtgctgcggctgctgctgccccggctgtcgaggagaagaaggaagaggccaaggaggagtctgatgacgacatgggcttcagcctgttcgactgaggagacccnctcacccagccattagcaaaattcacttgtgctgtcaaagactatc

SEQ ID NO: 69366 - DNA, 421 bp, Zea mays
  unsure at all n locations
  Clone ID: LIB3078-050-Q1-K1-A1
gcgccattgtacaagttgatgctgctccattcaagcagtggtacctcactcactatggagtggacatcggtaggaagaagaaggtgcctgttgctaagaaggatgcgactgagggacaagagggtgaggctatagctgaggaaacaaagaagagtaaccatgtgcagaggaagattgagaagcgacagcaggaccgtgcactcgacactcatattgaagagcaatttggcagtgggagattgttggcctgcatttctgcccgtcctgggcagtgtggccgagctgatggctacatccttgagggtaaagagctcgagttctacatgaagaagctccagaggaagaagggcaagggtgttgcatcttagagcattcttttagctagaactgcanaatatcttctacttgggggattttggtg

SEQ ID NO: 69367 - DNA, 369 bp, Zea mays
  Clone ID: LIB3078-050-Q1-K1-A10
cgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaacttcgacgggaactggaggaactgagcggtggggcccgcgcggtcaagttatcctgttcgctaccgtgatgtttaccctagtccagagggtttatcttcgttcgtgtcgtgtttgttgttgcccatctgtgtttttgattgcaaggtcgctctgtgtcagttgttagtgct

SEQ ID NO: 69368 - DNA, 378 bp, Zea mays
  unsure at all n locations
  Clone ID: LIB3078-050-Q1-K1-A11
gcgccacacttcagcggatacatccagtacatgcttctcgtaatgttggggaaactgatgagggattgagcagcttcgcattgggttgcgtaaacctgcgaaagcttgaactcaggagttgctgcttcagcgagcgagcactggcccttgcaatactacatatgccttccctgaggtacgtatgggttcagggctacaaagcgtctcaaaccggccgagacctcatgctcatggcaaggcccttctggaacatagagtttacacctnccaatcctaagaacggaggttggctgatggaagatggggagccttgtgtagatagtcacgctcagatacttgcataccactccctcgcccgtaagaaggctgactgcccac

SEQ ID NO: 69369 - DNA, 431 bp, Zea mays
  unsure at all n locations
  Clone ID: LIB3078-049-Q1-K1-G7
cccacgcgtccgcggacgcgtgggtgctgacaaggtggactacggctacaaattttttgagaaagaggtccctgttgatgctgtcttccagaaggatgagatgattgacatcattggtgtgaccaaaggtaaaggttatgagggcgtggtcactcgttggggtgtcacccgccttccccgcaaaacccacaggggtctccgcaaggttgcttgtatcggtgcatggcatcctgctagggtctcctatacagttgcccgtgctggtcagaacgggtaccaccaccgcaccgagatgaacaagaaggtttacaagatcggcaaggctggacaagagacccacgatgccttcacagagtttgacaggaccgaaaaggacatcactcccatgggtggcttnccccactatggtatcgtgaanggtgactacctga

SEQ ID NO: 69370 - DNA, 465 bp, Zea mays
  Clone ID: LIB3078-053-Q1-K1-C4
ggccaccgtcctaggcagcccccgcgcgccggccttcttcttctcgccgtcctccctgcgtgccgcgccggcgcccaccgccgtggcgctgcctgcggccaaggtgggcatcatgggccgtagcgccagcagcaggggcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggtcctgctcctcctgcgccggcaaggtcgtctccggctccgtggaccagtccgaccagagctacctcgacgacggccagatcgccggcggctgggtgctcacctgccacgcctaccccacctctgacgtcgtcatcgagacgcacaaagaggaggagctcaccggcgcataatcattcatgcccat

SEQ ID NO: 69371 - DNA, 461 bp, Zea mays
  Clone ID: LIB3078-053-Q1-K1-C5
cgcagttccatcttccgctcactcccttcatcgcgctcggcacacaggcgacggcgggggagctcatgctagggctctcagcgaaggcatcagctgcttcccctcccgcctctcgccaatcgcctcccgtcctccgcacaccggccggtgatcctgcgtcttttcattcgtaaatcatactccaggtatctgcatcgcaggggaaatggcaagcaaagcaggtggtgatggcaaagaagccataaacgagcaagtagttgccaacacttatgccaacatgcgtaccgaaatgaaccagctctataccaagatcacagagctggagatggaggtcagtgagcactccctcgtgattggtgcgatcgagccgctggacccctcaaggcgctgttacaggatgattggtggggtcctggttgaaaggaccatcaaggaaagcctgcctgctgtgaagcgcaaca

SEQ ID NO: 69372 - DNA, 451 bp, Zea mays
  Clone ID: LIB3078-053-Q1-K1-C6
cccacgcgtccgaattgcgactcagagaggaagtagtgtgggtgatgctggaggcgcgggtgatagagtgcttaatcagctactgaccgagatggatggcatgaacgccaagaaaactgtgtttattattggtgctacaaacaggcctgacatcattgatcctgctcttctgaggccagggcgtcttgaccagctgatctacattccactgcctgatgagcagtctaggctccagatcttcaaggcctgcctaaggaagtcccctgtggcaaaggatgtggacctgaatgctcttgctaagtacacacaagggttcagtggagcagatatcacagaaatttgccagcgtgcgtgcaaatatgcaatcagagagaacattgaaaaagacattgaaagggaaaggcggatgaaagacaaccctgatgcgatggatgaagatgaagtggacgag

SEQ ID NO: 69373 - DNA, 344 bp, Zea mays
  Clone ID: LIB3078-053-Q1-K1-C7
ggccgcactgtttgacttcaacctgacgctcccggcgatcgcgaccgagttcctgctggtcatggtggcgctggacaagctctacttcacgccgctaggcaagttcatggatgagcgggacgccaagatccgcggtgagctcggcgatgtcaagggcgcctccgaggaggtgaagcagctggaggaccaggcggcggccatcatgaaggcggcgcgcgccgagatcgcggcggcgcttaacaagatgaagaaggagaccaccgcggagctggaggccaagctggacgaggggcgcagccgtgtggaagccgagctcgtagaggcgctcgccaacctcgaagcgc

SEQ ID NO: 69374 - DNA, 414 bp, Zea mays
  Clone ID: LIB3078-053-Q1-K1-C8
ccgccctgctgcacgggaaccgcgcctccggccggacgccgctggactgggagacgcggtcggcgatcgcgctggcggcggctcgcggcgtggcgcacatccactccacggggcccacggcgtcgcacggcaacatcaagtcctccaacgtccttctcaccaagaactacgaggcgcgcgtgtcggaccacggcctccccacgctcgtcggcccctccttctcgcccaccagggtgtccggctaccgcgcaccggaggtcaccgacatccgccgcgtctcgcagaaggccgacgtctacagcttcggcgtcctcctgctggagctgctcacggggaaggcgcccacgcacgccgtcgtcaacgaggaggggctcgacctgccgcgctgggtgcagtccgtcgtgcgggaggagt

SEQ ID NO: 69375 - DNA, 405 bp, Zea mays
  Clone ID: LIB3078-053-Q1-K1-D1
cggacgcgtgggcggacgcgtgggcggacgcgtgggcggctgcatccgccctcgatggagaggggaagaagcagaagctgtccgagatccagtccggcgttgaggaagctgaatcgctgattcggaagatggacctggaggcaaggagcctacagcctagcattaaggctggattgcttgcaaagctgagggagtataaatctgacctcaacaacgtcaagagtgagctcaagaggatatctgcgcccaatgccatgcaggctacccgggaggagctcctggagtctggaatggctgatactctcgcggtgtctactgatcagaagggaagattgatgatgacaactgagagactgaatcattccactgacagaattaaagagagccgaagaactatgttggaga

SEQ ID NO: 69376 - DNA, 386 bp, Zea mays
  unsure at all n locations
  Clone ID: LIB3078-053-Q1-K1-D10
cccacgcgtccggaaccaccgacagacaacatggccgcctccgcctccaccgtctccgggctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttncccacgccccccgccgtcaccctccagttctggctgtggctagtgacgtg

SEQ ID NO: 69377 - DNA, 232 bp, Zea mays
  Clone ID: LIB3078-053-Q1-K1-D11
atcgagaagggggcctcctatgaggaaattaagaaagctattaaggctgcttctgaggggccactcaagggtattatgggctacgtggaggaggatctggtttccaccgacttcaccggtgacagcaggtcgagcatcttcgacgccaaggccgggattgccctgaacgaccacttcatcaaactcgtcttctggtaccgacaacgagtggggctacagcaacccgcgtcgt

SEQ ID NO: 69378 - DNA, 446 bp, Zea mays
  unsure at all n locations
  Clone ID: LIB3078-053-Q1-K1-D12
gctgcacaagagctcagagaatctgggctctccgatgtcatcttccatcagctggacatgaccgacgctgcgagcgtcagtcggctggctgagttcctcaaggctcgttttggaaagctagatatcctggtaaataatgccgcagttggtgctgttgagtacgtccaagatcctgctgacagtgcaacgaaagaggaagagcccattgtcagccctagatatggaccaaaggcttcagtgcatgtttaagagagtccgggagacctacgacgctgcgacagaaggcatcaagacaaactactatggcataaagcatgtgatcgaagccttgctgcctctgcttcaagcttcctccgatgggaggatcgttaacgtctnctctgagttcggcctgctaaggctgatcaacaacgaggagctaaggcaggagctaaacgacgtggaga

SEQ ID NO: 69379 - DNA, 336 bp, Zea mays
  Clone ID: LIB3078-053-Q1-K1-D2
cccacgcgtccgggcagctagctgcgaattacaactctctagaagccattaaccttgccggcagcgcctgcacagaagaatgtaggcgatgagcacctgaagaagtacctgcttggtctcctgccaaacctcgctgtgtacaacaagcagcctattagggcgactggatcaaaagacgtctcggaccgccatacccgcaagatctcttcttcgcaccattctgaccgtggtggcagacccgaccgcagatcttccaggttggtgggtgccccgtctgctcacaagccacagagctcgcggcatggacgctctggatatgtgtcaagctcagcgctc

SEQ ID NO: 69380 - DNA, 281 bp, Zea mays
  Clone ID: LIB3078-053-Q1-K1-D4
ctcacccataagacgacgaagtaccgtaccgccacgtggcttacacacaccagctgtgcgtgtggcacgcacagcgcagggacgaggataacgctctcttactggacaaagacgatggacgacgaccaattccgtgagcatcttagcgggatctacctgaaaagcgaggcgagacatatggacatcctgagttaaatgaactggcatacgcaaggaatgatgaatcctaacagcacctgaaccgacaaaggcatgaccattgagaagatcctgaggctcat

SEQ ID NO: 69381 - DNA, 463 bp, Zea mays
  Clone ID: LIB3078-053-Q1-K1-D5
gacttggtacaacccaaaatcaccattccttttggttcgcacaaccaaaaaattattgggaaggtctacaggaagataaaaaaatacggaattgtatcaagaactatatacaaaagaataggaaaaaaggctcgaatagaaaaatggaatcagactcaagttctgaagtaattacacatatagaaattcaaaaagaaatcgatacaatccacgtcataatccatattggattccccaacttattaaagaaaaagggagcaatcgaagaattagagaaagatctccaaaaggaagtaattctgtaaaccagagacttaatattgctatcgaaaaggttaaagaaccttatagacaacctaatattcttgcggaatatatagctttccaattaaaaaatagagtttcattccgaaaagcaatgaaaaaagctattgaattaactaaaaaagcggttataaaggga

SEQ ID NO: 69382 - DNA, 451 bp, Zea mays
  unsure at all n locations
  Clone ID: LIB3078-053-Q1-K1-D6
cccacgcgtccgtgaaaaggcaacaccaacactcgccgcagcatactccatctctcgggctgttagtattccagtgatgtgctcgtcagggttaagctcggtgactgcaccaatggcagtaactgcaggagctgctggagttggagtcggttctgctattaacaaactcaacgacgttgtggcaatgatcgctgaggtgagaagcattgcgcaagcaatggagcttgcgccaagaatcgtgtccgaaaacttgagaacaattagttactagtggctaggaatacccttgccatttctgagcaaacttgagcagtcaataagaaagcaaaagagagtcatcgactctcaattntattctctctacgctgtcttttgcctgtggcaatgaatagcgcattagcatcatagaaggattagcttgggtaaatgggaggtggtcatgcgcttcttc

SEQ ID NO: 69383 - DNA, 460 bp, Zea mays
  unsure at all n locations
  Clone ID: LIB3078-053-Q1-K1-D7
atcttcagatcctcttaccggcttatatttgaccgcatcaggatttgactcagaaatgcttagtttacaacgaaaatttggtcaatggcgggaggatggtccatctgaggagcatagtgacctattgttctatgagtatgttgaagctgtaaaattaacaggggacaacctcatgccagctggtcaggttgttttccgtgcaaaagttggtgaacactatcggctccctcataagggaattatccctagagaacttggagtgattgctaggtacaaggggcaaaggaaaattgcagatcctggtttccaaaaccctcaatgggttgacggggagcttttgatactagatggaaagttcatcagagatggtcctgtgatagctttcttttactggacatctaatgttcatcttttcgaattctttagacagttgaagctcnctgactaagttccttctaaa

SEQ ID NO: 69384 - DNA, 375 bp, Zea mays
  Clone ID: LIB3078-053-Q1-K1-D8
gtggaggtggaggaggaggaggaggaggcggcggcggcggaggtggcggcggtggaggcggtggtggtggtggtactggaggaggaggtgggggtggaggaaactagattgccttgttgctcatcacttgtctctgtttcaatcgtttcaatcattctgggatggtggaggtagccgtatctatgttcatgtttatggccaagccatgcatgtttatgcatgcatgtgtgtagtgcaaagatgaataaggacgtcgagctaaatctatgcaaccctcgacgtggtgtgattgtattttgtatttgaatcttgtgaagcatgtgtgtgtgtgtcatgtactcaggtatattatgtggtgctctcacattacatatg

SEQ ID NO: 69385 - DNA, 463 bp, Zea mays
  Clone ID: LIB3078-053-Q1-K1-C3
ggaaagctctggaggtggaaaagaagccatcaccagtggctgatgcagttcaagtggagagtggcagaagccgtggaaattgtctgaggtgatacgacacagtgatgaaacaatcacgaggattaggcccagacctccacttcttccacataaacctcataactgatgtgaaacggacttgtttttgtctcaacaagaactgacacggtttgcaaacctacacagctaactgcctgcacaaggtaacaatgcagttaatactccatgagatctccttcgtgcttgtttttacttggccacgggatcgacaagtatgtgttcatgggtgactcttgtctatggatagatgtaaattccctgtgggttggtataaagtgagatgtcaacgtagagaaagaaaatagttagtgggtgagtgagcagagtgaatgggcattctttcatgcaaatactgagcacaatg

SEQ ID NO: 69386 - DNA, 199 bp, Zea mays
  Clone ID: LIB3078-053-Q1-K1-A9
tcggttgggttctactatcacgacgacaatacatggtggaagctctgcgaagaatcggagagtggggtagtgtacgctcggcagatcggtggggagtctgagggctactctcggacacggcttgatcgagagtgaagagtcaccggccggacatacaagcatgctgctatcccgctcgcatctacctttcatcttacaa

SEQ ID NO: 69387 - DNA, 188 bp, Zea mays
  Clone ID: LIB3078-053-Q1-K1-B10
gtcacgcattctgttcaacgatacctcaacgtggtagtcgctcatgtggtcatgcatggggtcgacttctccgacaaccctaaaacgattatctctctctggtttacggaaatcactgtgctgctgatcaccatttcagatatgtcaacctaccatgcttaggcagtccttatcagatgctgtgcctt

SEQ ID NO: 69388 - DNA, 438 bp, Zea mays
  Clone ID: LIB3078-053-Q1-K1-B11
cccacgcgtccggtcttcttctccgaggtccagttcatcccggccgaggacctcgccggcatcgacgggctctggaaggagcacagcggcggcaggttcgggtacagcgtgcagcggcggctctgggagaagtcgcggcgcgacttcacccgcttcttcatccgggtcggctggatgaggaagctggacacggaggtggagcagtacaactacagggccttccccgacgagttcttgtgggagttgacggacgacacgcccgagggacacctgccgctcaccaacgccctcaggggcacgcagctcctggcgaacatcctcacccacccggccttccaggaggaggaccagggagacggagctgctgctgcagaagagagtgcaaacaccaaagatgataacaaagggagggagagacccaggtccatgagagatttc

SEQ ID NO: 69389 - DNA, 391 bp, Zea mays
  unsure at all n locations
  Clone ID: LIB3078-053-Q1-K1-B12
cccacgcgtccgtcgacgctgcacctggtgctccgcctcaggggaggcgccaagaagcgcgagaagaagacgtacaccaagcccaagaagatcaagcacaagcacaagaaggtgaagctggccgtgctccagttctacaaggttgacgacgccaccggcaaggtcacccgcctccgcaaggagtgccccaacgccgagtgcggcgcgggggtcttcatggccaaccacttcgaccgccactactgcggtaagtgtggcctcacctacgtctacaaccagcaagcgtaagatgcccctnctttctggtgggaaagaaaatgggaagtcttgctaagtgataatcctttttggtttggtttggtttggtggaatggtaggaagttcttggaac

SEQ ID NO: 69390 - DNA, 406 bp, Zea mays
  Clone ID: LIB3078-053-Q1-K1-B2
cccacgcgtccgcaccactccgcgctagctgaggacggtacagcggcacagaggtgcgacgtaggacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggggacggcggggctgaagctggaagcccgcgactccgggctgcagacgggtgaccccggccggttcaccctcggcgacacgct

SEQ ID NO: 69391 - DNA, 414 bp, Zea mays
  Clone ID: LIB3078-053-Q1-K1-B3
cgaacttttggagaaatgccacccattgtgcatgtttgacagcattgcatcacttgctgttgctcaaaacatgcgtgagctttatagattggttctagtcgatacaccactggccccttacttctcagagtgcattacatctgaggatttggatgacatgaatattgagattatgaggaacactctctacaaagcatatcttgaggacttctacaaattttgccagaaactaggtggtgcaacagctgagatcatgtgtgatctcctttcatttgaagctgacagaagagctgttaacattacaataaatagtattggtactgagttgacaagagatgaccgcaagaagctgtactccaactttggtttattgtatccatatggccacgaagaattggccgtttgtgaagatgt

SEQ ID NO: 69392 - DNA, 461 bp, Zea mays
  Clone ID: LIB3078-053-Q1-K1-B4
gccgggagaacttggctgtctgccctgtctgcaagtacctcgtcttcttcctggagagaaaaagcagaagacaatacaaagatgtccaagatggcggaggagaaggcggcggcagtgggcggactcggaggagccggggcggcggacgcggcgcagcagcagcagctggcagcaggggaggccgcggcggcgcgggtgcggcccgtggagacgctgcttcgcgcggcaccgctggggctctgcgtggccgccatgaccgtcatgctccgtaaccagcagagcaacgagtacggcgccgtcgcctactccgacctgggaggcttcaagtacctcgtctacgccaacggcctctgcgctgcctactcgctggtatccgcgttctacactgccgtgccgaagcctgccaccgtgtcgcgctcctggctcgtcttcctcctcgaacaggtgttcacgtacctgat

SEQ ID NO: 69393 - DNA, 289 bp, Zea mays
  Clone ID: LIB3078-053-Q1-K1-B5
gtcgcgtcggatccggcggagtcccatgtcgcctctcgccgcttccctacccctccagaggtatcgctcggctgactcttgcgtgaagtcgtcggagcaaactatctatcagtagtactagcagtgtcgtttcgttttggtctgtcgtggcgtggtagtaagaaatgcaagtgagcagcaccagtatctttccgtttgaatcagttgtaaggcagtcatggtcatggttggctctgccggatctatctgtcatgaactatctatattatatcattatcaatgttatgcc

SEQ ID NO: 69394 - DNA, 380 bp, Zea mays
  Clone ID: LIB3078-053-Q1-K1-B6
cggacgcttgcttcgacccacgcatgcagtcacgctcacggctgccttacaagggtagggtattgacaatactccgatgtgcaagatcgccgaccagaaggcccctgccgtcagcttactcccaatagccctggccgacgaccccgagcactaccaccagctcacagtaaaggagctcaagaacgctcgactgcccaccttgtacacgctaggtttctcggtacacgtatgctcatcgtcaacgccatgaccgagatcctccctaaccacctcagtaaccaatacaacaccaacgcatactcctacctgagaaacttcaagtacctcaactaagctaaacggctatgctatgcctactcactggcattcggattctacac

SEQ ID NO: 69395 - DNA, 459 bp, Zea mays
  unsure at all n locations
  Clone ID: LIB3078-053-Q1-K1-B7
gcgagaacggccgcataggtcttgcatttgatgtaatgggtcgtgtgccatacggaagatcatttctagatgaacaggccaaagaaaggtccatggacattaacctaggatggttcttggagcctgtggttcgtggtgactaccccttctcaatgagatcgttagcgagggaacgactacccttcttcagtgacaaacagcaagagaagcttgtgggatcctataacatgttgggaataaactactacacctcaatattctccaaacatatcgacatctcaccaaaatactcgcctgttctcaacactgacgacgcctacgctagtcaagaaacgtatgggcctgacgggaaacccattggtcctcctatgggaaatccgtggatctacttatacccagaaggcctaaaagatatccttatgatcatgaagaacanatatgggaacccacctatctaca

SEQ ID NO: 69396 - DNA, 453 bp, Zea mays
  Clone ID: LIB3078-053-Q1-K1-B8
cccacgcgtccggccctcaccaagaggacacaagatggtgggacagaggtggttgaaggaaaggcgggaaaaggctctgcaacgttgtccatggcatatgctggtgctgtttttgcagatgcatgtttgaagggtctgaatggagttccagacattgtagagtgctcttttgtgcaatcaactgtgacagagttgccattctttgcctctaaggttcggctcggcaagaatggagtggaggaagtgcttggtctgggtgagctcaacgagttcgagaagaaggggctggaaaacctcaagggccaactcaagtcttccatcgacaagggtatcaagtttggccacgggaactaggcaccttgcgtccttgcccggcttctaacaattgatgcccccccttgcatttttgtttgactgcctatttttcctgccccccgtatggttggggcaatg

SEQ ID NO: 69397 - DNA, 229 bp, Zea mays
  Clone ID: LIB3078-053-Q1-K1-B9
attcggaggttccgaggctacgacgtcacgctgacgcaggaagctataagctagccaagacaggaataataatggcggtgtcgactgaggcgagcctctctgatccatggacgacaactaccttagctgctcgaagcgaagccaacgtggtgatcgtcgaacaaaggagggcagtcgcctggcgcgtcaagttggtacccgcagttgaccgccaaggtgatgcaaaagc

SEQ ID NO: 69398 - DNA, 454 bp, Zea mays
  Clone ID: LIB3078-053-Q1-K1-C1
gcaagctgacaagtgagtcgaatcagcttactttctggagtgattcaccgactggggatggagcttcaccatattaccattccatagctggtggcatgtctccatatcgcagttatgctgtgatgtcaccatcaagtaaaccaaatgggtcgtctggaacaggagataaggatgataaagcaagtaggagcaatggttctggttcgtttgggaaagaccatgatcgaacctcgttggttggatcagatgatagtagcttcaagcgatcaagttccatgagctcaggaccagatggaacagtgcatgaagattcaatggatcaccacagagatactgattcagacacatgtcacttgggtgtgcttgtgcatacaaaagcagcattggatgcaaacatatatgacactcaacctggatggcgaaagacagttggaaataatttgattgtgaaaga

SEQ ID NO: 69399 - DNA, 407 bp, Zea mays
  Clone ID: LIB3078-053-Q1-K1-C10
aaaagaagcaacaggttgatgaaaatgctaggaggttttcaagaactgaagaaggaaacgctaggcggtttgcgaaatccgaagaatcatttgaagaacgccctagaaacagaccaggcagaagatctgttggatctggatccacatttaagggggcgcaacagaagagaagaccgatggcatccaaggggtcttcttcatatggccgaggatagcagtggcataaaacactatatgcttgcttttttttcgtgttgtctgtgctccggaccctggagcgttcatgtgaagttctcgacgaactggttggagcacatggcagtgtttagttctagttttgacaagtaagttgtggttccaggtctcatcaactgcacaatgaaataggcacaagatactttgtggtc

SEQ ID NO: 69400 - DNA, 404 bp, Zea mays
  unsure at all n locations
  Clone ID: LIB3078-053-Q1-K1-C2
gagccgnacgtcgggaggggcctgctcaacaccaggatcaccggcgaccaagcgcccggggagaggtggcacatggtcttcagcacagaaggcgaggtcccctacagagagggccagtccatcggcgtcatcgcggatggcgaggacaagaacggcaagccgcacaagctcaggctctactccatcgccagcagcgccctcggagatttcggcgactccaagacggtgtcgctgtgcgtgaagaggctggtctacaccaacgatcagggggaggtcgtcaaaggagtctgctcgaacttcctctgggacttgaagccaggcgctgaagtgaagatcacagggccagtgggcaaggagatgctcatgcccaaagaccccaacgcaacaatcatcatgctcgcaac

SEQ ID NO: 69401 - DNA, 309 bp, Zea mays
  Clone ID: LIB3078-052-Q1-K1-H2
cccacgcgtccggcagtatcaaagagctctggttttacttgggtcaatggctgctctgtccgtgatgactattgtgagtgttatacttggactgattttgcagtctgtgccagcacagttccaaacaacgctacccataggagagtattctgcagttgctctgctggcattctttggtttcaagtcaatgaaagatgcattagcacttcctgataatgccaacgggaaccttcaagggaattcagtaagtggagaactggctgaggccgaggagctcgtcaaggaaaaggtctctaaaaatcttaccag

SEQ ID NO: 69402 - DNA, 325 bp, Zea mays
  Clone ID: LIB3078-052-Q1-K1-H3
atttagggctgtgctactagaaaaagttatcaagccagagtggattcctccaaggttggaggaagttcctgacgaggcagttgatcaatatttcttgagaattgatgatccccagtgggaagatctgaacctgcctgcgagactttcccaccgaagaaatattgagtccaagatttgattgaggtcttggacgaatagtgagcctctgtctggataactcgacaactcatgtttgaagttgtgtgcagattgtttactaccattgatctataataaactcggactgaatatatgtctgattagttcacgttcatcgttaaataat

SEQ ID NO: 69403 - DNA, 433 bp, Zea mays
  Clone ID: LIB3078-052-Q1-K1-H6
cccacgcgtccgcccacgcgtccgggaaaacagatctttgggagtgtcacggcacaggatgttgttgacataataaagtcacaacttaatagggatgtcgacaagaagctggtgacggttccagaaatccgtgaaatcggagagtatgttgcagagatcaagcttcacccagacgtgacagcgcgagtaaggctgaatgtctatgcgaaatgagctcagcagttacagaacctcgagtaatggactttggcgaagcctgatgtttgccagtgcagagattttgctgaaagtgccatgtgctgcggtagacatgatgcctgttctggccgtgacttgcctggttttgatacacaattcacttgctcactgcgcattctattccctatcatgtgaagtcaagttttcaacaattatatctgttgatttgaagtgg

SEQ ID NO: 69404 - DNA, 435 bp, Zea mays
  Clone ID: LIB3078-052-Q1-K1-H7
caggaagcactggatgggatgacgattatgcttttgttgcctggaaggacagtcgtgggaactacaaggggcatatccaaaagcttagggctcaaaaagtgtctcattcgctctctgatcttgctgactccagttcagatctgcaagcattctcgcagggtctttctacgctattagataagatggatccctctcagagagcgaagtttgttcaggaagtcaagaaggtccttgattgatgataccaacacatccaacacaatgtgtgcatgtcacatctttttgttctagtacatacatagaaggatattgcttggtcttgattgatcatgtctgatttaagtcgactattatttcttggaattttcttttggacctggtgctatggttgatggatgtatattggatatgtgcgttctgccaagtgtaagcaca

SEQ ID NO: 69405 - DNA, 306 bp, Zea mays
  Clone ID: LIB3078-052-Q1-K1-H8
cggacgcgtgggcggacgcgtggggtttgccccgaccttgactctgtcgaaagtgcagttcagtggagggagacgtcatggtctaggagagtcatacagcagaagttgggcgacatctcagcagtgttaaaagcttttgcggattatgtcgacagcctctgtggaacttcgtacccgatggactatgagatctggttgaaacgactgcgaagaacaataaacgaagatcatgggaaggaggttgacacatcctcgagttaatgctgcaacacattctcttgcagatccaaaatttggaagatcaag

SEQ ID NO: 69406 - DNA, 341 bp, Zea mays
  Clone ID: LIB3078-052-Q1-K1-H9
cgcgctcgaggtgctcgtcaactgcggctgcgccgtcccgccaggctacaaatgcacttgaacgattccatcccattccatttccatttccacccagcacacgtgcacagcaaaacgtctccttttgccctcccgatgcaaagtttgaaaaggctcgtcgacggatttgggtggtcgtagccgcccgcgcgccgccggactgttcagcaagtgcattccttcatttgttttgctattctcgttgcatgcctgtatatgcatcgtccggtgtctcctcaaattccacttgtactttgtgtgattttgtatcaaactattctctttttttgggattcgattat

SEQ ID NO: 69407 - DNA, 271 bp, Zea mays
  unsure at all n locations
  Clone ID: LIB3078-053-Q1-K1-A1
ggaatcggcaacaagcaactgctgcgactgaggactgatggactacgccttctcatacggtcggacacaacggatggtattctcacctgaggaagcctacactgtacctcatggaacgaaggcaccatgtgatcgcaaacgcatgcttcgagctaaacatgtncggtatcgtcagatgacggctacggctaaagcgaggagggtaccatcttcaggtacgaggacgtgcccaggaacaaccagcacgcgctggtcataacgcttgcgcaac

SEQ ID NO: 69408 - DNA, 390 bp, Zea mays
  Clone ID: LIB3078-053-Q1-K1-A10
cccacgcgtactaacgaagtgcgagcgacttcacgtccacacgacacgaaccaccaccacgcgccagcagccgcaccacgcacccagcgcaaagcgatggcgtcgctcaccatgatggcgtgcttcgccgccgtggcggtggtcgcgcccttgcgccgcggtaccttcgccgtggtcaggtccgccaaggtccaccgatgccaggagcccgtcacgctagcagcaaccgaagccaggcccggcgccgacggacgccgagccgtcatgctcgcagatgctgcggaggacgtggcagccatcggcggttccggcgccgccatggcgggccccaagaacgggacccccgaggcgatgatgacgtacgcggacatatgcgtgaccatgcccacc

SEQ ID NO: 69409 - DNA, 194 bp, Zea mays
  Clone ID: LIB3078-053-Q1-K1-A11
acacgtacgcccgcgtccattttaaacgacatcatcacttacctttacttcaaccacacctactacaagatcctgtctaacctcctctgcgctttcccctatctattcctccatatcatactacacttccaccattgctcttctcccaacactacgtctccaacatctaccaccttctcatactactactacct

SEQ ID NO: 69410 - DNA, 490 bp, Zea mays
  unsure at all n locations
  Clone ID: LIB3078-053-Q1-K1-A12
tccgtccgaaacgagtgatagctcaggaaccagtttgaatctttgtgggtgannaaagtgagccctgcagaatcgccgggggagaagcgtggcnncttgtgatctcatccatagngtgaagaaatttctagtagtccccttgggacctagtattnngattaagtgcctatcctnngtttataatcattcntnntcccagaccacggctttgagaatngctttttgactttggcttggcattcanngcttgtgatnncagagctgatagtnntcttcggtaccttccatcttcataatcannggatggnnttgatcaagtcagaattcatcttcagatgtttccaagactgaaaaaggaatttttggctctgtgtactnattagggaaattctttgagagattagncacttaaaattcctttgaatacaatccccttttctcgatgtacccttctatatataatcgtattgcttgattcatctacatgttt

SEQ ID NO: 69411 - DNA, 436 bp, Zea mays
  unsure at all n locations
  Clone ID: LIB3078-053-Q1-K1-A2
cgccgctccgtggcagaacggagagcgcaaggtcgacggaggagggcccggctccaacagccggcaggtcgcgccggacgacaccggcatcgtcggaagcgtcggcgacggtagtagcagagacgagactttctatgaagccaccgcctggttggaattagactgcgaagatgatttctacagcgtcaacggaggtaaactgaatccccaaccaaaagatctgacgcctgcgagatcgttcgcatcccgaaccagtggccggaacactccgtcacctagaccccgcgatctaccgacgctggcggcgatcctcaaggccgaacccctgaagccggcgncgacgccgacgccgaccgcgggcccgcaaaagaagctgggcgacctcctgcgggaggcgcaagacgacgacgacgacgacaatgacaccggcgtcgac

SEQ ID NO: 69412 - DNA, 383 bp, Zea mays
  Clone ID: LIB3078-053-Q1-K1-A3
gcagcacactcagctatccagcaaaagagatcgagacgcaggagtcatggccaccgtgagcgcggccgtggtgaccaccatcgttgcccgcgccgcgatcgccaggcccaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtctgcggggcccgcgctggcgctcgtggacgagcgcatgtccacggagggcaccgggctgagcctcgggctcagcaacaacctgctggggtggatccttctgggggtcttcggcctcatctggtgcctctacaccatctaca

SEQ ID NO: 69413 - DNA, 453 bp, Zea mays
  Clone ID: LIB3078-053-Q1-K1-A4
cccacgcgtccgccatctagagctccctaactgcaccggccgccacaccaccgtacccggaccgctcgacaacaatggccaccgtcctaggcagcccccgcgcgccggccttcttcttctcgccgtcctccctccgtgccgcgccggcgcccaccgccgtggcgctgcctgcggccaaggtgggcatcatgggccgtagcgccagcagcaggggcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggtcctgctcctcctgcgccggcaaggtcgtctccggctccgtggaccaatccgaccagagctacctcgacgacggccagatcgccggcggctgggtgc

SEQ ID NO: 69414 - DNA, 384 bp, Zea mays
  unsure at all n locations
  Clone ID: LIB3078-053-Q1-K1-A5
ctcatcgactgcgacacggacggcaacaacggctgcaacggcggcctcatggactacgccttctcctacatcgcacacaacggcggcctccacacggaggaggcctacccgtacctcatggaggaaggcacctgccagcgcagcagcagcagcgagaagaagtggccgggatcgtcggaggacgccaacgacgatgccgcggtggtcaccatctccgggtacgaggacgtgccgaggaacaacgagcaggcgctgctcaaagcgctggcgcaacagcccgtcagcgtcgccatcgaggccttcggcaggaacttccagttctacagcggcggcgtcttcgatgggccctgcggcacgcagctgggccacngggtagcggccgtc

SEQ ID NO: 69415 - DNA, 443 bp, Zea mays
  unsure at all n locations
  Clone ID: LIB3078-053-Q1-K1-A6
ngctagngnnggagagaagagaatacactacactacgcatggcgaagcagcagcggggggagggcatggcggcagtggcgctggtgctgctggtgctggcggcggcggcggccgagacggcgtcggcggcttcgtgcaacgccgggcagctggcggcgtgcgcgccggcgatcactgccggcgcgacgccctccgcgtcgtgctgctccaacctcaaggcgcagcaggggtgcttctgccagttcgtgaagaaccccacctactggcgctacatcaacagccccaacgcgcgcaaggtcgtcgcctcctgcggcgtcttccggccgcgctgctagtactagtacgtgtgctgtgcatgcatgcatggacgtgcgcacgtgggctgatcttactgcttgattcgtgtcttgccgagcgccatcaggtggttgtgcacttttctg

SEQ ID NO: 69416 - DNA, 435 bp, Zea mays
  Clone ID: LIB3078-053-Q1-K1-A7
acttcgtaatgatgatagacgctgagaaacaggaacgtgctcagtctgcattacgtgcacacagtagttcaagaaaaaatagcaagaaggagataaatgtaccagaagattgtgctgcattaacagggaagttacaaccttttgtcaaagaagaagttttggtccctgtattcaatggaacttttccctgtactgcagaacagttcttcagtattcttttaagtgatgattcaaattacataacagagtatcgaacggatcggaaggataaagatataaatctgggccaatggcacgttgcagatgagtatgatggccaagtgagggaacttaattggtaatcaatatgccatagtccaatgtgtccttcttattcagcaatgacagagtggcagcatatagttctttcagctgacaaaatggatctggtatttg

SEQ ID NO: 69417 - DNA, 343 bp, Zea mays
  Clone ID: LIB3078-052-Q1-K1-H1
cggacgcgtgcgcgcaggcactcacgatcaggttctgaagccgccccttacgacataggtgtggagccccatttgatcgagtgctgatggcgcccaagggcgagaagaagcccgcggagaagaagccggcggtggagaagggctataagaagccaacggcggtgaaacgcgtgtcgagctaggtgggcggcgagaagaagggaaagtagatggcgaagaagatcgtggagacgtacaagatctacatgattaaggtgctcaagcatgtgcacccggtcattggcatcttgatcaatgccatgtccatcatgaactgcttcatcaacgacatcttctagaagct

SEQ ID NO: 69418 - DNA, 155 bp, Zea mays
  Clone ID: LIB3078-048-Q1-K1-H9
ccactcatcctaacaaaaaaaaaaaaaaaacaaaaaacattaaaaaaacaaaaaacaaaaaaaaaaaagtagaattataaaaaaaaaaagcagcccaaaacccatacaacaaaacaaaccccaaaaacacccaaacacacacacacccatatacc

SEQ ID NO: 69419 - DNA, 459 bp, Zea mays
  Clone ID: LIB3078-049-Q1-K1-A10
cccacgcgtccgcccacgcgtccgattcgagtaaatgaagtgcgtacaagaggtccccgagattttggtcgagatggttttagacgagatccaagaaggtatggtagagatccatactgggacagaagggatagggaacagagctatgatcgtgaaagagatccctaccatgacagggatagtgatagatcccgcgagcatgatagagaaagagattatgagcatggtggctttaatagagaagttgactatcccatggatcgagatcatgaagtagacgacatacatcctagagaacatgatcgtgcagcagaaacacataatatggattcagataatgacaaatataaggaacatggatcaagaaaaaggttcagccacccaaaaggtcgtgatagcaaagatttatcgagttccagtgatcttcaaaatgatgggaaacaccagttggataaaact

SEQ ID NO: 69420 - DNA, 324 bp, Zea mays
  Clone ID: LIB3078-049-Q1-K1-A11
acgcatgcatccacgcgaacgcccacgcgtaactcaagattgcaatacagagagcgtatcagaagtgctttcacaatctccactagatggatcgatacaaggatcacacaatcggtcatgctatccaagccaaatatgagacaacagacatatatctctggcctgggccaatgatgagtggaatcgtctgctgctggtacgactgtcgatactctgctgaactcggctaccttcagcaatgtcaagacaaagattatcggatcaaggaacccacttaatgtgattaacgctctcttcatacactttcaatgctattgaaacccc

SEQ ID NO: 69421 - DNA, 435 bp, Zea mays
  Clone ID: LIB3078-049-Q1-K1-A2
cgggaggatctcggcggcgtctatcggaggcgtcggccgcactcgcagggcggccccggtgggcgtatccgcctcgccgttcctccggagctccttcgtctcgtcctcctccacgtcgtccgcctccgcctccgccttccccgcttcgctcgcggcggctgtctcggcgtctctggcatttacgtcctactccgcgtttgcgggttcatctttgggaatcgagttcagctacagtataatgacaacacggagatcccgcggtatgcagattagggctggaaaggctgccctatgcatgaccaagaggtcaaggtctaagaagtcacttgcccgtacacatgggttccgcaggcggatgcggactacttctggaaggaaggtactgaagcgcaggcgcgccaaaggcaggaaggttctttgcacaaggacaaactc

SEQ ID NO: 69422 - DNA, 451 bp, Zea mays
  Clone ID: LIB3078-049-Q1-K1-A3
ctcggccgccggatccggcgtcgtcgttcctcggaacttcaggctcctagaagagcttgaacgtggagagaagggcattggagatgggacagtgagctatggaatggatgacgcagatgacatctacatgcgatcatggactggcactattattggccctcataataccgtccatgagggtcgcatctaccagctgaagttgttctgcgacaaggactaccctgagaagccaccatcagttcgatttcattcaagaataaacttaacatgcgttaatcatgaaactggagtggttgacccgaagaagttcagcgttctgggtaactggcagcgtgattactcaatggaatacatcctaacccatctcaagaaagagatgacatcgccacagaaccgcaagctagttcagcctgcggaagggacattcttctaaagatggcagcaactcatg

SEQ ID NO: 69423 - DNA, 428 bp, Zea mays
  Clone ID: LIB3078-049-Q1-K1-A4
gtgccgggcctcgcccccgccgtcgtcctttccaactacaccaagtcgcagtacaaccggttcctcaacgacagccagttctccggcgccgggatcgcgagcgagggcgactgggtcgtggtcgtgctcagcaccagcacgggatccggcgactactcgccggctccgccgggctccaactgggcggtctcggcggctcggccgttcggcttcggccagctggtccttttgttggtggggtttgtagttttgctggtgaagtgagtgtttagtacgcatgcaccaacatcttcgtggcttatgttgtcacgttcaggtctcgttggctttattaagcttttttcacttgaaaagattgattacgaaacaaacatgtgatttattgttaaaaaaagtaaatcaatctatcgcaatagttaatggaagtc

SEQ ID NO: 69424 - DNA, 444 bp, Zea mays
  Clone ID: LIB3078-049-Q1-K1-A5
gccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaggtgccgagcggcgtcgacgccaccaagatctcgcaggaggagtacctcaacgcgccaggcgagacctactccgtcaccctcaccgtgccgggaacctacggcttctactgcgagccgcatcaaggagccggaatggtcggcaagatcaccgtc

SEQ ID NO: 69425 - DNA, 118 bp, Zea mays
  Clone ID: LIB3078-049-Q1-K1-A6
attacgcgtgggttaacaaactatcaattaggagatcgatgcttatcatatggagcataggcgtatgatgtattgcataccatgctctagaatgtcattctatgatgtgaacagagca

SEQ ID NO: 69426 - DNA, 272 bp, Zea mays
  unsure at all n locations
  Clone ID: LIB3078-049-Q1-K1-A7
cccacgcgtccgcgcgctagctgaggacggtacagtggcacagaggtgcggggtacgacgacgacgacgcaggcgccacacatgggatcccagctctccgtcgccgtgccccggatccacggcctacggtgctacgccgctcccaggtccgctgtggcagcgctgcacgccgtgagggtggacaggaagaggtcgtcgtcgcacggcatacgctgcgactacatcggctccgncaccaacctgatcatggtgaccacgacgacgctgatgct

SEQ ID NO: 69427 - DNA, 433 bp, Zea mays
  Clone ID: LIB3078-049-Q1-K1-A8
cgacaagaaggcgtggccgtacgtccagaacgacctccgcctccgggcctcctacctgcgctacgacctcaagaccgtcatcggttccaagcccaaggaggagaagcagagcctcaaggagctcaccggcaagctcttcagcaccatcgacgatcttgaccatgccgcaaagatcaagagcaccccggaggccgagaaatacttcgcagcaaccaaagatgcgctcggcgacgtactcgccaagctagcctagatggaagctaatagatgggttaacgatggccacataatttcggacttgtgtttgttcatatggagccggcaaatgtaccgtttcctgttcatattatatcccaagttcttgacaagtacctttgcgggcggatggaacatcagaaacattttccagcagccttaacaagtgatccacgta

SEQ ID NO: 69428 - DNA, 381 bp, Zea mays
  Clone ID: LIB3078-049-Q1-K1-B1
gcgccgtgctcgacaacctggcgctctccgacgtcgggctgctggaccagatctcgtgcgccgacgacgtgcgctccgccgagcgcgccgacggcgccggccaggtgtactacgagtacgaggtggcgggcgccagcgcgcacagcctcatatcggtgacgtgcgcacggaacaagctgtacgcgcacttcgtcaccgcgcccaacgccgagtggagccgcgacgaggccatgctccgccgcttgcacgagtccttcaagaccatccagcccggcgccccgccaccggccacggagacctagctccatctgagcacgagcgagaaacctactgagcgattcgcggtgcgttgtaattgctagtaaaaatcatcagttttgt

SEQ ID NO: 69429 - DNA, 460 bp, Zea mays
  Clone ID: LIB3078-049-Q1-K1-B10
ctttgctggacatagtaacacagtgacatgtggtgattttactccagatggtaaacttagatgcactggatcggatgatgcgtctttgaggatatgggacccaagaagtgcacaaagcagacatgttgttcgaggccatggctaccattctgatggattgacatgcttatcgatgacttcggattcacaaacggttgttagcggctccaaggacagttctgtgcacattgtgaatttaaactcgggccaggtcgttggctcattagcaggccacaccagttctattgagtgccttggtatctcgtcaagctatggctgggtagctacagggagcatggatcaaaagctgatcatctgggacctcacgcaccaatccagccgatgcatttgcgaacatgatgagggcgtgacatcactgacatggctaggttcgtcaagatacgttgcgtcaggatgcatt

SEQ ID NO: 69430 - DNA, 322 bp, Zea mays
  Clone ID: LIB3078-049-Q1-K1-B11
gcggccgggcctgggccgctgtcggtatatcgatccggacctggaggaggacgccatggacgtgtaccgcaccaacggcgtcagcccggaggacttcgagtacgggaagtatgacggacaccacacctatttcgaaggccaagacaagaagggcttctgggaagatgtctccgagtggtaccaagaagctgagcctgctcagggctttcaagcactcatctgctgggcatttactgctgcgatcatcctcggcatggctttcaatgtgccgggagagtacctggacatcggggccgccgtcttcatcgtggtgttctgcgtc

SEQ ID NO: 69431 - DNA, 163 bp, Zea mays
  Clone ID: LIB3078-049-Q1-K1-B12
gccttttcagctgctaatggccttgacatttagtggtgcaaggctccagaaaatggactgattgcttcagaccttgtaagtggatcttgatgtacagccagagaaagcggctgaaagaggaggctatgggggtgagcgatatgaaacgatcgagtcttctaaa

SEQ ID NO: 69432 - DNA, 441 bp, Zea mays
  Clone ID: LIB3078-049-Q1-K1-B2
cgccagtccaaccaagtcagcacccgcgcgcggcaaggagttcacgcccatggcgagcacgaacatggcgtcggccacctcgcggttcatgctggccgcgggcgtgcccactgccagtagcggcagcggccgtgtcagcttcgcctcggcgcccaaccggcttggcaggaggcttgtggtccgggccgatgaggagtccccggcagagccggcgcccacggcggaaggggagggcgccgtggccaccaagcccaaggccgagaagccgtcgccgatcgggcccaagaggggcgccaaggtgaagatcctgaggcgggagtcctactggtacaacgggatcggcaacgtcgtcaccgtcgatcaggatcctaacacccgttacccggtggtggtgcggttcaacaaggtgaactacgccggcgtgtctaccaacaactatgc

SEQ ID NO: 69433 - DNA, 445 bp, Zea mays
  unsure at all n locations
  Clone ID: LIB3078-049-Q1-K1-B3
tgctaattcagtccagaatggcggatcccacaatattttactgagaccacccagtcaaggttctagtttgggatcatatgatccatttctgcagcaataccagcagcctcagcctcaaaatcatttcagattgcagcagatgtcttcagctgcacattcatatcgggatcagattcaaaagattcaggcgggaccgacaccacctgatccatatggcttgttaggatttttgggtgttataaggatgaatgatgctgatttagcatctcttgctttaggaatagatttgacagcattgggtttgaacttgaactcgccagataatctatacaagacatttggctcaccctggtcgaatgacccagcaaaaggagatactgattttcgaattccagcttgttacctctttgacaaaactcctncactacagaccttactttttcag

SEQ ID NO: 69434 - DNA, 405 bp, Zea mays
  Clone ID: LIB3078-049-Q1-K1-B4
ggaaccgcccttgtggtacagacggcgagggtgtatcccggagcttttgtgctcgagttccacgttgggattgtcgtcgcgtttgtgttcctgctcctgagcctgatgggcaccctgttggtggtcacctgggctaggtttcgggtgcccaggtgctggggatactgccttatgggcatgtacatcttgttcaccgttgtcagtattgccatcgcgagttattcaggatgatatgtcatcctttttttttttgtgaagatagccggccgctgatagattgtggtatatagttagcatgcgcaatctgtctgtctggttcaatgcctacgtatgctgattttggcggtgccggtgtggcacgcggaatttaatgtgatatttaatttgctgccgcattttaaaaat

SEQ ID NO: 69435 - DNA, 404 bp, Zea mays
  unsure at all n locations
  Clone ID: LIB3078-048-Q1-K1-H8
ggcaatgccatttgtcagacttttggaggtggaactttatccaactttgctatccaaggcaagaagttacggattgagtgataactgggtgcaggcccttgcgaagaaggatcctgtgcgtagacaagtcctacgggtgaaaggttgtttggctggatcgaaagcagaaaatcttctggagcagggagatatgattcttgctatcaacaaggagccaattacatgcttccttgacattgagaagacttgccaagagttggaccaatccattgggtcagatggagtgcttaacatgacaatattccgtcagggaaaagaaattgaccttgttgtcggaacttgatgtagagatggcaatggtacaacccgtatggttaatnggtgtggttgcattatcccagatc

SEQ ID NO: 69436 - DNA, 428 bp, Zea mays
  unsure at all n locations
  Clone ID: LIB3078-048-Q1-K1-G3
cggacgcgtgggggcaaatttattatccgtggggagaagtccattcagcagacaaaggcggagacacaatttgatgtgactgtgcaccatcagatatggcgtccgaggatacaccatatgttcacgttccagttgttatcgacttttataatgtctcaccgtcacactgagataagtcgaaaaaggagatacaccgcgtggatggagaaaaagagaagaaatnttgggagacattggaagtgctgccagtgaggctacgtctaagctcagaacaaatggnttatgttttttccnctaattcggtcgtatttggatgctngagtcctgcattgcatgatgaagaacattctcaatctctcttttttggtaataatttaaatcaggatctatanggtaaaggaagtggtttggaacagatttctgaatca

SEQ ID NO: 69437 - DNA, 417 bp, Zea mays
  unsure at all n locations
  Clone ID: LIB3078-048-Q1-K1-G4
cccacgcgtccggcggcgcctgcgcgaggcccctacgtcgtcgttctacggcggcgggtgcccgaccccggcgccgagcctccagggccggcacggccggagcgtgccggacgagatgtcacagctgcagcgggagaacgaggagctcaagatggagctgctgcggctgaagatgaacctgagggacccgtcggcgcccccgcagcacagcgacgctccaccatcggggcgccgcccgctgccgaagaaggcggcaggcggcagcggngggttcattaacaacgtgtccaagaagctcgggcggctgaacccgttcctgcggcctgacgccgtgggtggcgccaaagtgcgcaccaagccgtccaggaccaaagatcggaggcactccatcggctagtgattggaatggctcatgct

SEQ ID NO: 69438 - DNA, 404 bp, Zea mays
  Clone ID: LIB3078-048-Q1-K1-G5
ccgggtgcagcccgacgaggccatctacctcaaggtcaacaacaaggtgcccgggctgggcatgcgcctcgaccgcagcaacctcaacctgctctactccgagcgctaccgccgcgagatccccgacgcgtacgagcgccttctgctggacgccatggagggcgagcgccgcctcttcatccggagcgacgagctcgacgccgcctgggccatcttcacgcccgcgctcagggagctggaggacaggaaagtggcgccggagctctacccgtacggcagcaggggccccgtcggcgcgcactacctcgccgtcaactacaacgtcaggtggtgagacatcaccagcgatgacgacggcgccttctagctctagacagagacatgcattcatcgattcgtgacgc

SEQ ID NO: 69439 - DNA, 229 bp, Zea mays
  Clone ID: LIB3078-048-Q1-K1-G6
gcacattcatccacactaacgaacgttctctagctccgatcacgagctagctgaagtcgacattcgccgctgtgctgaacagcacgaagacgcctaatgcgatcgctactgctggtgagaccgcgactcgtactatctcctactgctgaacgccatggttggcgagcaccttctctttatgcagagctacgagctcgacgcctactgtgacattttaacacccgagctc

SEQ ID NO: 69440 - DNA, 397 bp, Zea mays
  unsure at all n locations
  Clone ID: LIB3078-048-Q1-K1-G7
atcggccaactcccccatctccgcaagctctcattccgccagaacctcctcgacgatgacgccgtcgcgccactcacgtcctgggaggctattgccgggttgaaggagttcgtccttagagataacaaacttacaaggattcctgatgctggcatattcaaggatcttctggtgttcgatgtatctttcaatgagatatcttctttgactggtctgtccaaggtttccatcaaattgaaggaactttatgtttcaaaaaatgaagttgcaaagatggaagagcttgaacatttccatgcgctggaaattctngaacttggtagcaacagattacgggtaatggaaaatcttgaaaccttgacaaatctacaagaactgtggttggggaagaaatcga

SEQ ID NO: 69441 - DNA, 460 bp, Zea mays
  Clone ID: LIB3078-048-Q1-K1-G8
aattccgggaacctagtaagcatgcagtcatcactttctgatgttaacaagttggtcaaggagatccggtctgatgtgggtggagtagttgcagctgacgagtttgagtacaaggatcctgttgatggctctgtgtccaagcaccagggcatccgatacctctttggagatggttcacgactggtgttccgcctctctggaaccggttctgttggtgccaccatccgtgtctacatcgagcagtacgagagggactcctctaagaccggcagggattcacaggacgcccttgctccgctggttgatgttgcgctcaagctctccaagatgcaagagtacactggacgctctgcccccaccgtcatcacataaattttgaagagtgttttagaatgaagtgaggcgcttacacaaactttcattccgggctcttgttacatagtttttcttgcattgtaca

SEQ ID NO: 69442 - DNA, 433 bp, Zea mays
  Clone ID: LIB3078-048-Q1-K1-G9
cccacgcgtccgcccacgcgtccgctcacctcgaccaccgccatggccatggccttggcctccgcgaccgccgccgcactcttccgctccgccctgtccgcgccacacggcgccggcgcgcgcgtccggccgcagcgccggcagccgttcttggctccgctccacgcggcgaagggccccggctcggcgccggtggtgctggagggcaaggccaagggaaagaagaagaaggggcccagctccgggaaccttcccgcagccctcgacgtcgagatcagggaggcgcatgagtacctcgacagcgaccagcaggaacctgttccagaaaactttccatttgaattaatcgacgaagagggtatgagcgtggttattttgagaagggactacaaggacgagaaggtcgaggttactgtcagcatgccctaattag

SEQ ID NO: 69443 - DNA, 200 bp, Zea mays
  Clone ID: LIB3078-048-Q1-K1-H1
aaaaaaaaaacaactaaacactcatatttttttaaaataaaatcagaacctactaagggatgggtttttaaaaccaatcacgttctaaagacgctcttgcagatatgaatgaatatcgtgcctagacaaaacaaacttacaaggcttgctgaagctgccatatataatgatcatctggtgatcgatgtatatttcaatga

SEQ ID NO: 69444 - DNA, 363 bp, Zea mays
  Clone ID: LIB3078-048-Q1-K1-H11
ctcgctcagaatacaaccaagggctttcgcgcccgctctcacccactcgctagcaacgaccaatactgaagctcctggcgtacagtgacttcaaggacacagcttggtgacctacacttgatcatgtctcaatgaggataaagcacactcagcatattttgggacatcatccatggcaagcaatcgagctggaagccaccgcggaagtacagacttgccatcttgagtattccccaactcatactcaacagaaacatcaagacgtgtctccggaaccaaccttgactgaagctcctagcatacagtgatttcgaggacacggcttggtgacctgcagttgatcatgtctcaatgaggataaag

SEQ ID NO: 69445 - DNA, 311 bp, Zea mays
  Clone ID: LIB3078-048-Q1-K1-H12
ctttctccagctctctgataagctagccagcgtcgtcgtcgtgtcttgctaggtatgagctctatctcgccgccctgcagacgctgatcgagtgagggaattcagcagcagcagctgcaggtagcatagcatagatatgactgctgccgacgtggatgccgtcaatgacatcgtcgaggagaaggccgtcgagccgctgccaccgtcgaccgtcaagccggccgacgactactacaatgccatcgtctctcttgtcggcaaggactctgctgctgggaaaccccctacagctattatcggaagctcaactg

SEQ ID NO: 69446 - DNA, 452 bp, Zea mays
  unsure at all n locations
  Clone ID: LIB3078-048-Q1-K1-H2
cggacgcgtgggcggacgcgtgggctgacgcgtgggggagcgatcgactacgaggagtttgagcacatgatgactgccaaaatcggagagagggatagtaaagaggagctttcaaaagcattccgcattattgatcaagatggaaatggaaagatttctaacattgatatccagaggattgccaaagagctgggtgtaaatctcaccctcgatgagatccaagacatggtgcaagaggctgatagaaatggtgacggtgagatagactttgacgagttcatcaggatgatgaggaggaccagctttggctactaggtgtatttatctgtgagtgcttgacgctgccagtttgtttatgactaccgggcgtgtgttaatcgactggtgttgttactatgaacaataaatgtgtgctctggnttcgcttatatatataatttaaattaatttaa

SEQ ID NO: 69447 - DNA, 415 bp, Zea mays
  Clone ID: LIB3078-048-Q1-K1-H3
ctgggccatgctcggcgcgctcgggtgcgtgttcccggagctgctcgcccgcaacggcgtcaagttcggcgaggcggtgtggttcaaggcgggctcccagatcttcagcgagggcgggctggactacctcggcaacccgagcctggtccacgcgcagagcatcctggccatctgggcgtgccaggtggtgctcatgggcgccgtcgaggggtaccgcgtcgccggcggcccgctcggggaggtggtcgacccgctgtaccctggcggcagcttcgacccgctcgggctcgccgacgacccggaggcgttcgccgagctcaaggtgaaggagatcaagaacggccgtctcgccatgttctccatggtcggcttcttcgtgcaggctatcgtcaccggcaagggccccctcgagaac

SEQ ID NO: 69448 - DNA, 260 bp, Zea mays
  Clone ID: LIB3078-048-Q1-K1-H4
cccacgcgtccgcccacgcgtccggtgtaaggacacagactgttgttcgttgctcttgtccgacagccatgcttttggtattgcgatccgagtgcgtgtgatctggatggagcttggagatgacggaattgcgacggatcctcatgtgccagcggctccgcctgcgctgaaccgctgtcatgcctaccatcgttgaacaaaggcagtttgtgttctgccgagcgtccatctcgagaacataatgtaatctccacttggct

SEQ ID NO: 69449 - DNA, 392 bp, Zea mays
  unsure at all n locations
  Clone ID: LIB3078-048-Q1-K1-H5
cccacgcgtccgcagctagctagcgttcctaatcaccgacgaataatctcttctggagctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggctgaccggcaggccacctgcaactgcctcaagagcatgacnggccggctcggccgcggcgtcagcat

SEQ ID NO: 69450 - DNA, 233 bp, Zea mays
  Clone ID: LIB3078-048-Q1-K1-H6
cggacgcgtgcggagcccgccatcttttctaacaccaccacctacatccccaaggcgtgcttctaccaccgaactatccgaccgcccgagtatccaccaatgcagattgcgaccgacgccaaggagatcgcaacggccgccaccctggtcacgccactagcgatactgggcctacgaacccgcatcagccgagtagaagcgagctgcggactagacaccacctacatcgcaca

SEQ ID NO: 69451 - DNA, 389 bp, Zea mays
  Clone ID: LIB3078-048-Q1-K1-H7
cggacgcgtggggaaaaggtccgctcggaaagggagattcctgatgtgcagcctggaggcatcattcagatgagattgcaagttcctgagaacaaacggcgtgagtcgacgctgaaggggattgtgataggaaggcgcaacgccgggatcaatacaaccttcagattgcgtacattagcggctggtgtcggagtcgagtctgtctttccactttactcgccaaacatcaaagaaatcaaggtattgcacaggaagaaagtcaggagagctaagttgtattacctgagggacaggatgaacgcacttagaaaatgagtctttcagcttgtttcaaggaatttcgccgagcggatcagcacggtttctgaagcgcaacggttgcagccctg

SEQ ID NO: 69452 - DNA, 447 bp, Zea mays
  unsure at all n locations
  Clone ID: LIB3078-048-Q1-K1-G2
cccacgcgtccgcggacaccatcgacaacgtgaaggccaagatccaggacaaggagggcagcccgccggaccagcagcgcctcatcttcgccggcaaacagctcgaggatggccgcaccctcgccgactacaacatccagaaggagtcgacgctgcacctggtgctccgcctcaggggaggcgccaagaagcgcaagaagaagacgtacaccaagcccaagaagatcaagcacaagcacaagaaggtgaagctggccgtgctccagttctacaaggttgacgacgccaccggcaaggtcacccgcctccgcaaggagtgccccaacgccgagtgcggcgcgggggtcttcatggccaaccacttcgaccggcactactgcngtaagtgtggcctcacctacgtctacaaccagcatgcgtaggatgcccctnctttcttgtcggaag

SEQ ID NO: 69453 - DNA, 406 bp, Zea mays
  Clone ID: LIB3078-048-Q1-K1-F1
cttgggtctacttcttgccatcaagaaacttaccaaggaccaagtacaaacgattattgagaaaattgccaaccaactatcggggtggaaatctgatttgatgactaaggctggatggaaggtccatgtgcagtttgtcctcacagggatggtcatatatctcgcaatggctgtggatttacctccttgggctctcaaagctattgacaagatccgccgaggctttctttggcgatggcgcaaagaagcgagggggggacactgtcttgttgcttggggaaaagtttgtcggccgcttgagcttggtgggctagggatttccaatctcattgatcttgcttgggcacttcgtatgcgttggttttggttagcaaaaactgatccgggacggccatggggcctcctt

SEQ ID NO: 69454 - DNA, 425 bp, Zea mays
  Clone ID: LIB3078-048-Q1-K1-F10
taacaagtgatccatatgttgctttaacgctcggagggcagaaagttcaatcgacgggtaaaaaaagtgatctgaatccggtatggaatgaagtgcttaagatatctgttcctcgaaattatggacctctaaaacttgaagtgtatgaccatgatacgttctcagccgatgatatcatgggtgaagcagagatagatctccagccaatgatcacagcctccatggcctttggagatacttcacgtcttggtgacatgcatattgggaggtggttcatgaccaaatacaacgccctgatgaaagatagcacggtgaatgttgcggcaggtaaggtaaaacaggatgtgcacttaaagctactgaacgtataatcaggtgagttggaattggaactagaatgggctccgatcctctagactaatgat

SEQ ID NO: 69455 - DNA, 375 bp, Zea mays
  Clone ID: LIB3078-048-Q1-K1-F11
ctgctcgtcatggacatcttctcgtatcacctcgatgatcgttacgcccaaaaccgtgaatgcctactacatctgtatgcactatccactgcagtacgtatcacatctggacgtgctaattatagacctctaaaacttgaactgcatgaccattatacgtactcagccgatgatatcatgagtgaagcacacatagatcttcagcctatgatcacatgctccatctcctttggagatacttcacgtcttgattacatgcatattggaaggtgtttcatgaccaaatacaactccctgattaaagatagcactgtaaatgttgcgacaaataaggtaaaacatgatgtgcacttaaagctacataacgtttaatca

SEQ ID NO: 69456 - DNA, 381 bp, Zea mays
  Clone ID: LIB3078-048-Q1-K1-F12
cccactcgtccgcccactcgtccggtcgtggtggacgacgtgctcaagggcatgagggacctctccgccgggatggacacggtcaagtctttcgagtggggccaggacgtgctgaaccaggagatgctgactcagggcttcacgcacgtcttctcgctcaccttcgcctccgtcgcctacctcgccgcctacatggcccacgacagccacaccgccttcgccgccaccttcatggccgtcatcgacaaggtgctcgtcgtcgacttccccgtcgtcgtcgccaagcctccgccgccggcatgacccgctggccgctctcgcatccgccggccactgtacgcctccccttctcaggtcgcgcagcagatccacgtgtgcctg

SEQ ID NO: 69457 - DNA, 390 bp, Zea mays
  unsure at all n locations
  Clone ID: LIB3078-048-Q1-K1-F2
cacgagccacagcccacaggtaagcgtcgtcttttcacgccgcgttcccatactctgcgctacagttacagtcacggcgcgtccgtcctgacgctcgccggccttgcatttaccggttctcaccgcctgtccgcgctgcccgtcgccagcaggctagctctctagcggtctagccagtccacgcagcgcagggatggcgtcgttcgccgtggcaacggccccgtcgctagcggccccggcagccaagaggaggcccgccgccggcgtcacgtacgtggagggcatgaacgcctacagcggcctcaaggggctcaacaaggtgaccatgctncgngtgcgcaagaccgncgactactccttcgccaaggtcgtggcgtcgctcagccccgc

SEQ ID NO: 69458 - DNA, 418 bp, Zea mays
  Clone ID: LIB3078-048-Q1-K1-F3
tgccgaacttcagcacgccattgagctccagagccgccgcctcatggatctccagctgcgcggtctcaaggctcgcgcagctgcgacagcagcagcggcatcggcactgccaacaccagttgccaatgcctttgcgtccaaccatcctttgagcaccatggcagtcgagtcgccactagagtccggagagcagctcaagctgagcagtgggtttgctctggaggggaagctcaacggtggcgacaaggaagaatctgcttgcgaggcgagccctgacgccgctgatagcgaccaaaggtggattaaacaacccatttcatcattcttcttccttgttaagtatgattcccacgcttggccttcatgaatcatgatcctatatgtatatggatattaatcaggtctaggaagttcaaca

SEQ ID NO: 69459 - DNA, 380 bp, Zea mays
  unsure at all n locations
  Clone ID: LIB3078-048-Q1-K1-F4
gggctcccctctctaccgcagatcagttcacactcgtagagagaaggaaaaatatccgcagaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacngcgagaagttccccgacgagaagntcgtgcgcaagcacacc

SEQ ID NO: 69460 - DNA, 366 bp, Zea mays
  Clone ID: LIB3078-048-Q1-K1-F5
cccacgcgtccgcccacgcgtccggcgccactgtccagtgcgcgcgtcaagcttgcggagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctg

SEQ ID NO: 69461 - DNA, 426 bp, Zea mays
  Clone ID: LIB3078-048-Q1-K1-F6
ccgcacgcgtccgcatcgacaagatcgtgcagtgcatggagagggacctcttcatgcgtcccgacgaggcgcgcgactggggcctcatcgacgaggtcatcgagaaccgacctgcctcgctcatgcccgacggaatcgttggaggcctcgatgtgcccagcctcggtggcggtggtggcggcggcggacggggaagcgacgtcgaggagccttcggcggtgtgagaattggcctcaaaggtgaaatcccgttcgcatccggtggctatgttgtttgttgttagatctgaaggttcgattcttaccgtacaaggttaaccttgttattctggttacggaggcatccggctccacattctgcttggtgcttcaaatgcctgaattgagctattggtgatataattattacaacctccaggaaattctg

SEQ ID NO: 69462 - DNA, 407 bp, Zea mays
  Clone ID: LIB3078-048-Q1-K1-F7
cgctcgtgagattccaccactcaaatctgaattatggaaggagatgggttggcaagggaacgatccatctactgatttcaggtcctcttgtaatttgatcgtaaggagaatgtgctcatggagaaaattaacccagttgataaacacatctaatactgatcgcatttatgcaggggtggtggactcatatcgttggagaacctcatcttttttgctaggaactaccctgtatagaacttagatctgacacctttttctgttgtcttcctaattttttgatttttgaccattcacctgtacacattctcgtgcagaattcatttcagatgcttctgaacaaagtacaagggcagagatcagattgggagtacccttttgcagttgctggtatcaacgtttcattcatg

SEQ ID NO: 69463 - DNA, 427 bp, Zea mays
  unsure at all n locations
  Clone ID: LIB3078-048-Q1-K1-F8
gcttcgtcccggcggtggcgtcgtgttcggccccaagccccgcgactggtccatggggatcaaccgcaaggagaagcgccttgccatctccactgccatcgtgagcgccgccaaggacgccttcgttgtcgaggagttcgaggaggccttcgcgtcggggcccaagaccagggatttcgtggccgctttgcagcggtgggggcttgacccaaagcagaaagccatgttctttgccacggacttcgacgacaatgtgcggctcagcggcaggaacattggttccctcaagatgctcacacccaggacgctgaacctgtacgacatactcgacgcacgcaagctcttctttactcctgctgctgtagactacctcaactncaggtacggagccagtgtttccgatgactactatactgatgatgaggat

SEQ ID NO: 69464 - DNA, 361 bp, Zea mays
  Clone ID: LIB3078-048-Q1-K1-F9
cagatgacactagcagagctactcgtataggaaggagctgatataatccaaagggagggtgggaaatgttctagcccgacaaaacctgtagtgcttggattgattgaaaaggcaacaccaacactcgccgcagcatactccatctctcgggctgttcgtattccagtgatgtgctcgtcagggttaagctcgctgactgcaccaatggcagtaactgcaggagctgctggagttggagtccgctctgctattaacaaactcaacgacgttgtggcaatgatcgctgacgtgagaagcattgctcaagcaatggagcttgctccaagaatcgtgtcccaaaccctgagaacaattagttact

SEQ ID NO: 69465 - DNA, 404 bp, Zea mays
  unsure at all n locations
  Clone ID: LIB3078-048-Q1-K1-G1
gagatccggagcagccgcagtcccaccgaccccgccgccggtcgccctccatctcctgggggctgcctctcgtttctctttccaataatcaagatgagccgtggtggtagtgccggtggtggtcaaagttctctgggttatctttttggaagcggtgagccccccaaaccagcagtggcaccagctgcaagtgctccacctgttgagaaaccatctgctgcaaagactgatgcgaccaagcaggttgctgctggggttaccagccaaaccaataactaccacagggctgatggtcagaacactggcaacttccttacggaccgtccttcaaccaaggtccacgctgctcctggcggtggctctttcctgggctacctgttcngtggcaactgatgcccgtgctg

SEQ ID NO: 69466 - DNA, 262 bp, Zea mays
  Clone ID: LIB3078-048-Q1-K1-G10
ctgcgtgttccctggagatcgctggtccaagaacgtgcgtcatagttacggcgaggtcggatgtggttcaagtgccggcgtcgcagatcttctcggaagggcgggcatggactactctgggcgaactcccaactctggttgcacgcacatgagcatcctgggccatcatgggcgtgccatggtggtgctcatgaggcttcgtcgagggctaccgcgtcggcggcagcccgctcggggaagggctcgacagggtgtaccccgg

SEQ ID NO: 69467 - DNA, 368 bp, Zea mays
  Clone ID: LIB3078-048-Q1-K1-G11
gagaggcgtaagtatattggcccgttctccgagcagacgccgtcgtacctgaccgtgtagttcttcagcgactacgggcggtacacctcgggcctgtcggccgacacggagacattcgcgcgcaaccggtagctggaggtgatccactcccggtgggcgatgctgcgctcgctgggctgcgtgttcccggagatcctgtccaagaacggcgtcaagttcagcgaggcaatgtggttcaaggccggcacgcagatcttctcgtagggctggctagactacctgcggaaccgtaacctgatgcacgcacagagcatcctggccatctgagcttgccatgtggagctcatgggctatatctatggctaccg

SEQ ID NO: 69468 - DNA, 332 bp, Zea mays
  Clone ID: LIB3078-048-Q1-K1-G12
gagctcacaaactatagtggcccgattttcaagcatactccattgaacctgagggtgtagttttccaacgactacgggttctacacctccggcctctcttccgacccggagacattttcgcgcaaccggcatctggacgtgatccactcccggttgtcgattctgcgctctctgggctgcgtgttccccgagatcctctccaagaacagcgtcaagttctgctagacaatgtggttcaaggccttctcgcaaatcttctcttaaggctggctatactacctgctgaacaccaacctggttcactcacacatcatccttaccatctattcttt

SEQ ID NO: 69469 - DNA, 427 bp, Zea mays
  unsure at all n locations
  Clone ID: LIB3078-048-Q1-K1-E9
cgccagtggctaggcaccttgcggagaggactaacggtacaaaaactggcctactgagcaaatgtgacggagagtgcctagtcaaatcaactcttcttgaaggaacctttgtcggaatagtgctccttatcatcttgatatcagggctcatgtgtatgatgggaatcgatactccctccaagtttgaagctccccaggagtcttgatctcccttcgaagcagaacccttgttttgttggtctgcactgtggatagatattattcagtttccccctttgaaagcgcctttcgtataattattattatttttttactgagccatctgttatttacgatgtgctcaaacttttgacaccaaacgaatgcatgtgtgtgaagcttgtgctgtgaccagacatagcattgcctncaggtgttttctgtgaat

SEQ ID NO: 69470 - DNA, 438 bp, Zea mays
  Clone ID: LIB3078-033-Q1-K1-A8
cgtacgtacatgcacaaaactagagcgagctgtgtgtgtgtgtgttcgtcatttcctcgatcatggcgaaggcgcaggcgcaggtggcggcgaggttcatgatggaggcgccgccgccgcaggtggtgtcggtcatgcggcggaggaaggcgccgaggagcctgagcaccatcgccgaggacgacagggagatgctggcgccgtgcgggtcaccgtcggaccacggccacgtacatacacataactagagcgagtagagataccgtctcttactgtgtgtgtgtgtgtgtgtttatcaactcctcgatgcatggcgaatgcgcatgcgcaggtggcggcgaggttcacgacggatgtggcgccgtcgcatgtggtgtcggtcatgcgacgaaggaaggggccgaggagcctggacaccatcggcgaggacgacaggga

SEQ ID NO: 69471 - DNA, 466 bp, Zea mays
  Clone ID: LIB3078-033-Q1-K1-A9
aattgatgctgtcataatgaaggaccgctacacacaaaagcccagaggctttggctttaggacttttgctgatcccactgttgttgacagagtgattgaggatgaacatgttatcaatggaaaaccggttgaaattaagagaacgatccctaagggagctgctcctttgaaagatttcaagacgaagaagatttttgttggtggattaccctcagctctaaaagaagatgaattcaaggaattcttttccaagtttgggaaggttgtggagcatgaaatcatccgtgaccatgcaaccaaccggtcacgtggatttggttttatagtctttgatgcagaaaaagcagtagatgatttattacataagaagggcaatatgattgatctaaatggttctcaggtggagatcaagaaggcagaaccaaagaaaccctctaaccaaccacctcgttcacttgatagtgag

SEQ ID NO: 69472 - DNA, 107 bp, Zea mays
  Clone ID: LIB3078-033-Q1-K1-B1
accacgcgtcccgcctcagcgcgtgcctttgccctacggcatctccagcgccggactggtccagtgcctatagcacccggacaccgcttagtccattctcaacacca

SEQ ID NO: 69473 - DNA, 458 bp, Zea mays
  Clone ID: LIB3078-033-Q1-K1-B11
cacacacacagagagagacaagtggtttccaaagccaagtgtgtactagcagtctagcagccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgaagagaagaaggaccacaaagacgccgaggaggctagcggc

SEQ ID NO: 69474 - DNA, 458 bp, Zea mays
  Clone ID: LIB3078-033-Q1-K1-B12
ctaggagcagcagcagcggcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcgtgtaaaatc

SEQ ID NO: 69475 - DNA, 353 bp, Zea mays
  Clone ID: LIB3078-033-Q1-K1-B3
ccgacgcgtccggcacttacaactactgttccgactcctacacgctcttcgacttcaggatcgcgctcatgggcttcggcgcgcaccggtgactacagtactggttcaacccgggctccatgggcacgctagactctcttggagcttctaagatgctcaccagctccttaatctcatgctacaactgtggtcctctgatgtatatttatgactttcgccagacctaatatgttatataagtgcaatggcgccgtgcgctagataactactgataagattgattattgcaaatggattgcattgatcgtgcatgaataatcatgcaggacgatctttctataagatccaagctt

SEQ ID NO: 69476 - DNA, 436 bp, Zea mays
  Clone ID: LIB3078-033-Q1-K1-B5
aaagtgcagaaaaatgctaggcacaacaaagtattcaggaagctcacagaatcatcgggccaagaagaaaaagaggaaaacaagttgtgagaattgcatacagcagtttcttcgtctgtggcatccacgacaaaaaatgtatgttggatgttggatagttgacttcgatcaaggaactaaaatgcatactctccagttcattgatcaccatactgaaaagtttgatttgaaagaagaagaatggcacttcttggaggtcgactctgatgaagattgatcattgaagttttattgcatccttgtacaaggaatagtcgtgcaagatgatattggcatgaggtgtggttaagtctcaacttccaattatgttgtgcatctttggaaaatgtaatctggccagtaacctttggaggatgaccgacttcgtgagagtttt

SEQ ID NO: 69477 - DNA, 479 bp, Zea mays
  Clone ID: LIB3078-033-Q1-K1-B6
acgcccacgcgtccgcggacatcgtgggtgacatatatgactttgctaacgcgcatcgctgaaaagatgatgatcgagtgccgggggagcagatctcacggaggttgatgtctgtggccacggattctactcactcatctcgttccgtgaccctgtatgcattgcttccgctcctgttgttccgctacgcacgcccgatttttgcatcgagcaccgagatctacaacaaacacatggagctacgacgcgattcccaagtatgatggattccactattcatcaaccgaaattatggcgcgcttcaatcgtggctactctgatggggacctgatccgttatggtgtgcttgaatcgtggctgtggagatgtgtggaactcattggttaaagtgtgctttattaataatggtgatgctgatggaactgattttgctcccgttggactgcctgattggttactttgccctgttgactgtttga

SEQ ID NO: 69478 - DNA, 305 bp, Zea mays
  Clone ID: LIB3078-033-Q1-K1-B7
accagcagctacttctctgcatgagccatgatgttgtctgatgctcttactagggctgccaaggccgcggctgatctggccgctcatggcagacagagttaaagtgaaaaacaaaacatacaatccatcctttttcagttactaaacatgaggacgaacaccttaataggatgcttgaagtgttgttgttcgatgtatatttataacagacaacattgttgatttgttgtataaattaaaaggagacgtacactgcgtttgcactgataagtttgattattgcaaatggagtcgagtgatcgtgc

SEQ ID NO: 69479 - DNA, 389 bp, Zea mays
  Clone ID: LIB3078-033-Q1-K1-B8
aattgagccacctttggaagttttcgtccctgcaaagcgcactccatggcctgaaacagccaccgtgctgccagccgagttattggatgacaagcaagatcaggaggataggcgcttgtcaagagccaacaaatcatctcggcctcgaggcaccacgaatcggaagggcgacccttaaggacaagataactgatgcagaacgtactggccttgtgatgtatatcttacactctgcaaatacacacagtatcaagcatatcctgttaatctggctgtgtcagattattactgtctgctctatacttttctgatcgtcttgctactgtggcgatggtccaagcttgggtatgttatatgtagagggcacattggtaaagtagtggatgtat

SEQ ID NO: 69480 - DNA, 467 bp, Zea mays
  Clone ID: LIB3078-033-Q1-K1-B9
ccacgcgtccgtgcaattggtgcttgtgttggtagtcctgctgatctggcactcattagggtgcaagccgattcgaccctgccagttgcacaacgacgcaactataagaatgctttccatgcactctaccgtatcagtggtgatgagggagtccttgcgctttggaagggtgcaggtccaactgtggtgagagctatggcactcaatatgggtatgcttgcttcctatgaccagagtgtcgagctatttagggacaaatttggcgcaggagaaatttctactgttgttggagccagcgctgtttctggattctttgcctcagcatgcagtttgccctttgactatgtgaagacacagattcagaagatgcaacctgatgcgaatggcaagtacccatacacagggtctttggactgtgctgtgaagaccttcaagagcggtggcccattcaaagtctacactggttt

SEQ ID NO: 69481 - DNA, 434 bp, Zea mays
  Clone ID: LIB3078-033-Q1-K1-C1
caccagaaaggatgctcctcggcgtctgtgccgtgctgatggtggtcggcgtcacgaacgcggcggagggccaggtggcgtctgtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgccgacctccacggcgcctactgccacgcgcagctccacagcgccgccaataacgcgccttgccctgggcaggagccgtccaggatcgcgcccatgtcatgcggcaccttcgtcgccgtgcctggcaagatgcactacccgtccgcggagtgcgcgttcgcgtttctctgctccccgatc

SEQ ID NO: 69482 - DNA, 436 bp, Zea mays
  Clone ID: LIB3078-033-Q1-K1-C10
gaagaggccaacatcgaggatgtttatacagacgacgagttgaacgaagcagggcagtactagtcgcggaaaaacggacaaataccaaggattaagagggacagggaggaaagatatgcgaggttgaaggataaggacgagatcgagaaagtcaggaatatgaccgaggatgagcgtcgcgaatggcagcggaagaatccgaagccgcttcgtcagacgaaacagaagtggaagtttatgcagaagtattaccacaaaggcgccttcttccaggaaggtgctgatgatgttatccagtcagcgggtaaagaggatatctacacccgtgatttctctgagcccactggagaagatcagatggataagagcatgctgcccaaagtcatgcaagttaaacatttcgtgcgcaatggcaagacgaaatggacgcatcttg

SEQ ID NO: 69483 - DNA, 468 bp, Zea mays
  Clone ID: LIB3078-033-Q1-K1-A6
aaaaggagccgcgacaggatgcactcctttgggcaccgcgccaacgcggtggcaacgtgcgcggtcaccatactggccgcgatttgcttcgccgcctccttctccgacaacttcaacaccccaacacccactgcctccgttaagatcttgaatctaaactggttccagaaggaggccaacggcaacgacgaggttagcatgacgctgaacatttcggccgacctttcgtctcttttcacgtggaacacaaaacaggtgtttgtttttgtggcagcagagtatgagactccacagaatgctttgaatcaagtttccctttgggatggcattatacctgcaaaggagcatgccaagtttttgatccataccacaaacaagtacagatttattgaccagggaagcaatctaaagggcaaggaattcaacttgacaatgcactggcacattatgccaaagactggcaaaatg

SEQ ID NO: 69484 - DNA, 416 bp, Zea mays
  unsure at all n locations
  Clone ID: LIB3078-032-Q1-K1-G4
cgacgaacgcgtccgcgccgcactgcctttaatattttgggtagcgtaggcgatcactaatgtcatagtgaaggacttggggatcttgaagggtccgtgtccaaactgcgggaatgaaaacctctccttcttcggtaccatactgtcagtgcctagcggtggctcaaaaaacagcgtgaaatgtgcaagttgtggcactgagttggagtacgactcttcaacccgattgatcacactcccagaaccggctgaggctaaataagtgatggcgtggtttcgatttcgctagcaggaaagacggnccggncggcccgcagattcttgatcgacgacagtacgaagcaagactgttctgggatcgggtggcaatcgtggagtgaatggatgttgctgtgctaatctgtgtgaatatatat

SEQ ID NO: 69485 - DNA, 298 bp, Zea mays
  Clone ID: LIB3078-032-Q1-K1-G5
cggacgcgtgggcgcgtgcgctgtcgtcggcctccctggcggggctcgttgaggcccggaggagcgaagacgcaggaaggtcggcctgccggtgcccttttgctgtgtcgccctgccgatcgttgacgctcgaacgtcgacccctcccgaagatcaggcttttgctgcgcgtcttccgaccgcgaccacctcgacttcggctacctcgacatctatgggctatcgtcttcttggagcacacaacggtctctgctccagccggaacattcgcaccatcacgacactgggaatggggggg

SEQ ID NO: 69486 - DNA, 309 bp, Zea mays
  Clone ID: LIB3078-032-Q1-K1-G6
cggacgcgtgggtccctaacggcccctccgagctcgccgtcaaggaggccgcgtgggggctggcacgctacgccgccatctcacaggacaacgggcttgtgccgatcgtggagccggagatcctgctggacggcgagcacggcatcgagcgcacgttcgaggtggcgcagaaagtgtgggccgaaaccttctacgccatggcggagaacaacgtcatgttcgagggcatcctgctgaagccgtccatggtgacgcccggcgcggaggccaaggacagggccaccccggagcatgtggccgcgtacaccc

SEQ ID NO: 69487 - DNA, 259 bp, Zea mays
  Clone ID: LIB3078-032-Q1-K1-G7
cttcctcctggcgcgcctgctcctggacgacatgcagaagtccgactacccgtcccgccggctgatcatcctcggctccatcaccggcaacaccaacacgctggccgggaacatcccgcccaaagccgggctgggcgaccttcgcggcctcgcggcggggctgcgcggccagaacggctctgccatgatcgacggctccgagagcttctacggggccaaggcgtacaaagacagcaagatctgcaacatgctcaccatg

SEQ ID NO: 69488 - DNA, 373 bp, Zea mays
  Clone ID: LIB3078-032-Q1-K1-G8
agaactccatgctcgacgctatcgagaacatgaacggcaaggagctcgacggccgtaacatcggcgtttaccaggcccagtcccgtggcggtggcggtggcggcggtggctactgcggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgttagtgtccgttctacctttggattaggtgttggtacccctgttgttccctttggtttgctcccgctttgaaacgagacgagagaagaatgagcacggtttttgttcgcagctaa

SEQ ID NO: 69489 - DNA, 202 bp, Zea mays
  unsure at all n locations
  Clone ID: LIB3078-032-Q1-K1-G9
attttgggaagctcgccgacctgngctacaagataagcgccaagaagtgcaaggagaagttcgagaacgtgcacaagtactacaagcgcacaaaggaaggccgcaccggcaggcaggacggcaagagctaccgcttcttcgacgagctggaggccttgcacgcagccgcgccgcagccacagccgncgctacagaagcagca

SEQ ID NO: 69490 - DNA, 434 bp, Zea mays
  unsure at all n locations
  Clone ID: LIB3078-032-Q1-K1-H10
attcccgggttcgtacccagcgcgtctctgattctgcaaccgaactcttggcattacttgtattcttcagggcgcctgatgcacnnagctctgtgtgtggaccanatgacactctgtgaaaaaaagagaacagtctcgatacaaatgccagctggaaaaactccttcaggagatacacgggtccagtttagttctgatcaaagtcacttgctagtagtacatgagactcaactagccatatatgacgcatcaaaaatggagaggatctatcagtggataccccaggacacattgtcagcttccatatcgcatgcatcatactcatgtaacagccagctagtttttgctgccttcactgatggtaacttaggtgtttntgatgcggagaacttgagattaagatgtcgaattgcaccatcggtgataaacagcaa

SEQ ID NO: 69491 - DNA, 245 bp, Zea mays
  Clone ID: LIB3078-032-Q1-K1-H11
accaaccttgtcatacttgtatcttttatttctaatgcacaactcttatacaatagggaggcttcctaaaaaaaaagggaacactcactatacaaataccatctggaaaaactccttcaaaatatacactgaatccaatttaattctcatcaaattcactagctaatactacatgacacttaactaaccatatattacgcatcaaaaatttagaatatctatcacttgataccccatgacacatt

SEQ ID NO: 69492 - DNA, 391 bp, Zea mays
  Clone ID: LIB3078-032-Q1-K1-H2
ggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttaccccc

SEQ ID NO: 69493 - DNA, 292 bp, Zea mays
  unsure at all n locations
  Clone ID: LIB3078-032-Q1-K1-H3
tcgtcgggctacttttcgcggtgttcatttggtgaagggcgaagctgacccgtacggtggtgatccccgggtgatacgggggagcggcgacgaccctcgggtgggcaccgtgtaaccaacccggtggttcaagcccggtacggcaaggagcattctgtcgtgaccgtccgaccttcgccgcttgtgtcgtgccgactcccattctcgcttgccgcttcttcattccacttccgtgcggccctactggcgaacatcttcgtnggtggacaatcgtacccggaaggattgcgag

SEQ ID NO: 69494 - DNA, 360 bp, Zea mays
  unsure at all n locations
  Clone ID: LIB3078-032-Q1-K1-H4
actctggctcgaccgacgcagtccgccacagcgtacgaacgcctacaaccagacgatctatatgaccgcgccagtactgactcgagtgtggcccaacaacaggcccttctgcgcctccgccttcggcgtgagcttctacgtgccggccaagaaccaggcggacccgccgtcggccgagggcctgcgcgtggaccgctgggccggggccaggtacgcggacgtgcgccgcttcgggggcttcgtggcggacgccgacgtcggggagcaagcggcgcggctcgaggccagcctacagggcacccggtgggccgccgacgttaacgacgctcgcagggccgaaccggactngccctacaccgt

SEQ ID NO: 69495 - DNA, 404 bp, Zea mays
  Clone ID: LIB3078-032-Q1-K1-H6
gacgtcgagaacccagagttcaagaggaagcttgacaggatggttgagatcaaccagaagatcattgccgtcggagaggccgacgaaatccccctagtgaagaacctgaagaggattcctcttgtcgcctctctggtgtccgagatcatcgccgcctacctcatgccccccatcgagtctggctcggttgatttcgccgaatttgagccccggctcgtttactgattctgtacaaagatttatccttgagttattcaccctgaaagacaagctgctggtgctttctgccgaaggggccttggatgaatggtgaaaaccgctggatggttagaggatctacatcttcttgtgttcttctgtaaaatactgagacttgggcagcataaaaagcttggcaaatttct

SEQ ID NO: 69496 - DNA, 292 bp, Zea mays
  unsure at all n locations
  Clone ID: LIB3078-032-Q1-K1-H7
gcagaaacctttgcccgtccaggcttgtgccagattgcaacagtggcagccattgacagtgcgtcanttcctcttaagtttggcaacccttcagatgatgttagcacacggatgatgatgaagggtatgaccgccaaaaacttcgatccagttcgctactcttgtaaatgggttgaggtagcctcgttgtaacgtggatttgctggtcaaggacaagaagactgttactgtactcagggagtgtattctttttatgagaaagcacgcttcaatccaggggatacattctgtg

SEQ ID NO: 69497 - DNA, 404 bp, Zea mays
  Clone ID: LIB3078-032-Q1-K1-H8
cccacgcgtacgaacgcgtacaaccagacgatcgagatgacggcgccggtgctgacgcgggtgtggcccagcgacgggcccttctgcgcctccgccttcgccgtgagcttctacgtgccggccaagaaccaggcggacccgccgtcggccgaaggcctgcgcgtggaccgctgggccggggccaggtacgcggccgtgcgccgcttcgggggcttcgtggcggacgccgacgtcggggagcaggcggcgcggctcgaggccagcctacagggcacccggtgggccgccgacgtcaacgacgcgcgcagggccgacccggtctcggcctacaccgtcgcgcagtacaactcgaccttcgagttcaccggccagggcaacgagatctggatgctctttgacgcgga

SEQ ID NO: 69498 - DNA, 398 bp, Zea mays
  Clone ID: LIB3078-033-Q1-K1-A1
cgacgactcggctcgcggacggagcctgtcgcggttctccatcgactcccccttcttggtcgcttccaggggtttctcttctactgaaacagttgtcccaaggaaccaagatgctggcctagctgacctcccagcaactgtggctgctgtgaagaatcctaaccctaaggtggtttatgatgagtacaaccatgaaagatatcctcctggagatcccagcaagcgtgcctttgcatactttgtcctgagtggtgggaggttcatatatgcttcactgctgcgtcttctcgtactgaagtttgtcctgagcatgtcagcaagcaaggatgtgcttgcccttgcttcacttgaggtggacctctccagtatcgagccatggaccacagtgaccgtgaagt

SEQ ID NO: 69499 - DNA, 461 bp, Zea mays
  unsure at all n locations
  Clone ID: LIB3078-033-Q1-K1-A10
cccacgcgtccgcccacgcgtccgcccacgcgtccgttgcacacaggaacgtgcccccagccgtcggttgtcttccaggaaagtttcaccaagagttccaagcggcagctaccccgtcgctcaggtgaactacgagctgaatgtgctgggaacccgagggcccaggcggatgcagtgcgctatgcattccatccccgcatcagcggtggagcccggcggcgtggtgcctgggcaaccgaaagagctcctcccgaggctgttcgacgagtccttccgcagcaccgcaacttcctctttctccaagtactccgtcgcggacagctccatggacctgggcagctgcccgttctccgaggtcgaagtgggcggngggagtctgcgagaaagtgacgagtcggaaaaggagaggccactggttctgcgcaacaaggcgccgaggtggcacgagcagctgcagtgct

SEQ ID NO: 69500 - DNA, 295 bp, Zea mays
  Clone ID: LIB3078-033-Q1-K1-A11
cgaatcaatgggttccaagcccgagatcaaattggtgctatgctcaactcatttaaccggggggggctttccgaatattctggggcattagaaaatcttaccctcaaaaagccttctgaggtatttgcttcccaaagcccaaggcttcccattgcccgccgcacttgccttcaagcgcttaagaccatttgcgccaaattccaccgtacttgcaaagcccttaaccttcttgtcaccccggcattaagtggcgtctgcctttaagccctgcaactttcgaaaacggcttgtcttc

SEQ ID NO: 69501 - DNA, 241 bp, Zea mays
  Clone ID: LIB3078-033-Q1-K1-A5
cgacgactcggctcgctgacggaaccagtctcgggtctgcatcgacttccccttctttggcgctttcaggggtttctctggtactgaaacagttgttccaaggaaccaagatcctggcctagctgaccttccagcaactggggctgctgggaaaaatcctaaccctaagggggttaatgatgggtccaaccttgaaagtattcctccggggaatcccaccagggtggccttggataacttg

SEQ ID NO: 69502 - DNA, 331 bp, Zea mays
  Clone ID: LIB3078-032-Q1-K1-G3
ctcatgcacgacctgtgcaaggtgctgctgcacccaagcttcggggagctccctcagtgggctgtcgtcggtgacaccttccccgtcggctgcgcatacgacgagtgcaacgtccacttcaagtacttcaaggagaaccccgactaccacaacccgaagctcaacaccaagttgggggtctactcggagggctgcggcctcaacaaggtgctcatgtcatggggccacgacgactacatgtacctggtggccaaggagaacaagtgcacccttccttccgcggggctgttcatcatcagataccactcgttctaccccctgcacaagcatg

SEQ ID NO: 69503 - DNA, 233 bp, Zea mays
  Clone ID: LIB3078-032-Q1-K1-E7
cccacgcgtccgcccacgcgtccggcgagggcgggctggactacctcggcaaccccagcctgagccacgcgcagagcatcctcgccatctgggcctgccaggtcgtgctcatgggtgccgtcgagggctaccgcattgccggcgggccgctcggcgaggtcgtcgacccgctgtaccctggcggcagcttctacccccttgggctgggcgacgacccccagggctttgccgag

SEQ ID NO: 69504 - DNA, 237 bp, Zea mays
  Clone ID: LIB3078-032-Q1-K1-E8
tcgcggacgcgtgggcggacgcgtgggctcggagggcgggctggactacctgggcaaccccaacgtggtgcacgcgcagagcatcctcgccgtgctcggcttccaggtcatcctcatgggcctcgtcgagggctttcgcatcaacggcctcgacggcgtctgcgagggaaacaacctctaccccggcgggcagtactttgacccgctgggcctcgccgacgacccagtcacctttgc

SEQ ID NO: 69505 - DNA, 272 bp, Zea mays
  Clone ID: LIB3078-032-Q1-K1-E9
tcttgctgagtatatctcacaagtttcagaaatttctgtcaaagaaaggggatactttgccatggccttatctggaggtcccctagtcagttttttggggaaactttgtgaagctccatacaacaagacactggattggtccaaatggtacatcttctggtctgatgaacgtgctgtggcaaaaaaccatgcagagagtaactataggttaacaaaagaaggattcctcgccaaggtaccgattctgaatgggcatgtctactccataaatg

SEQ ID NO: 69506 - DNA, 349 bp, Zea mays
  Clone ID: LIB3078-032-Q1-K1-F1
gcggaacaccattcctggtatcgaggaggtcaacatcttcaaggacgatgttgttatccagtttgagaaccctaaagtgcaagcatgcattcctgcaaatacatgggtggatagtggagtaccccagacaaaaagtctgcaagaccttctgccatcaattatcaaccaactgggccctgataacctggacaaccttaagaagctggctgagattttccagaggcaggtacctggtgctgaagcagctgcacaggatgatgacgacgtccctgagcttgtccaaggagagacatttgaggaggctgcagagaaggagcctcaactggagcaggatgagaacaaagaatcg

SEQ ID NO: 69507 - DNA, 419 bp, Zea mays
  Clone ID: LIB3078-032-Q1-K1-F10
cggacgcgtgggctggcggcaccattggaggagacacacggcctgcacaggcagcccccactgggatccctgcatcccggcctgcacagcctgcccccgcggtccctgcatcccagcctgcaggaaataacaacgaaaatgggaacccgaatccagaaagttcacgggatcagttcagggagagaaaacgaccatcaggttgggatcgctagtccctgctaactggtatgcccaattgtgattccttccccgctttgttatattgatgtagtctcttgggagacatcctataaaaaagcactgtagattacatgatgtcagggtaagtgttgtttaggtagtttggcctttattctttatccttcaactactggtgtatctggcccggtgttcacatttttcatcagagcaaaatttac

SEQ ID NO: 69508 - DNA, 233 bp, Zea mays
  unsure at all n locations
  Clone ID: LIB3078-032-Q1-K1-F11
ccacgcgtccgcgacactcgacaggctcggtttccgccctcctttcccaccgccgcgcaccgagaagatggngaagcggtggatcccgctggaggccaacccggacgtcctgaaccagttcatatgggggctgggagtccacgaggaggatgtgcagttctgcgacgtctacggccttgacgatgagctgctcgctatggtgccccagcccgttctcgccgtcctcttcctct

SEQ ID NO: 69509 - DNA, 361 bp, Zea mays
  Clone ID: LIB3078-032-Q1-K1-F12
tcgccggaacaaggcggctgcagggagctggtgaactctcgtggggtcgtctgcggcgaccatggcaaccggttccaaggacaagggaggagcagtgccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcagcctgctttctacgaggctttcgggctgacggtggttgaggccatgacctgcggcctgcccacgtttgccacagcctacggcggtccggccgagatcatcgtgcacggcgtgtcttgctaccaca

SEQ ID NO: 69510 - DNA, 368 bp, Zea mays
  Clone ID: LIB3078-032-Q1-K1-F2
gttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggcctggccgacgaccccgaggccttcgccgagctcaaggtgaaggagctcaagaacggccgcctcgccatgttttccatgttcggcttcttcgtccaggccatcgtcaccggcaagggcccgctcgagaacctcgctgaccacatcgctgacccagtcaacaacc

SEQ ID NO: 69511 - DNA, 309 bp, Zea mays
  Clone ID: LIB3078-032-Q1-K1-F3
cccacgcgtccgctctggttccctaaaaggatttcctagtgattgcaaagcagcttcaaagctgagatcttgtgtgccgaaagaacctggtaattgataagagcatccacactgcatatgtccgagcaatcagatctgcacaacatttcatttatattgagaaccagtactttcttggttcttcatatgcttggccatcctatgtgaattcaggtgctgataatctggtaccaatagaattggccctcaaaattgcaagtaagattaaagcgggagaacgctttgcagtgtatgtagtgataccaatgt

SEQ ID NO: 69512 - DNA, 321 bp, Zea mays
  unsure at all n locations
  Clone ID: LIB3078-032-Q1-K1-F4
aatggcaccagaaacgatgctcctcggcgtctgtgccgtgctgatggtggtcggcgtcacgagcgcggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgncgacctccacggcgccgactgtcacgcgcagctccacagcgccgncaataacgcgccttg

SEQ ID NO: 69513 - DNA, 390 bp, Zea mays
  Clone ID: LIB3078-032-Q1-K1-F6
cgcggtttgcctctctgcctgcctccctcagatcctccctaagattgccatggcggaccaggtgaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagttactcaacctgatggcacgcatgatgaaggacacagactctgaagaggagctcaaggaggccttccgcgtgttcgacaaggaccagaacggcttcatctctgctgttaacttcgacatgtcatgaaccaacctaag

SEQ ID NO: 69514 - DNA, 261 bp, Zea mays
  Clone ID: LIB3078-032-Q1-K1-F7
cccacgcgtccggcggcagcttcgaccccctcggcctggccgacgaccccgaggccttcggcgagctcaaggtgaaggagctcaagaacggccgcctcgccatgttttccatgttcggcttcttcgtccaggccatcgtcaccggcaagggcccgctcgagaacctcgctgaccacatcgctgacccagtcaacaacaacgcatgggcctacgccaccaacttcgtccccggcaactaagctcaacggctatgctatgcaa

SEQ ID NO: 69515 - DNA, 361 bp, Zea mays
  Clone ID: LIB3078-032-Q1-K1-F8
cggacgaggaggaaagaggagcagcagggccggaggagagatgttcctgtgggactggtgcggcggggtgctggcctccctcggcctgtggcagaaggaggcgaagatcctcttcctcggcctcgacaacgccggcaagaccacgctgctccacatgctcaaggacgagcggttggtgcagcaccagccgacgcagcacccgacgtcggaggagctcagcatcggcaagatcaagttcaaggccttcgacctcggcggccaccagatcgcgcgccgcgtctggaaggattactacgcaaaggttgatgctggagtatacctggtagatgcgtatgataaggagcgatttgctgaatcaaaa

SEQ ID NO: 69516 - DNA, 360 bp, Zea mays
  Clone ID: LIB3078-032-Q1-K1-G1
cttcagctgtggccttgcttggctactcgttgatcctttcattgctaagggctttcaatgtcggggatgaggctagcagggtgatgtttgcagcccctattttggcattcgttacaacgcacatcttgtatcttaacttctacgagcttgactatggatggaacatgaaagtctgcgtggtgatggctgcggttcaacttctgacgtgggctgtttgggctggtgtaagccggcatccatcacggctgaaactctggacggttgtttttggaggagcactggtcatgcttcttgagctctacgacttccctccatacatggggtttgccgatgcccattcactgtggcatgcaagcacca

SEQ ID NO: 69517 - DNA, 447 bp, Zea mays
  Clone ID: LIB3078-032-Q1-K1-G11
tgcacatatgcactctttctccaaaatttggcatttaatcttattgcaacatacttgtacagaggggcgagggttgttcagtgctttgacatgtgtgcaactattcaagcacaatggttagatgatatccccattcattttagattattacattgtggtgttcggcttcttcagtcaagcagcaatcatgcaacatgccttactgtagttttttatcactgcacatgttgctggacaaatttatggactggaagattatagaagactaacaagtgctactgggagattctcgagcaccattggactaagaaatttcaaatagttctttggagtctattggtgatgtttgccgggataatctaacagaaatttgtcagattttttgtgcaacacggaagctacatgaagcaacaacgatcccattcttctcgcatgccactttacaca

SEQ ID NO: 69518 - DNA, 304 bp, Zea mays
  Clone ID: LIB3078-032-Q1-K1-G12
gcgtcttcattcactcactctcttcgatcactgtactgaagataccatggccaagtcgaccgcgatgttggtagccgacctgaccctggtggtggtgatggccacgacgagcacaggcagtggcacggcggcagcggcgtgcgatcccaagccgctggtggtgtgcgatccgtcgttcatggacagagcgaaaccctcggcaacatgctgatccaccctgcgtgcgcaggacgcatgcttacgcatgtacgccaaagaccccaagtttgcaaaatacatcaacaaccccaacatcgtcaaaacc

SEQ ID NO: 69519 - DNA, 319 bp, Zea mays
  Clone ID: LIB3078-032-Q1-K1-G2
gaaccaacagcacctgtcgcagccccagctccatctactggggtgccaaagaaagcaaagaagtggagtatggaaacaaagctgtagctttttggtactatataagcatgactttggagcacctgaagtattttgctgttctatagtttcgtgtctcaatattctgagtcttgtatctctaccgttctgttggataatgcatgccgtaagagttgtttatggagcttttgttgttacaggacccctaaaaatgtttgtttgacagatgtttggaattgtggtcatgtttatgaaaattagtgttgtgggtcttcgtgtg

SEQ ID NO: 69520 - DNA, 210 bp, Zea mays
  Clone ID: LIB3078-032-Q1-K1-E6
cccacgcgtccggcgcagaccaagccttagctctgcgagctatgtaccatctaataattctggccgtgtcgtaccatggtaactgctaaatagaaaaattgaagaaactaccaaccggccctggcttgtattcacccttgaaccatttttttcttggaaaaaaaaaaaaaaaaaaaaaaaaaaaaaccccggaaaaaaacgcattcaaaa

SEQ ID NO: 69521 - DNA, 267 bp, Zea mays
  Clone ID: LIB3078-035-Q1-K1-F7
ggctcaggaccacatcaatatttacaagtggtgggttcctttcaatctgttccaccaggtagttctcagtcagaattcttcgctgctggcgccgagtgggcccaccaccaggacatcatagttaaattgaatgatatttggcagcaattcatgctgcgcaggatcaagtcaacaggattcaataccatctcatctgcttcttctaactggtgctgctgtctctccttagctctcggctcagaaagaagaacgcagccccagctctat

SEQ ID NO: 69522 - DNA, 440 bp, Zea mays
  Clone ID: LIB3078-035-Q1-K1-F8
cccacgcgtccggccagctgcagcgacggatgcggcaccggcgccggcagagacaccgtcggaggcggcggtggtagaggagaagaaggaagaagagaagaaggaagaggaggataagccggctgccgaagaggcggcgccgccagcagaagcagcagctgctgctgaggagaagtgatcctgttgacggatcgagcatgcaaagctctccctcctcgctcccttgcttgcttgcttgcttgctgctggtaaattaaattaagttgccgtgatacttaagcgtagccgcacggagtgaaaagttattaagtaaaagcagacaaacacttggcatgcatggacattaatttgttattctttgtaccggcgtcgtctcgatgaaccgcgtgtacatttgtagtgtggggttttctttggtttcgatttgggggtggtcatta

SEQ ID NO: 69523 - DNA, 263 bp, Zea mays
  Clone ID: LIB3078-035-Q1-K1-F9
cccacgcgtccgcccacgcgtccggctgaaggagataagggcagccctgagaaaatgcttggatcacatgttaccagaacattgagcaaagtaagttagcataaatataggctaaatagtaccatagtccagttccagtagcagaaaagggaatgaactggatgctcccctggcacatactgaagaatccccaacggcagttaaatccatggagagttttctgaagcaactgcaccagctgtttcttaaggtgtgaaaacact

SEQ ID NO: 69524 - DNA, 399 bp, Zea mays
  Clone ID: LIB3078-035-Q1-K1-G11
gcgcccccgctcgcttcacttctctaggtgcgcaccgatcagaagagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagaagcgcaaggagatccgggagcgtgctgcacagctcgaca

SEQ ID NO: 69525 - DNA, 339 bp, Zea mays
  unsure at all n locations
  Clone ID: LIB3078-035-Q1-K1-G12
gccgccgcggcatacggagaagcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaggtcgactacctgctcggcaggcaggcctacngcggcaagaccgactccgagggcgggttcgagaccggcgccctggccacc

SEQ ID NO: 69526 - DNA, 498 bp, Zea mays
  unsure at all n locations
  Clone ID: LIB3078-035-Q1-K1-G3
cccacgcgtcctgccacgcgtnccggaaccttcaactttttcttcggcttaaaaggggtatggcaaatgtttgaaaagactctgactggaaaaaactataacccttgaggttggagaagctcggacacccatcgacaaatgtgaaaggcgaaagatccagggacaagggaggggcattncccctcggaccaaagcagcgtcttgatctttccgccggcaaaacaagcttggaaggattggccgcacccctagctagactactaacatccaaaagggagaaggcaccctccaccttgtgcctccgtcttccgtggtggtcaagtaagtcattgggtcgtttaaagcttgccgatgttgcctgcgtcgtctgggtgccctctctccatatggaggttgtcaaagtatctgctgttcgtgtcatgagtcgtgtcagtgttggtttaataatggaccggttgtgttgtgtgtgcgtactacccagaactatgacaaatcatg

SEQ ID NO: 69527 - DNA, 355 bp, Zea mays
  Clone ID: LIB3078-035-Q1-K1-G4
cccacgcgtccgcaagtgttcacggtccatcctctcgagagtctaggcccttctcccgaagccgcagacgcagaaaacggctctacatatggaggcgaagaagaagccgtcggcccccgccgccgtcggagccgcgccgccgccgccgggtaacgggtacttcagcaccgtcttctccgcgccgactgcgggaagcgcaagtgacgcaaagcatgcggacttgtacacgatgctgaacaagcagagctccagagggcagaatggcagagatggcaaatcccacagccgccctacttacaaggatggcaaacatgctcatcccaatgagccatcagaatctccttactttggctca

SEQ ID NO: 69528 - DNA, 310 bp, Zea mays
  Clone ID: LIB3078-035-Q1-K1-G6
gagaggacagaggagaggagacacaggcgacacgcgctatttgggagagggaaaggaatggagctgacgtcttcttcccgctccgtgctctcctcctgcaaccggccggtcgctcgagctctttgcaggacggcgtacccgggtgcaaggaggaaggagaagggaatagtatgtatcttgagcgaggagaaagaagtggtacaaaggacgatccggaggcgagctgccttttctttgttgctggcttcgccggtgctatcagtggcgttctcggcctatggaaagagtaaaaccatgaacccttacgatg

SEQ ID NO: 69529 - DNA, 289 bp, Zea mays
  Clone ID: LIB3078-035-Q1-K1-G9
ggctaagaacagggcttcgtctaatggaagtgtaaaacagggcactcagtgctgttcgtcgccatcgtgctcgtcctggtcttgccttgagtccaccaggctgaagctggagcaaatggtgctgcgaaaccgcaccggaaaataccattttaatcgctgcgttgactcggtttggtcgacaaattgggtctggcggtaatgccgttgcatcattaggaagaagattggaggccgtgccgggcctgctcgtgatgcgctttcctgatgtatttgattattatagcagtcg

SEQ ID NO: 69530 - DNA, 147 bp, Zea mays
  Clone ID: LIB3078-035-Q1-K1-H1
ataacactgacgcagaaggaaggctaacactttctgatgctttggtctaagcctgccacccaggggtttgaaagattattggttttgccacccctacccgcccttgccttggcgcactccggccttacctttgcggaatttttacgc

SEQ ID NO: 69531 - DNA, 259 bp, Zea mays
  Clone ID: LIB3078-035-Q1-K1-H11
cttcattcttgaaagttcacacttactgaattggtacgggcatggtcattaggttaagctgatgtgctcctactgcaaacatcatactgagtctgaagttccagatccttattatggaggccctcagggatttgaaaaggtgctggacttattggaagatgcttgcgagtcgctgcttgatagtatcgtcgcaaacaatgcaagcatttctgggtgacatcgatgtaaatctccacatacagacatctattttcagacg

SEQ ID NO: 69532 - DNA, 258 bp, Zea mays
  unsure at all n locations
  Clone ID: LIB3078-035-Q1-K1-H12
cctccctcgagcccgagcaaacatgggcggtctcggagccggcggcggagcggagatggcggagaataagcgaggcgccggcactcgcaaggatgaggtggtgacacgcgagtacactatcaacctccacanacgcctccacggatgcacctttaagaagaaggcaccaaatgccatcaaggagatcaggaagttcgctcagaaggccatgggtactactgatgtccggattgacgtgaaactcaacaagcacaattt

SEQ ID NO: 69533 - DNA, 425 bp, Zea mays
  unsure at all n locations
  Clone ID: LIB3078-035-Q1-K1-H2
cccacgcgtccgaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctacgcttccagagctctgctgtctccgcgctgcangaggcggctgaggcctaccttgtcgggctcttcgaggacaccaacctttgcgccatccacgccaagcgcgttaccatcatgcc

SEQ ID NO: 69534 - DNA, 468 bp, Zea mays
  Clone ID: LIB3078-035-Q1-K1-H3
cccacgcgtccgttcacgcgtccgttctatggcaattgtatgcggtacaacattctacaactgctgaagaatcttagatttcactcaaatggaaaagagatcacagataatgacatattggcatgggccaataagaaagtaaaagattctggaaagcaccactcttatatgcaaagtttcaaggataaaagcctttcaagtggcacctttttccttgacttactaagtgctgtggagcctcgagttgtgaattggagccttgtgaccaaaggggaaaaagacgaagagaagcaaatgaatgcttcatacatcatttctgtggctaggaagcttggttgctccatttttttgttaccagaagatatattggaggtgaaccagaagatgatgctaactctgacagctagcattatgtacttgtatttgaaaaggccaacattacaatcattggactctgaaaactggagt

SEQ ID NO: 69535 - DNA, 100 bp, Zea mays
  Clone ID: LIB3078-035-Q1-K1-H5
gagcccttgaaaaccttgtatgatgctgttcaatccatcaaacctacagttctgatcgggacatctggagttggaaggaacattcacaaaagaaatcatt

SEQ ID NO: 69536 - DNA, 250 bp, Zea mays
  Clone ID: LIB3078-035-Q1-K1-H6
ggaaacctcgaggaggcagcaatggtggatgtttggatcgaggtggaggctaaccagtacgccggtgcactgaatcccatgctcttccaggtcctcatcagtcctatgcttgcgggaaccaccgaccagaaagttgtggattagaaccttgagaagctgaaaaaggtgctagaggtgtacgaggcacgcctgaccaagtgcaagtaccttgctggagacttcctcagcctcgccgacctgaaccatgtgt

SEQ ID NO: 69537 - DNA, 372 bp, Zea mays
  Clone ID: LIB3078-035-Q1-K1-F6
gcgaaattgtgagcttgaaacttgatttgactaatcttgagcagagactatttgacgctgagagattgtcccaacatgctggtgagcacaaagctcaatttgacaaactactgggagaacatgagctccagctacatgaagcacagaaaactattcatcaacttgtatgggagaataagcaactgaaggagttgttgcctgtaagagctcctaaacaatctcctcctggatctggatggaaagttaacaaaacattggagaacggtgtgcatgcagaatgcgaaagtggcgatgtaattcttgaaaatatggcaaaacgaaatgaagaatctgaacttctaattgagcagcttaaggaagagcttcgagaac

SEQ ID NO: 69538 - DNA, 183 bp, Zea mays
  Clone ID: LIB3078-035-Q1-K1-H7
gtcgagacacatatcacatcattatttacgttccaaatatccgtcccaacaccggggagagtgttaatttcatacatcaatatttttacaaatacctctcaattcacacacatacacatctcttaattcaaccaaaacatcatcctttcatacacttacttttttttttttataaccaccaaa

SEQ ID NO: 69539 - DNA, 201 bp, Zea mays
  unsure at all n locations
  Clone ID: LIB3078-035-Q1-K1-H8
ggccgaccgcacccaacgacacaccacanaacacttcatatttgactttaaaaacacacatcccaacacagcggaaatgtaaatattaataaatcaatagccctacaaatacccanccactcacaaacatacacatctcttattttaaccaaaccatcatccattctatcacttactatttatttcttttacatccaccaa

SEQ ID NO: 69540 - DNA, 416 bp, Zea mays
  Clone ID: LIB3078-036-Q1-K1-A10
ggccccctccggcgcccgcgaggtggatgtcggcgaggagtacacgctcgccggcgttctgcgcagcttcgtcgacggcgtctggtacccggacgagccgctgctccggcggctccgggcggcgtcctgcgaggccgcgccgcggctgaagggggcgtctcggaactcagcgcgggatctgctcgagtggacaaggcagggcagcggcctccgcgccatcctcgtcatctcggtcgggacaatcatgcctatagcattgactggccttttaatcttcatgttctttctgctaattgccactgctaatgcgatcatcgtctcagccctgatgtcactggccgctgctggcggattcttggctatcttctttgcttgcttggttgcagtgtatattggagcaataggagttgctatct

SEQ ID NO: 69541 - DNA, 54 bp, Zea mays
  Clone ID: LIB3078-035-Q1-K1-D3
gccatgagtgcacattatttggggtcattcttttgacataaaaggggggggggg

SEQ ID NO: 69542 - DNA, 282 bp, Zea mays
  unsure at all n locations
  Clone ID: LIB3078-035-Q1-K1-D5
gccgacccacgcgtccgctcggaccaggcagagcgccatctttcgggtccctngctgaattcccgatcgctcgctctgtcgaatttaaagaagctagcttctaccattacgtctctggcgttcggcagcaccgtagctgctgcccttgcatcttctttatttagttatcttttttcttttcttttttttattatctatttcttttattttcttttttttatttttatttattttttctttttatttctttttttttatctttctattttattatcttttctt

SEQ ID NO: 69543 - DNA, 404 bp, Zea mays
  Clone ID: LIB3078-035-Q1-K1-D7
gtcgaagcgaggcaggggaggttcggcggttaacaagttacgcatgacgctggggctgcgggtgacttttacggtgaactgcagcttacaacactctccctcactaaaacttacaacatttcttcatgatcataaactccaccaccaactccttctccacaatcttagtctgcaacttggtctacacagaacctaaaaacaacaaattttaatgatgaatcaatgcaaatgtgcactgaagctaatcaacataagtccatcaaaccatccactaacgttgaattcacaaattgtatagccacttccttgaccagaaagttttgtataagagctgattttgcatgggttgtcttttttgcatttggtgtaattttaaaaaaattaaaaatttgcttgatgtgttt

SEQ ID NO: 69544 - DNA, 461 bp, Zea mays
  unsure at all n locations
  Clone ID: LIB3078-035-Q1-K1-E10
gaaagtggatgctttggatgctatcaagagatacaatggtgttctacttgatgggaagccgatgaatgtagagctcattggaaacaatgtcnaaccacctcccttgccaccattaatacacaatcgtcctttgcagaactataacgatatccacagcagtgtgcttcaatcccaaagaaatggtcagcgaagagcacctcaagtcaacggtcggggtggacgcagtagtcaaaccagcggtggccgcggacaggggagaggccgagtgcaggaccggaaccgcacacccatttctgcttcagaccttgacgccgaactcgacaagtaccatgcagcggcagcgaaggaagaatgaggctctggcgttctcttctactaatctaattacacaggtggaaaggcgttcttttctgggggcggtcagaagcatggagtttactatcttagccctagtgttctac

SEQ ID NO: 69545 - DNA, 387 bp, Zea mays
  unsure at all n locations
  Clone ID: LIB3078-035-Q1-K1-E11
cccacgcgtccgcccacgcgtccgacgagttcgagggtgaggagtccatctttcgcaggtgtgcggcgggaggtgatgcgcgccggcgtgcttcangagatcaagcgccgccggaggtacgagagcaagacagacgagaagaagcgcaaggcgcgcgaggccggacgccgtaaccgtcgcatgcgtatgatggacgagccgaggttcccagaagaagactcctactcgacctttaaggttcgtgactaggacaacgacaactgtgaggataacaacattcttcatatttctttttttatattttttatttccttctattcaaattgtttaatgttcaatttttaacttttatatccattattctttaatattttatttttttattta

SEQ ID NO: 69546 - DNA, 353 bp, Zea mays
  Clone ID: LIB3078-035-Q1-K1-E2
ccactcgttcgtcaccctcgctcagctatctacaagaccccgggtcaaggagcattgccatctactaaagtgggtaactgtgtcagatgattttagtgttcttaatcttgccaacaagatatgtaatgcctcagagagagtcctcgaggatgcagtgaagaagcttcaggaacatcttaaaggaaagaggtattgctggagcttattagctattactaactctactttcttgcatgcctactatgatgtttgtaagttattgtctactaaatcctcaatacgtcgtgtcatatcgtgtgttcctaatggacttgtttgctaatatttagtacaagttcatgtgtgtgtgctgt

SEQ ID NO: 69547 - DNA, 351 bp, Zea mays
  Clone ID: LIB3078-035-Q1-K1-E4
aaacttcttccacggccgattccccccttcctgccccggatcatgttctttttcctctgtccttcttatgttgtatcctttctttaatttttatcttttattttttatttttttctatcttttgtatttttttcttttttaatattctttttcttatattattattttttattaatattttattttatgctatttttatttattttttttttattttttatattattattttttttatcattattttatttttttaatttattatattattatatttattattattttttatattatatttatttttttattttttttcatttttattttttttttttttttttattatta

SEQ ID NO: 69548 - DNA, 241 bp, Zea mays
  Clone ID: LIB3078-035-Q1-K1-E5
gcctggttggaaggacatttttcgaatgaatcagagtgagctcgaggctgagatgtgaagaggtctctcgagattctactcttgatccaaggaggaaggcctatctgatccaaaatctcatgaccagccgttggatagttgctcagcaataatcaccacaaccaagcgtcgaaggacataatggatgtacacgatgacctggatgtgttccttcgtaccgagacccatggaaacaaatatt

SEQ ID NO: 69549 - DNA, 240 bp, Zea mays
  Clone ID: LIB3078-035-Q1-K1-E8
cccacacgtccgaacacttccaatctaacattaccttatacaaccacaaaaagggggacctgagttcatttccatctacccgatcctttaatcaaccaaaaaaagaggcattcttcatatttcccttcgctctacatatttcatgcttactatacctttcatactatctgctacttcttatataatctcacctaaattcactttacctgcccttctttaatatctttctgactggcaaaa

SEQ ID NO: 69550 - DNA, 299 bp, Zea mays
  unsure at all n locations
  Clone ID: LIB3078-035-Q1-K1-E9
gcccacgctcgccacgcgtcgaaagatcaagtattcccggagccgagggatacttggacaccaaagatgcctgcgantcctgccaagctagcctagatgagctatagatggttaacgatgccacgtattcggacttggtttgtcatatggccgcaatgttccgtttttgttatatattcaagtttttacatgtcatttgtgcagtttactttttatttattttttatataatattgtttttctattttttttttttatttatttttttatcttattttttttattttattttttttgtt

SEQ ID NO: 69551 - DNA, 425 bp, Zea mays
  unsure at all n locations
  Clone ID: LIB3078-035-Q1-K1-F1
gcccacgcgtcgcagccaaagatggagatcaacttaacaaatgcggatgtgggagatctgaggatacagatctcgctgtcatggacatgcgacaggaattccataacgatctggatcatgactgnatatttggctcgttacctgaaaactacatagcttttctatacttgacgatgtcttaaatgccatcgactgtcaggcagatctgcttatgtgctgatgcgttcttgcatgcaatgccaggaaattgcttcatcaatatcgctaaagagcattgtcaactacggaccaatattgtgttctggcactaggatgttttgaggatgttatgtttgaagaaacttgagacttttttttttcatctaattaattatcagacgtaatttgtggtactaaaaatacttttttataaattgttttgaacc

SEQ ID NO: 69552 - DNA, 388 bp, Zea mays
  Clone ID: LIB3078-035-Q1-K1-F10
cacgcgcgcctcggcaaaccctccgcctcctcgcccatcctcccctccatcccggcccagccgcagggccatggactctgctgccggcgcaggccgccaccgcgttcgaatcgcagtcgtcggcgacgtgcacaatgattgggcccttgaggaagattcaaaggcgcttcgatttcttcagccggatttagtgctttttacaggcgattatggaaatgagaatgttgaacttgtcagaagcatttcagatcttcagttaccaaaggcggcaattcttggcaatcatgattgctggcacacacatcaattctcagagaagaaggtcgatcggtgtcggcttcagctcgcaagccttggtgagcagcatgttggatacaaatgtttggac

SEQ ID NO: 69553 - DNA, 296 bp, Zea mays
  Clone ID: LIB3078-035-Q1-K1-F11
caacttctgacaacacgaggtctaggccttgcctcgccagatgctgaatcatgggagggttctgtcagtccaagctctccgcattaagtgcccaagccattcttcgtgtgacctctactactacaaaagagtgcgtcacctctgccccaaaagaagggttggctgtgggttgctagcacaagccacaggggagatattgcgatttttcaccctgttcgctgttttgctgtacatgcttttggtttgtcctgcggtgcacccagtcgtgaaaaggttaatcattgatttcaggagtc

SEQ ID NO: 69554 - DNA, 284 bp, Zea mays
  Clone ID: LIB3078-035-Q1-K1-F12
gactttgttggccaaggcaattgccaatgaatgccaagctaacttcattagtgtgaaggtcctgaactgcttaccatgtggtttggtgagagtgaggccaatgtcggagatttttgacaaggctaggcagctgctccatgtgtctcttttgatgagctcgactcattgctactaaaggaagcaggtggtgacccggggtctctgatgggtgtgaacactcttactgagatggatggctgatgccagaaacgtttatatcgggcactaaaccgacatatgaccac

SEQ ID NO: 69555 - DNA, 342 bp, Zea mays
  Clone ID: LIB3078-035-Q1-K1-F2
cccacgcgtccgcccacgcgtccgctcgtttagaacctctaaaatttcccccactcgccagtcgcaggagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggctaaagacaacaag

SEQ ID NO: 69556 - DNA, 373 bp, Zea mays
  unsure at all n locations
  Clone ID: LIB3078-035-Q1-K1-F4
cccacgcgtccggttgaaaggaaggacttcaactcatatggtagccgaagaggaaatgatgagatcatggctaggggaacctttgccaacattcgtcttgtgaataagttcttgaagggtgaggttggacccaagacaatccatgttccatctggggagaagcttgcagtttttgatgctgctatgaaatacaagaatgaagggcatgacactattatcctggctggtgccgagtacgggagtggaagctctcgggattgggctgcaaagggcccaatgctgcagggagtgaaggctgtgatagcaaagagcttcgagaggattcaccgcancaatcttgctggcatgggaatcatccctctatgctacaaag

SEQ ID NO: 69557 - DNA, 274 bp, Zea mays
  Clone ID: LIB3078-035-Q1-K1-F5
gtacgcgtcccgttcataggaaggactttttctaagtctgtaaccgaagaggaaatgatgggatcgtggctattggaacctttctcaacattcttcttgtgaataacttctcgaatggtgaggtttgacccaagacaattcatgttccatctactgtgacgcttgcaactattgatcttgctatgaaactcaccaattaagtgcatgtcactattatcttatctggtactctgtacttatgtgctagctcccgtgattgcgctgcaatgccccc

SEQ ID NO: 69558 - DNA, 405 bp, Zea mays
  unsure at all n locations
  Clone ID: LIB3078-035-Q1-K1-A2
ccgaggtcgcgnagaacgatcacagccatctggttctcaaagaggatgacgttataggtagcttagagactgatgacgtgaaagacatgaagcctctgaacgaccgtgttctaatcaaggttgctgaagctgaagacaaaactccaggaggcctactgcttacggaaactgccaaggagaagccatctatcggaacgtgtgtagcggatggcccaggctccctggaactggactgcactgagttcgagacgaaacttgccctattagtgttgtgcatgatcatgacccaacctgtaaggggtttttgatatcgatttggtcccatggcctaatcctttacatcttcgaaagccttaatgtgaacatatggtttactttcagaatcccttcgtgtgtccttttttt

SEQ ID NO: 69559 - DNA, 356 bp, Zea mays
  Clone ID: LIB3078-035-Q1-K1-A3
ctggattatggctgtctccgattcttgccatcagtagttgctgcttcagttatgttcgttgctaggcgtgaccattgatccaaatgccaatccttgggtaaggaaccgaaggatcttattgatgcatgcaaaggactgccctgtttctcaaagttcatttatcctgcatttttatatataattattatagaacatgaagctgcagaagacgacaggctacaaagtttctgaactcaaggattgcatcgtaaccatacgtgacttgcagctcaacaggaaatttccatcattaatggcaattcgagacaagtacaagcaacacaagttcaaatgtgtgtcaacgcttcttccccctg

SEQ ID NO: 69560 - DNA, 384 bp, Zea mays
  unsure at all n locations
  Clone ID: LIB3078-035-Q1-K1-A4
cccacgcgtccgaagatctgcaaaaattgttttggaaattaaccatggcaacaaggggccaactcggggtggggtgaccctattaaaaccaatcgcggagcaaattcagttggaaaatgaaaaggatgctgatgagattacaaaacanatagtgtgcatgttaaatcttgttcaactggtgctataccgctgcatcgagttggtggaggaaaagatgaaaggctgctaatgtttttggtacctgtcatttctatacagtagcatctgctgtatctggatggaatgttcttgaggatataaattccatcttctcaggttattgtatatttacattgccaggaagtctggtttatttaaaaataaataaaaaaggtcggtcgtttt

SEQ ID NO: 69561 - DNA, 122 bp, Zea mays
  Clone ID: LIB3078-035-Q1-K1-A6
tccgtcgaccacgcgtccgttagacctacaatggtgagtctgtaccaggtctgccttctcgggtggctataccgcaccaatccggcgacagctgactcgatcaaggtatggaacaagccggt

SEQ ID NO: 69562 - DNA, 187 bp, Zea mays
  Clone ID: LIB3078-035-Q1-K1-B1
cccacgcgtccgcttcgacctccccttgaaggagcggttctacctgcaaccgctgccgccggcgaaggcgtccttcagggagtagacaataaccctagatccggggattcccaatataggtcaacctttcgaactgctgctgaatccacggactgacatataaaaaataaataaataaaaaaacaaa

SEQ ID NO: 69563 - DNA, 477 bp, Zea mays
  unsure at all n locations
  Clone ID: LIB3078-035-Q1-K1-B11
cgacttctacggctgctgtgagtcttctccgccccaggccggcagttccagccaagagaggtgcctccatgcggttgctgggtggacgacgatgaggaggaggggagctgcaggggtcgtgcgagctttcttcaaccctctcggggatgagcgcatcctccgagaagccattaaggagccagtagcattcatgggtggtgtgtttgttgttcttttgagttttgtcttttatgtgtattttcttttggtttgtttattttcttacattgtatgtttttatatattttttattttataattttgtgttattgtgtgtgtataatttatttttatatttttattttttaatantatttttttttatcttattattttttctttattattttttattataattatgtattattattattattttataatttttttatatttttatttttttataattataattattttatttttttatta

SEQ ID NO: 69564 - DNA, 367 bp, Zea mays
  unsure at all n locations
  Clone ID: LIB3078-035-Q1-K1-B12
tggagattcagagttgactgcagtcattattaaggatatcacggctttaattctgctggggtagacctacaagctctctgcaattcacaaaatgagagngcagtctctccaaggacacatcaaatcattccactacagtcgtggacaacctaaaaaatcgtctgatgagtgcaacaaaagaatttaaagaagttcttaccatgcgaacagagaatttgaaggttcatgaaaatagaaggcaaatgttctcttcgtcagctgcaaaggacgcgtcaaatccattcatccgtcaacgaccccttgttgctagggatccatcagagtcatctgtgcccccagcaccatgggccagctactttgcatctac

SEQ ID NO: 69565 - DNA, 240 bp, Zea mays
  Clone ID: LIB3078-035-Q1-K1-B2
cccacgtgctcgtctctctgccgccctccctttcgccttcccactcgtttcaggcgggtacgggacctgggcggcgacttcaatctcgtccgcgggaaggttgagacggcgggggctggaggtggtgtgcgaggccacgaccggtcggcggccggactcggttaagaagagggagcgccagaacgacaagcaccgcatccgcattcacgcgcgcaaggccgagatgcgcactaggatgaa

SEQ ID NO: 69566 - DNA, 394 bp, Zea mays
  Clone ID: LIB3078-035-Q1-K1-B8
cggacgcgtgggggacatacatggtgtgcattcagaagtcttcgctgatgataattcaagctgggactccatggtgcgaaactactggtctttgctatccccacttatattttcagaccatccaaagagacctggtgatgaagacccacagccaccatttaacatgctaaggaacgttttagatatgaatgctcactttggtggatttaatgctgctttactgaagtctggaaagtctgtatgggtgatgaatgttgttcctacaaatgccccaaattatctaccactaatatttgaccgtggttttattggggttcaacatgattggtgtgacgcatttgcaacttacccaagaacatatgatatggtgcatgctgatggctttctatcactt

SEQ ID NO: 69567 - DNA, 388 bp, Zea mays
  Clone ID: LIB3078-035-Q1-K1-C1
cggacgcgtggggtaatggttctgaccagacttcgggtgatgccaaaaggttggctgaaaaggattttgaatttgtaaggcacgttgaaccactttcaagggaggtggttgtcactaatccaatagggccaagaccaagatcgtgttctcgcaagttaacagcacttgtactaactagttcatgggttgtactatttgctacagagatgcacataccgcataaccgtcgacaaacaatgccccaacccaacctgaagtgcaggctgtaaataatgcgcctccttcaaaagcatctcctcctactaaaacaatagaccctaacaaggctgctggtataaacagtcattttactgatggccagaacaccggctactttattacggaccga

SEQ ID NO: 69568 - DNA, 171 bp, Zea mays
  Clone ID: LIB3078-035-Q1-K1-C10
gcaaaacatctctaatacacccaatgcaaatacacacgcagtgatagccatggctcgtggcggatctggttgccgtcttctcgtcctgctcctagtcttgactgccttcaatggcagctttgcagctcgacatctcttggacacagcaactgcgccagaggccacgcctgc

SEQ ID NO: 69569 - DNA, 251 bp, Zea mays
  Clone ID: LIB3078-035-Q1-K1-C2
ccagatctgctccatcctcaccccacataagccagctcaagagcatggttcgtcaagttagcagtgctggtgctcaaagttccttgggttatctcttttgcaatcaataggcccctgccacaaaaccgtcaacaaacaatgccccagcccaacctgaattgcaccctgtaaaacaatacgcccttcttcaaaaaccatttcctactactaaaacaaatagacccctaacaaagccttcccgtaataaaaca

SEQ ID NO: 69570 - DNA, 244 bp, Zea mays
  Clone ID: LIB3078-035-Q1-K1-C3
atttgatttcttgtctgagcagaaaaaggagttcccactatctaaaaaatggttcaatgtggggccagggggttgttgcttaatggccacatcccaacatggccactggctgtgggtggccacaacggttatccagggggcaaggtgttcgtttctgctgaacagttaggtcatggagattactctgcctcacgcacataagtatttcgcatggtgtatactcttggagtcaacaatgaatcca

SEQ ID NO: 69571 - DNA, 490 bp, Zea mays
  unsure at all n locations
  Clone ID: LIB3078-035-Q1-K1-A12
gcgctcctctccgcttccaagatgtcttatcgaggacgtggaggttctgctggtaacgagttccgtatgtcactggttctaccaatcccaaccactgtnaactgngctgataacacatgagccaagaacctttacatcatttctgtgatgggaatcaaggggcgctctatacagtcttatttttgtctttgtttgttacattgttatagtatcttttataatatgtaattttttctcttttttatatagttacttctctctttcttattttttttatcatactataatttttttctactcttttataattttattactatttattgttgtttgttgtattatttctatactatttttatttatttcttcttattcataataattattatttattttattattcatttttatactattttattcatcttcatctttatttctttataataatttttattgttatatatattctttaattatattatattat

SEQ ID NO: 69572 - DNA, 66 bp, Zea mays
  unsure at all n locations
  Clone ID: LIB3078-035-Q1-K1-C6
cgcccacgcgnccgcccacgcgtccgcccacgctaccgctcacgcgtccgcccacgcctccgggga

SEQ ID NO: 69573 - DNA, 319 bp, Zea mays
  Clone ID: LIB3078-035-Q1-K1-C7
ggcggtacatgcaattctgaaggacctgtttgaggctatcaatgaaacacatgagctgaagcagttcacccttcgtgtggaagtaggcatgcacttttgagtcattggatagaatgagggatgaaagcagaaaatacataaagctagttgacatggaatgcactcttgacagtgattcttcaggaagcttcccaggatgttgagaggggggaatcaagccactctatttgatagattaatgactctatcttaacaatggcaactgtctgcatagtaatatgggtgtcgacttgagaactcatcaaaattattgttattg

SEQ ID NO: 69574 - DNA, 319 bp, Zea mays
  Clone ID: LIB3078-035-Q1-K1-C8
gggctactttgggcctttgcagaagccaattatatcagattcattttattggtgatctctgcaatcttctgtggttatgtttaccagtgtcctccattccgattaagctaccaaggactaggcgagccgttgtgtttcgctgcatttggtcctttggcaaccacagccttttacttctcaaacagcagcttaaatacttcgagcggaggagcggctcttctccctctcactaaaacaggtatagcttcatctgttctcgtcgggctgacaactactctgatactcttctgcagccatatccatcagatcgatggagatc

SEQ ID NO: 69575 - DNA, 67 bp, Zea mays
  unsure at all n locations
  Clone ID: LIB3078-035-Q1-K1-D10
gcaaccaccgcagacggcgagaggactacaggacaaggcagnngcgggccgggggggtaaaaacgca

SEQ ID NO: 69576 - DNA, 363 bp, Zea mays
  Clone ID: LIB3078-035-Q1-K1-D12
gccagttgcagcaatggatgctattgctaaaatcgtctaagttgcaccaatcagggtttatgaagttgcaaccttttataccatgtttaacaggactaaggttggtaaataccaccttctggtgtgtggaactacaccttgtatgattcgtggttcacgtgaaatcgaagagacgttgttggagcaccttggagttaaacgaaatgaggtgaccagtgatggtttattttctgttggagaaatggagtgcatgggttgctgtgtgaatgctcctatgattgctgtggctgactactcgaaaggctcatagggttacacatataactactatgaggacctcacttcaaaactagttgttgagat

SEQ ID NO: 69577 - DNA, 419 bp, Zea mays
  Clone ID: LIB3078-034-Q1-K1-B12
cccacgcgtccgcggacgcgtgggcgtccctgcccgctgacaagcatcctgagcgtcggctgaagtcgacctttaaggcatttgaagaggcagagctccctaagctgaaggaagaaaagccaggtctaacgctgcaccaatacaaagacatgatatggaaactgtggaagaagtccccagacaaccctcttaaccaggctgctgactgaattttgcaaccctactgaatcttatgtaaaggccaaccttcaaacagcactggattggtgaattgtgttggtacctttttcttggagtggatgcgcaccaaaccttgaatcagaaaggtgttccagtctcggctaataatttccaaatcactggagtgtatactgtgggaggtgctcttgtttagactcgactagtcgagtttcctttct

SEQ ID NO: 69578 - DNA, 402 bp, Zea mays
  unsure at all n locations
  Clone ID: LIB3078-034-Q1-K1-B2
ctctgtatcgactcgtcattactttggctttggtgctcttgtatctgaggaactttcttacaaactgaaagaaattcccaaggtccgctgggttcttcctgattcatacttggatgtcaaaaacaaggactatggaggcgaacccttcataaatgggcaagctgttccttatgatcctaaatatcatgaagagtgggtgagaaacaatgcccgtgccaatgacagaaaccggcgcaatgataggcctcgcaactttgacaggtcaaggaactttgacaggagaagggagaacatgcaaaactaccagaacagagatgggcctnctgcccaaggtttcaatggcccnccaccttcacctggccagaaccagatgccatcccaccatagtcagggcaacatgtc

SEQ ID NO: 69579 - DNA, 428 bp, Zea mays
  Clone ID: LIB3078-034-Q1-K1-B3
cccacgcgtccgcccacgcgtccgcccacgcgtccgcggacgcgtgggttcgccggcgagcagctcgaggacggccgcaccctcgccgactacaacatccagaaggagtccaccctccacctggtgctccgcctccgaggtggcgccaagaagcgcaagaagaagacgtacaccaagcccaagaagatcaagcacaagcacaagaaggtaaagctcgcagtgctgcagttctacaaggtggacgacgccaccggcaaggtgacccgcctccgcaaggagtgccccaacaccgagtgcggtgcgggtgtcttcatggccaaccacttcgaccgccactactgcggcaagtgcggcctcacctacgtctacaatcagaaggcgtaatcccatgcgccgctttgcttcacccgcctacctatcaagcattc

SEQ ID NO: 69580 - DNA, 388 bp, Zea mays
  Clone ID: LIB3078-034-Q1-K1-B4
atagaccacagccagtcagccacatcactagctatctgtgcagaggcaatggcgtgcagaggttgagctggtggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaaggcggagggcgagggc

SEQ ID NO: 69581 - DNA, 347 bp, Zea mays
  Clone ID: LIB3078-034-Q1-K1-B5
cccacgcgtccgttttccatagtaatgaaaatgctcttggctcgacatagtctgttctattcgtcccgaaccgaattttcgctgggttgtttgtaagtaaagtaaatagtacacgatggagctcgagaggacagaatttctttttgatcaagggaaagaatctagggttagtgaaaactaataaattaggccaactttgtcagtctatccttaatatagaaatcaaaaggttaaaataagaaaaagtctaattttggaagattggaaaaacttttttgatgaaaagtctatctgaatcaattgttcatatttgatttctatagaagagtgaaatgctttatcgaagg

SEQ ID NO: 69582 - DNA, 410 bp, Zea mays
  Clone ID: LIB3078-034-Q1-K1-B8
cgtgtccgaggcagccatcgagacctcatatctggtgctggagtccgccatggccgagctcatgaaccacaggcccgtcatgaagaagctgcaagcggaggtacgggcgtacggagcggagaagaagctggacatgatcagggaggacgacctgagcagcctgccgtacctaaaggcgtccatgaaggaggcgctgcggctgcacccaccggggcccctgctgctgccgcactactccaccgccgactgccagatcgacgggtaccacatccccgccaacacgcgcgtcctcgtgaacggctgggccatcggcagagacccggcggtctgggagaagcccgaggagttcatgccggagaggttcatgcgcgacggctgggacaagtccaacagctacagcggccaggact

SEQ ID NO: 69583 - DNA, 424 bp, Zea mays
  Clone ID: LIB3078-034-Q1-K1-B9
ctactccgcccatctcaaacgctccggcaagatggagcttcctgagtgggttgacattgtgaagactgcgaggttcaaggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccatttcacgcaacatcctccagcagctgcaggagatgggcatcattgatgtcgatcccaagggtggacggcgcatcacctcccagggaaggcgtgatctggaccaggtggctggaagggttgctgttgaagcttgagcaatctcatatttggtttctatgatgtcatgtttgattgttgag

SEQ ID NO: 69584 - DNA, 426 bp, Zea mays
  Clone ID: LIB3078-034-Q1-K1-C11
cggacgcgtgggggcggtggcgcctcagggcctgccgcccctcggccgccgcgcctggtccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcgtgtaaaatcagggtgtctgtctat

SEQ ID NO: 69585 - DNA, 276 bp, Zea mays
  Clone ID: LIB3078-034-Q1-K1-C12
ctccacctagctccccggcgcccaggaccacgccggctagcaggcgcgctcgatcgaagaccgttcccgtgtcgccatggccgccaccgcgtctctatcagccgtcgcggcgccgctgtcggtgcccgggctcaggaagccgctcggcgcgtcgtcgctccggcccctgcagccgatggcggcgaggatgacgacgacggccgtgccggcgtcggcgtcgccctcgtccacgtccatcaaggagaaggctgcggccgggctgaccgcggcggccct

SEQ ID NO: 69586 - DNA, 394 bp, Zea mays
  Clone ID: LIB3078-034-Q1-K1-C2
cgccagtccaaccaagtcagcacccgcgcgcggcaaggagttcacgcccatggcgagcaccaacatggcgtcggccacctcgcggttcatgctggccgcgggcgtgcccactgccagtagcggcagcggccgtgtcagcttcgcctcggcgcccaaccggcttggcaggaggcttgtggtccgggccgatgaggagtccccggcagagccggcgcccacggcggaaggggagggcgccgtggccaccaagcccaaggccgagaagccgccgccgatcgggcccaagaggggcgccaaggtgaagatcctgaggcgggagtcctactggtacaacgggatcggcaacgtcgtcaccgtcgatcaggatcctaacacccgttacccggtggtggtg

SEQ ID NO: 69587 - DNA, 417 bp, Zea mays
  Clone ID: LIB3078-034-Q1-K1-C3
actgtgcagtgcctcaaaggtcgtcggttggttctcaagggacttcaacgacgggacgacccgttcagtgacgtataacacggaagctgacctgaatcctgctggtgccgctggtacacgagcccacacgatcgacgtctcaggttttgcgttcaatagctctattttgtgggatcctgagcggtggggacggccaacgtcattaccagacacttcacaggactcgatcaagttcgtgcaagaagtgctacttgaagaccgagctaagctgaaggggatcccctccgactgctcccagatcatggtgtggcagtacagcgtgcccagctcgcgatagagggcagccgagaggacgcacaagaggcgtcgcaacctcgcaggcaggggaagaactgcagggggttggatcggagtcgc

SEQ ID NO: 69588 - DNA, 409 bp, Zea mays
  Clone ID: LIB3078-034-Q1-K1-C4
cccacgcgtccgaattaagcccattactgttagcttcaaagagggtcttggtcaaaaattcaggcaaccttcaggaacaggaattgacttttcagtgtttgaagaatcagatttattaaagcagggggacatggatgtatatccacttgcagttaaagctgaaacaacattgtctgttgatcacccaccagaaggggatgaccaaaagatgataactcctaactcacagatcacccaggccgtttttgaaaagaaagaaaatggggattatcaagtaagagttgtttgccagatcctctgggtcaatggaactaggtatgaactgcaagaaatatatggcatagggaactccatggaaggtgatgctgatgcaaatgatccagggaaagaatgtgttatttgcctctca

SEQ ID NO: 69589 - DNA, 276 bp, Zea mays
  Clone ID: LIB3078-034-Q1-K1-C5
tcggcctagctgtacttgttagcctttcagaatgtcggcggtcgatgatgcgaggaggaacgtgtaccacgacactcgtccttgcgctagttaccatcatcgccatccccatggccaagggggacgacgagaagtgtggcgagtgctctgcgtgcggcagctcttactgcccagcgctatacccgtcgccggccccggcgacgtactaatactagagacgtccctcaaacgtgacctaccccaaggagtacttgtgatactaccagccctcatagt

SEQ ID NO: 69590 - DNA, 418 bp, Zea mays
  Clone ID: LIB3078-034-Q1-K1-C7
gtggcggtggggccaagaaaatgatagaagacagagctgcggaaaacatagatgccatttttgggcttcatatagctgactctgtgcctattggtgtgctggcatccaggccagggcctattatggctgggagtggattctttgaggccgtaataagtggaaagggaggacatgctgcacttcctcatcacactatagatccgatattggctgcctcaaatgttattgtgagccttcagcaacttgtttctcgagaagctgatcccttggactcacaggttgtgacagttggaaagtttcaaggaggtggagccttcaatgtgatccctgattcggtaactataggtggcaccttccgagcctttctgaaagagagttttaatcaattgaagcaacggattgaagaggtgattgtgtc

SEQ ID NO: 69591 - DNA, 413 bp, Zea mays
  Clone ID: LIB3078-034-Q1-K1-C8
ggactttcatcggcggaagcttcaggttcttgctgaagcaggcccggatttgattgcggttgaaacgatccccaacaaattggaagctcaggcatatgttgaactccttgaggaatgtaacattaatatcccttcatggctttccttcaactcaaaagatggagtgcatgttgtgagtggtgattcgttaattgaatgcgctactattgctgacaagtgtgcaaaggttggtgcagtcgggataaattgcacacctccaagatttattcatggactgatactctccattcgaaaggtcacagacaagcctattctgatatatcccaacagtggtgaaagatatgatggtgaaaaaaaggagtgggtggaatccactggtgtgtcagatggtgattttgtttcgtacgtaaatg

SEQ ID NO: 69592 - DNA, 427 bp, Zea mays
  Clone ID: LIB3078-034-Q1-K1-B11
catctatggtggccatgttgctgactacatgaagaaccttgctgaagaggagccagagaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttggtttaaagttttgc

SEQ ID NO: 69593 - DNA, 448 bp, Zea mays
  Clone ID: LIB3078-033-Q1-K1-H9
cggcgcccgacatcaagtccatgcagatccaccacgaggcgcgccaccccaagctcccgggcgagccggagaagctcctcaacctgcactcctccgcccccgctgctgccgccgccgccgccgctgccgccgccgctgccgaggccaccacctccaagcccaagcccggcgtccgcggcagcctcaagaagtaagcttgctgggcttggttggctcgcccgcctgcatggggcgcaattcccttcggtttcaatcccatccgccgacccgatctataatcaatcaaaccgccgccctccggcctggcggctgccgcagtcggcctgcggtgtactgttagtctgctgctgatttccgttgttatactgctggtacatgtgtcgtgtgatagatgtgtcaactatatatcaatctcgtcgccggcagctctggcatgtttgagtatgtg

SEQ ID NO: 69594 - DNA, 423 bp, Zea mays
  Clone ID: LIB3078-034-Q1-K1-A1
gcacgttcgaggtggcgcagaaggtgtgggccgaaaccttctacgccatggcggagagcaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcatgacgcgctgctgctgcgcgccaaggccaactccctggcgcagctcggcaagtaca

SEQ ID NO: 69595 - DNA, 309 bp, Zea mays
  Clone ID: LIB3078-034-Q1-K1-A10
cagaactaacagttctgagatcgagctgcacaaggaaggaaagaaggagacacacaatcgtcgcctgcttaaccagagcgacaatgcccaagctcaggctcatcttcaccgttattcttgtggtgtctctactgttcagtggtgtgtcttcaggacaaactgcagctacacaagccagcgatgcagatctttctgaagcggttgaggttgagagacgcagtgggaaagttctgacgtacgttcaagactacgactacggcgggtccaaccccaaacatgacccacgcaggaagccaaggagcggacacc

SEQ ID NO: 69596 - DNA, 415 bp, Zea mays
  Clone ID: LIB3078-034-Q1-K1-A11
cggacgcttggccccgcccatggccgggccctacagtttttggaaggccgccaacggcgtcgttttaaattcctacttctggtgggtcgccggggacaaattccaaatcctgaggggcgccgacaacaacccgagcaaggacatcgtggagatgaagtcggaggaggcctaccggctggtgctgcaccaggtggtccggtggctggagcgcaacgtggaccccggcaagtcacgggtgttcttcgtcaccgcttcgccgacgcacacggacggcagagcgtggggcgacgacgacgcggagggcagcagcaactgctacaaccagacgtcgccgatcagcgccgcctcgtcctaccgtggcggcacgagccgggagatgctgcgcgcaacggaggaagtgctggccacgtcgcgg

SEQ ID NO: 69597 - DNA, 424 bp, Zea mays
  Clone ID: LIB3078-034-Q1-K1-A12
cccacgcgtccgcccacgcgtccgctaatagcctgctggttgataaccgtgaaagagaatctgggagcatgtacactgattgggatattctccctcctcgtaaaattaaggatgttcacgccaaaaggcctaaggattgggatgacagagaatatattgaagatcctgatgaagttaagccagagggctatgattctatcccaaaacagattcctgatccgaaggacaaaaagcctgacacatgggatgaagatgaggatggaatatggaagcccagaatggtatcaaatccagcatacaagggaccttggaaacgcaagagaattaaaaatcctaactacaagggtaaatggaagaccccatggatcgataatccagagtttgaggatgatccagatctttatgtgctgaagcctttgaagta

SEQ ID NO: 69598 - DNA, 409 bp, Zea mays
  unsure at all n locations
  Clone ID: LIB3078-034-Q1-K1-A2
cggacgcgtgggccggagcgcacgtcagatcaggtgcgccgcgcccccctcgcctaaggtgcgacgaccatccatcgaacaggaaggatgacgggctccatggatctcccggccaagggcgggttcagcttcgacctgtgccgccggaacaacatgctggagaagaacgggctcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctgtggagcaggaactgctgcggacacggaggccgttacagatatggtgagctcccagctacagcttcaccgntatgcaa

SEQ ID NO: 69599 - DNA, 394 bp, Zea mays
  unsure at all n locations
  Clone ID: LIB3078-034-Q1-K1-A3
cgccgccaccatgtcgctgatcgccggtgaggacttccagcatatcctgcgtttgctgaacaccaacgtggatgggaagcagaagatcatgttcgccatgacctcaatcaagggtgtcgggcgccgcttctccaacatcgtctgcaagaaggccgacatcgacatgaacaagagggccggcgagctgacgcctgatgagctggagcgcctgatgacggtcgtggccaaccctaggcaattcaaggtgccggactggttcctcaacaggaagaaggattacaaggacggcaggttctcgcaggtcgtcttcaacgcccttgatatgaagctcanggacgaccttgagaggctcaagaagatcaggaaccaccgtggtctgcgtcactactggggc

SEQ ID NO: 69600 - DNA, 406 bp, Zea mays
  unsure at all n locations
  Clone ID: LIB3078-034-Q1-K1-A4
cccacgcgtccggatggcggcccaggctctcctctccggccggcagctgctgggccggcccgtgcagtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctatggcgaggtgatcaacggccgctacgccatgctgggcgcggtgggcgccatcgacccggagatcttcggcaagatgggcatcatccncccggagaccgcgctgccgtggttcaagacg

SEQ ID NO: 69601 - DNA, 388 bp, Zea mays
  Clone ID: LIB3078-034-Q1-K1-A5
gtcgtcgcccgtggcctggggcctgctgctgctaagccggccttggatgaacgggacggtgccggagaggtcgctgggttctggggctacctgctccagatcatctaccaggcaaatgcaggcgcggtgatgctcacggactgcgtgttctggttcatcatcttcccgttcctcaccgagaaggactacagcctcaacttcctgttgatcgggatgcattcggtgaacgcagtcttcctgctgggcgaggccgccctgaatagcttgaggttcccgtggttccgggtcgcctacttcttcctctggaccgcgctctacgtcgtcttccagtggatcgttcacgcagctacgccgatgtggtggccttacccgttccttgacctgacat

SEQ ID NO: 69602 - DNA, 375 bp, Zea mays
  unsure at all n locations
  Clone ID: LIB3078-034-Q1-K1-A6
gtaccccgacccctcgacaacaatggccaccgtcctaggcagcccccgcgcgccggccgtcttcttctcgccgtcctccctccgtgccgcgccggcgcccaccgccgtggcgctgcctgcggccaaggtgggcatcatgggccgtagcgccagcagcaggggcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggtcctgctcctnctgcgccggcaaggtcgtctccggctccgtggaccagtccgaccagagctacctcgacga

SEQ ID NO: 69603 - DNA, 380 bp, Zea mays
  Clone ID: LIB3078-034-Q1-K1-A7
cccacgcgtccggatcgcggaccaggctctgctctcccgccgccagctgctgggccgggtcctgcagtacgccgtctctacgtcgtctgccaggaacgcacccttcgacatcagggccaactccagccctccacccaagcaatgtgcctacaggcagactatgttcgcgttcaagcactccctctcctacctcgatggcacgctgcccagcgactatcgcttagacccactaggcctctcggaccccgagggcaccggacacttcatcgagcccaagtggctgacctatggcgaagtgatcaacggccgctacgccatgctgggcgcagagggcgccatcgacccggagatcttcagcaagatgggcatcatgccccccg

SEQ ID NO: 69604 - DNA, 385 bp, Zea mays
  Clone ID: LIB3078-034-Q1-K1-A8
gcagattgacagtattccagatgggctagttgattttgaggagtttgttgctgcaacagtacacgtgcatcagctggtggaacatgatactgagaagtggaaatcattgtctcaagctgcatttgataaatttgatgttgacagagatggctacatcacacctgatgaacttagaatgcatacaggaatgaagggttctattgatcccctcctggaggaggctgacattgacaaagatggcaagataagcctagatgaatttcgccggctcttgaagactgcaagcatgagcgcacgcaatgtacaaactcctaggggtgttcgcaagtcatagttttctggtttttgtagttcacataactgaactagagagcagcagcacatg

SEQ ID NO: 69605 - DNA, 430 bp, Zea mays
  Clone ID: LIB3078-034-Q1-K1-A9
gagccatatgttgtggagcttgatcagcgagaggatggctcagagattcaggatgccttacttgagatagttggcaggcgtactgtccctcaagtttttgtccatggaaagcacctgggtggttctgacgatactgttgactcctacgaaagtggaaaactggctagacttctaaacatcggagtcaaggacgacctttgagtgacatgctacatcggtcagcctgttcgtttggtttcaatccgtaccggcttctactacttctatattgtttttgtctctatggattacagctacaacagtctaaatagctgattttaatccgaagcgaacagtccaaacagtctcttgttttgagttaccaagggattttttgtgtgactctgattaaagatatgtaactgaaatgtttattataggttataccatt

SEQ ID NO: 69606 - DNA, 426 bp, Zea mays
  Clone ID: LIB3078-034-Q1-K1-B1
cccacgcgtccgctggtcgatggtgcccgccgacaaggcggcggaggccggcggcgacaaggcaccgcagatcgacgtcacgcagttcggctacttcaaggtgctcgggaagggggtgctgccgcccaagcccattgtcgtcaaggccaagctcatctccaaggtcgccgagaagaagatcaaggcagcaggcggcgccgtcgtgctcaccgcctaggtttcagtccttgttcgcctcctggttttgaaatctatatctgaactgatagtgctttcctgtctcagcaatttgtgttaagaaaacctgtagttttaaaatatgtggttcctgcctgttgggcagtgcttatgcggtttttgatgccagttcatatcaaatgtttcacatcaattaaatcgatcctcgctaccaggtgtgctagtttc

SEQ ID NO: 69607 - DNA, 308 bp, Zea mays
  Clone ID: LIB3078-034-Q1-K1-B10
cccacgcgtccgcctacgcgtctactgtttcatggacctacacgagtacgttcccatggcggggaccgtcatgttcagagagctgcttcataactatcctgattcatactacataaaatctctatctaactcagtaaatatctacttgagtcatatcattgatatagatgaattacaaaagatacaatgagctctactgaagaatgcatcacgtcgaagtcatttgttaaagatatgtaatacaaggatactctacatcttacatcagctatctgatatggacataattaatatcaatactaacgtat

SEQ ID NO: 69608 - DNA, 439 bp, Zea mays
  unsure at all n locations
  Clone ID: LIB3078-033-Q1-K1-H8
cccacgcgtccgcccacgcgtccgggtcggccggaccatcgtcgccgcgcgccggaggggcaagaacctctggctccagctcgacgcgccgcccttcccgtccttccagttcgggatggcaggcgcgatatatatcaaaggcattcctgtgacgaattataagagatccgttgttaattccgaagaggagtggccctgcaaatactctaaatcctttgctgacctggataatggttaggagtccgctttcattgataaacggcactttgcaagagttcgtttgtttgaagatcctgaaaccgtacccccaatttctgagctaggtccagatgctctgtttgagccaatgtccgtcaaaagtttcttggactccctgggtagaacgaagatagggataaaagctcttatactngatcagagcttcatatcaggcattggc

SEQ ID NO: 69609 - DNA, 402 bp, Zea mays
  Clone ID: LIB3078-033-Q1-K1-G5
aagataacatctaggatgacgttctaactatacgacaactaatacactaacggcacatggtgtcaatactcatagcacagcggacatccgatcacgacaaacaacaacactcaaataaaccttcactgatacaaagtcctactgaatcaaccatcaaagcatccatcgcgaaaattacaacggacaaacatgaacgatacgtatgtatccacttatgagacacgacaatggaatcatatcactgttcagcttaatctgtttgtctatacatattatcctattcgacaactaccactgtacttatgatattcttcttgttagatacttggaattgactgccatactggagccatggtaaacttctaaaatggacaacacagctatatcgagtgatgctattca

SEQ ID NO: 69610 - DNA, 467 bp, Zea mays
  Clone ID: LIB3078-033-Q1-K1-G6
gaaaaggcaaaccatctcactcttcaaacagttcacttagcacacttaatgacggaggtgtttgcatgacattctctttgagctgatatatatgggagcagtggctgcattggtaatttaagaaaatctcagtcacttccagattctaagccgaaacgatctttaagaaagaaatctctggattcatctactggaaacagaagacgatggcaatcgagtctagaagcaatggagaagaatgttagcatatcagtttctcttgaggggaatatctcttctattcccaactcgatagtcaacgattctaaaacgttaatggaaaatggggtagatacatcatttatcaaccatgctgctaaagaatggactgagatgagaagacaatgggttggacatcaggcagaagttccgagaaaggcccctcaagagccagtgataagttggtccgcaacatatgatgatctctt

SEQ ID NO: 69611 - DNA, 413 bp, Zea mays
  Clone ID: LIB3078-033-Q1-K1-G7
ctcgtcgccttcagcagccccaaccccggcctgcagatcaccgactttgcgctctttggcaacaacctcccgtccgccgtcgtggagaaggtcaccttcttggacgacgcgcaggtgaagaagctcaagagtgtgctcggcggcagcggttaacttgtttttcgagacaatacagtgcaggctgggtatgcatcgtcgccgtcgtcgtcttggtccgtcgtcatcgaatggaacgcgtgtgcttgctgctgcatgcgtgcgtgcacctgtcgtcgcgtgtcaaagtactcgtggtctatttcatcttacccttatttattcatctacttttcattcagggatgtattcagtttccatattgcattttgttgcaatgaaagagtaacatgtgcatctgattggttcaaaatagc

SEQ ID NO: 69612 - DNA, 467 bp, Zea mays
  unsure at all n locations
  Clone ID: LIB3078-033-Q1-K1-G8
cgttagactaggttaggctaggctagggtgtcgaccagctcgcggtaatggtggcctggaggttccatcagtaccaggtggtggggcgcgcgctgccgacgcccggcgacgagcaccccaagatctaccgcatgaagctctgggccaccaacgaagtccgcgccaagagcaagttctggtacttcctgaggaagttgaagaaggttaagaagagcaacggtcaggtcctggccatcaacgagatcttcgagcgtaacccgacgacgatcaagaactatggcatctggctgcgctaccagagcagaaccggctaccacaacatgtacaaggagtaccgcgacacaaccctgaacggcgctgtagagcagatgtacaatgagatggcttctcgccaccgcgtgaggtccccctgcatccagatcatcatgaccgncacagtacacttcaagctgtgcaagagggacaac

SEQ ID NO: 69613 - DNA, 461 bp, Zea mays
  unsure at all n locations
  Clone ID: LIB3078-033-Q1-K1-G9
ggcaacccgagcctgatccacgcgcagagcatcctggccatctgggcgtgccaggtggtgctcatgggcgccgtcgaggggtaccgcatcgccggtggcccgctcggggaggtggtcgacccgctgtaccccggcggcagcttcgacccgctcgggctcgccgacgacccggaggcgttcgcggagctcaaggtcaaggagatcaagaacggccgcctcgccatgttctccatgttcggcttcttcgtgcaggccatcgtcaccggcaagggtcccgttgagaacctcgccgaccacctcgctgaccctgtcaacaacaacgcctgggcctacgctaccaacttcgtccccggcaagtgagcgagggcatatacatactngtatgcgtgtaccgtagacatacgtattcgtatatgtactgcatgagatgtaccagtatttgtgaagaanggagcatgggc

SEQ ID NO: 69614 - DNA, 419 bp, Zea mays
  Clone ID: LIB3078-033-Q1-K1-H1
ctcgtcgccttcagcagcccgattccctttctgcagatcaccgactttgcgcgctttggaacaacctgccgtggggccgtcgtggagaaggtcaccttcttggacgacgcgcaggtgaagaagctcaagagtgtgctcggcggcagcggttaacttgtttttcgagacaatacagtgcaggctgggtatgcatcgtcgccgtcgtcgtcttggtccgtcgtcatcgaatggaacgcgtgtgcttgctgctgcatgcgtgcgtgcacctgtcgtcgcgtgtcaaagtactcgtggtctatttcatcttacccttatttattcatctacttttcattcaaggatgtattcagtttccatattgcattttgttgcaatgaaagagtaacatgtgcatctgattggttcaaaatagctttgtg

SEQ ID NO: 69615 - DNA, 455 bp, Zea mays
  unsure at all n locations
  Clone ID: LIB3078-033-Q1-K1-H10
cggacgcgtggttctttggccaatgttccatttctcatccttggcaacaagagggatgtgccatatgctgcctctgaagaggagctacggtatcacctaggccttagcaacttcacaaccgggaagggcaaggtcaaccttggcgactccaatgtccgtccacttgaggtcttcatgtgcagtgttgttcgcaagatgggctacggtgatggtttcaagtgggtctcccagtacatcaagtagggccctcgccgaggcgcatgctcagcccggcgaatttttttgccttgttcgttccggttggttcgtgacgagaacgaacgatggtcgctaggaaagtatcatggaaggtatgaagaggaaaaacagtgcttaacattgttgaacatgtngagtctttagcgtcaaaacaatttatgtcgaactctattctttcgcttttccatacaacggtt

SEQ ID NO: 69616 - DNA, 274 bp, Zea mays
  Clone ID: LIB3078-033-Q1-K1-H11
acgcgttcgccgacacgtacgccatctctctcaatcagttaccgcagatccgtcatccggtgagtgtagtccgcacgaacccatggcctccctcgagcttgcctgctcctacgccgctctcatcctcagcgactatggcatctccatcaccgcacgataagatcgccacgatcgttaatgcggccaacatcaaagtcgagtcctactggcctgccctcttcgccaagctcctggagaagcgcaacgtctaggaccttatcctctccgttggatc

SEQ ID NO: 69617 - DNA, 478 bp, Zea mays
  unsure at all n locations
  Clone ID: LIB3078-033-Q1-K1-H12
cgtctcgggcctggggactactcgcggggcttgtcttcgccgactctcggagaccctttcgcctaagaactcgcgagcctggaggggtgatccactgctctngctgggctattgtctgggcgcgcctcgggtgcctgtgttcccggagcctgctcgcccgcaactggcgtcaagnttcggcgagggccgtgtggttcaagggccgggtcccagatcttcagcgagggcgggcttgactacctcggcaacccgagcctgatccacgcgcagagcatcctggccatctgggcgtgccaggtggtgctcatgggcgccgtcgaggggtaccgcatcgccggtggcccgctcggggaggtggtcgacccgctgtaccccggcggcagcttcgacccgctcgggctcgccgacgacctcgaggcgttcgcggagctcaaggtcaaggagatcaagaacggccgncttggcatgttctncatgt

SEQ ID NO: 69618 - DNA, 331 bp, Zea mays
  Clone ID: LIB3078-033-Q1-K1-H2
cccacgcgtccgcccacgcgtccgcccattcgtccgccccaaggaaccctttaaaagggggaaggttgcttaacaagaggccccagtcgtggttgaagcaccaaccccagttcttggggagcctatggacttgatgactgctctgcagctcgtgatgaagaagtcaagtgctcatgatggacttgtgaagggtctccgtgaggctgccaaggccatcgagaagcacgccgctcagctttgcgtgcttgctgaggactgtgaccagccagattatgtcaagctggtgaaggcactctgcgcggagcacaatgttcacctggtcactgttcct

SEQ ID NO: 69619 - DNA, 459 bp, Zea mays
  Clone ID: LIB3078-033-Q1-K1-H4
caggaatgttgagtttggtgatgactctgagaggccaccacggagaaactatgagcgcgacagcgggactggccatggctatgagatgaagcgtgatggcgcagggcgtgggaactggggcactgccactgatgagcttattgcccaggatgcagaggactctccgaagatggaggaggctgctcctgttgctgagaaacaaggtgagcagatcgatgccccagcagcagatgagaacaaagataacaaggatgctactgcaaatgaggaggaagaaaaggaagaggacaaggagatgactctggaggaatttgagaaaataagagaggagaagaggaaagcactacttgcgttgaaggctgatgagaggaaagttgaagttgacaaggatctgcgttctctgcagccactttcaaacaagaaagaaaatgatgaagttttcattaagctgggttctga

SEQ ID NO: 69620 - DNA, 415 bp, Zea mays
  unsure at all n locations
  Clone ID: LIB3078-033-Q1-K1-H5
ccgcgccgtgatcgggcttgtggccactggcatcgtcggcggcgccttgtcgcaagcggcgcgcgccgagaccgtcaagaccatcaagattggagccccgccgccgccctccggtggactccccgggactctcaactctgaccaggcgagggacttcgacctccccttgaaggagcggttctacctgcagccgctgccgccggcggaggcggcggcgagggtaaagacgtcggcgcatgacatcatcaacctcaagccgctcatcgacaagaaggcgtggccgtacgttcagaacgacctncgnctncgggcctnctacctgcgctacgacctcaagaccgtcatcgcttccaagcccaaggaggagaagaagagcctcaaggagctcaccggcaagctcttcagcaccatcgac

SEQ ID NO: 69621 - DNA, 460 bp, Zea mays
  Clone ID: LIB3078-033-Q1-K1-H6
cccacgcgtgcgcagacgcgtgggcgaagctcctactggcgattccaatcgcgcgcacgggatctgcgactgcgcgtgcgactcgcgcaggacatatattcagtgatggaacacaaggaggccggctgccagcagccggagggcccaatcctatgcatcaataactggggtttctttggaagcgctgccaccatgaacatgtgctccaagtgccacaaggagatgataatgaagcaggagcaggcccagttggctgcctactacatcgatagcattgtcaatggcggggataatgggaaaggacctgcaattgctgcaactgtaggtgtggcagttcctcaagtcgaggagaagactatcgccgtgcagcctatgcatgtcgctgaaaccagcgaggctgctgctgttatcgcgaaggccaaagaaggcccaaaccggtgcgcaacctgtaggaagcgtg

SEQ ID NO: 69622 - DNA, 310 bp, Zea mays
  Clone ID: LIB3078-033-Q1-K1-H7
gttcggagttcgaggcacgcgtcaggcgttcgagcttgagaccccagggaggagatgaagagcctaacggagctcaccggcaaggtgttcagcgccatcgacgatcgcgaccatgccgcgaagatcaagagcaccccagaggccgagaaatactatgcagcaaccaaagatgctcttggcgacggtatcgtcaagctaggctagacgcacgggctaataatggccatgtaatttacgacttgcgttggctcatatggacccggcaaggcaatgtaccatattctgctgatattgtaaaaaaactactgag

SEQ ID NO: 69623 - DNA, 464 bp, Zea mays
  Clone ID: LIB3078-033-Q1-K1-G4
cccacgcgtccggcgaggccgccgacgcccgacggcagggtgcccaggccttcttcgggcccatcgcgaggccatagttgcatcattcgcctgagacgactgcccaccgccaggactgatctcctcactaggcgcgtagaggtgaagagaataacttgacaatgagcagcataggcacaggttacgatctgtctgtcaccaccttctccccagatggtcgtgtcttccaggtcgaatatgctaccaaggccgtcgacaacagcgggactgttgttgggatcaagtgcaaagatggcattgtcctgggtgttgagaagctggtaacctcaaagatgatgctggaagggtcaaaccggaggatccattcagtgcaccggcactctggcttggttgttgctggtttagcagcagatggcaggcaaattgtttcaaggacgaagtcagaagctgccagttatgaaaag

SEQ ID NO: 69624 - DNA, 444 bp, Zea mays
  Clone ID: LIB3078-052-Q1-K1-A10
cggacgcgtgggcgctcggcgcgcgccttgtcgagcgcgcggagtttccgatcgggttcatgggcggtttctgtgtttctgccgcgcgacttggcttgcctgatgttggcctcatttcctatggagaaatggtagatcaagggcgtctcatcaatgaagctgtttcaatcccagtgattggtgatggagacaatggttacggaaactctatgaatatcaagagaaccataaaaggatatatcaatgctggttttgctggaattatgcttgaggatcaggtggcacctaaagcatgtggacatactgaaagaaggaaagtcatatcaagggaggaagctgtcatgcacataaaagctgctgtagatgctaggaaagagagtggctctgacattggtattgtagcaaggacagattctcgccaagctatttctcatgatgaagcat

SEQ ID NO: 69625 - DNA, 425 bp, Zea mays
  Clone ID: LIB3078-052-Q1-K1-A11
tttagatgtcataaaccaaacatggagcctaatgtttgatctagtaaatgtttttgaagtgttccttccacagctgttactatatccaaatccttctgatccattaaatggggaggctgcagcactgatgatgcgtgatcgtcctgtttatgaacagaaagtgaaagaatattgtgagaagtatgccaaaccagaggacgctggtatcactccggaagacaagtccagtgatgaagagcttagcgaggaggaagacgactccggtgatgaagctatacttggcaatcctgatccctagtctgagttggaagaagccagtccagctcatcaatacaatgtttattgcagaaattgcaattaaacaaaaactgaaaaacaaaaaaactttggatggcatgtaaataagtgtacctttgtatgtctcc

SEQ ID NO: 69626 - DNA, 374 bp, Zea mays
  unsure at all n locations
  Clone ID: LIB3078-052-Q1-K1-A12
gttctagatcgcgagcgccgnccttgntttttgtttttgccaagcccgtgatgaatcaggtgtcacataggttcaggataagttacaagggaaaagtgacaagtggacaaaaatggacaatgcacctcactcaatctcaatttgctgatgtgcatcattttgatctgcctcacttgattcttcagagctgttatcctcagctattccagaagcctccactgtccgacttatccattccttgagaggatcctcattcaggtcaagcctcaagaggccagcaaacacaccacccatgaatgctactggctccttgatggcttctcggaggatgcgctcatccccgagagggttgaagaaagctcgcacgacccctg

SEQ ID NO: 69627 - DNA, 438 bp, Zea mays
  Clone ID: LIB3078-052-Q1-K1-A2
gataacgacaggaaacctggtctccctgtcggagcagcagattctagactgcgacgagtcagacgggaaccagggctgcaacggtggctacatggacaacgccttccagtacgtcatcaacaatggcggcgtcaccactgaggacgcctacccttactctgcagtccaagggacgtgccaaaacttccagccagccgccaccatcagcggcttccaggacctgcccagcggcgacgagaacgcgctcgccaacgcagtcgccaaccagccggtgtctgttggcgtcgacggcggatcgagtcctttccagttttaccagggtggcatatacgacggggatggctgtggcacggacatgaaccatgcagtgaccgcgatcggctacggcgccgatgaccagggaagccagtactggatcctcaagaactcctggggcac

SEQ ID NO: 69628 - DNA, 250 bp, Zea mays
  Clone ID: LIB3078-052-Q1-K1-A3
ctcgtcggcaacctgttgctgccgtctttagtttgcgctcgcgccgctgtccgtgtgcgcgagcttcactcgccggccgcggcgcgtctgccattccaagaacgctttggacgaagttgtggtggcggactagaagaactgggacgggttggtgatggcgtgcgagacaccggtgctggtggaattttgggcgccattgtgcggtccgtgccggatgatcgctcctgtgatcgacaagctggccgttgac

SEQ ID NO: 69629 - DNA, 431 bp, Zea mays
  Clone ID: LIB3078-052-Q1-K1-A6
ctcgcccaccaccacaccaccggcggcggcggcgacccagtcgagaacacgaaggcgagggcgacagcgctgaaccgcgggctccgctccgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatggagacttattttgagcgacatttttttgaagttaaaagcttggacttcatcctatc

SEQ ID NO: 69630 - DNA, 427 bp, Zea mays
  unsure at all n locations
  Clone ID: LIB3078-052-Q1-K1-A7
gccgatttgagagaaaaggctataagcttgttgccatcaagctgattgttccatccagagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggngtgaattaacgagagagtcaatctggttnttttccttcttttgatct

SEQ ID NO: 69631 - DNA, 427 bp, Zea mays
  Clone ID: LIB3078-052-Q1-K1-A8
gccatgcttggcgtggccgggatgctcatcccggaggtgctgaccaaagccgggctggtcaacgcgccgcagtggtacgacgccggcaagtcggagtacttcgcgtcgtcgtccacgctgttcgtggtcgagttcatcctgttccactacgtggagatccggcggtggcaggacatcaagaaccccggcagcgtcaaccaggaccccatcttcaagagctacagcctgccgccgcacgagtgcggctacccgggcagcgtcttcaacccgctcaacttcgcgcccacgctcgaggccaaggagaaggagctcgccaacgggaggctggcgatgctggcgttcctgggcttcctgatccagcacaacgtcaccgggcaggggcccttcgacaacctgctgcagcacctgtctgacccatggcacaaca

SEQ ID NO: 69632 - DNA, 329 bp, Zea mays
  Clone ID: LIB3078-052-Q1-K1-B1
cacgaacctgcagaggactggtacgagtacctgcctgacgtaagcccgtgactttctgcgggggggatctgaacaggatgaggctacgactcatcgactgaaaggtgtcctgtatcgtgacggccataaacggagacagcctcacggcgctcttgttgtccaacatcggacatgagctggcccacttactcacgcacctctaccgtcagcttacagctctggctgtggatagtgtacattgcacctaggcctgatcatcatgctcaccttcatacgcatcggattcaatgacctgatcgacgactacttacagaagtgaagcggattag

SEQ ID NO: 69633 - DNA, 170 bp, Zea mays
  unsure at all n locations
  Clone ID: LIB3078-052-Q1-K1-B10
attggagctggtcgcattggctccgnctatgcacgcatgatgattggcgggttcaagatggacctcatgtactacgacctggattaggccacacgtcttgagaatttcgtcacagcatatgggcaggtccttaaagccaacggtgaagaacctgtcacctggaaaaaggc

SEQ ID NO: 69634 - DNA, 444 bp, Zea mays
  Clone ID: LIB3078-052-Q1-K1-B2
ctgcagctgcagcggcgccaagaagcagagctgctctctgcgtcaggggcagcagcagaggaggcgcctgcgcgtcgcccgcgccgtcgaggtggacgcgccttccgccggcgcaccggagccggaggacgcggacgagccgtccgtcgacttcgctttcgtcagcccgcggctgctgccggacgggacgccggacgtgcactaccggacggagcgcggcgtgcagaagctcacggacatcatgctcgacggctacatcgacctctacgggccctacgataacgttcttctcaactgctcacgaggcggcgtgtgcggcacctgcatcgtcgaggtggttgaacgcaaggaaatgctgtccccgaaaactgatgttgaaaaggagttgctcaaaaggaaacccaaaacgtggagattggcgtgccaagcaacggtgggcaacgc

SEQ ID NO: 69635 - DNA, 393 bp, Zea mays
  Clone ID: LIB3078-052-Q1-K1-B3
gacgtggtctacaatgcatcaaacactgagcttgtgaggacacaaacccttgtgaagagtggcattgtgcaagttgatgctgccccattcaagcagtggtacctcactcactatggagttgacattggtaggaagaagaaaacccctgctgcaaagaatgataatgctgacggacaagaggttgaggcagcagctgatgaaacgaaaaagagcaaccatgtcacgaggaagcttgaaaagcgcaaggagggacgtacccttgacccacacattgaggagcaatttggcagtggacggctgctggcatgcatttcttcccgccctggacagtgtggccgtgctgatgggtacatacttgagggtaaagagcttgagttctacatgaagaagcta

SEQ ID NO: 69636 - DNA, 413 bp, Zea mays
  Clone ID: LIB3078-052-Q1-K1-B4
cggcctgtaggcgatcgtgaggagcggagccgtggacgtggtggtgcccggggtgctggcgatcggctgcttccccatctacctcaccctctacggcacctccaacgccggcgactacgaccgcgacggctgcctccgcggctacgacggcctctcctcctaccacaacgcgctgctgccgcagagcactgtccggcctgcagaggacgtacgcgcacgcccggatcatgtacgccgacttctacacccaggtcacccacatgatccgggccccttacaacttcgggctcaagtactgcctcaaggtctgctgctgcgccagctggcagggccaggacggctacagcaacgaggcgcggtgcggcatggccggtgccagcgcctgcgccgacccgggcaactacctcatctgg

SEQ ID NO: 69637 - DNA, 367 bp, Zea mays
  Clone ID: LIB3078-052-Q1-K1-B5
gcggatcgagaaagatattgatgaagttgtgaaaattgctcgtcaagcgaatactaaggctgatgcattggatgatgactacttatcagataggctataacctggatgtggacaaggatctgccgtgggccgatcaatagagcaatctactgaactaactactgagatattgaaggagcggttggatgactttcagaccttgtgagaaaccttcagacaagagtttcggcaggatgatcaaagaatggtttttactgtgactggtactggtactgatgatcagactgttgatgactcgatagataccttgataggtgaccaaatattcgaagatgctatccaacatgctgtacaacgtcagatacta

SEQ ID NO: 69638 - DNA, 291 bp, Zea mays
  Clone ID: LIB3078-052-Q1-K1-B6
cccacgcgtccgcccacgcgtccgttcatgagcttgttcattgacggccaggccgagctgtttgtcgcttgagatgtcacaaggcttgcggtgcgtatgcttttcggtgttttgtgtcagagcgagcaatcacaaagcaatggagagcccagcttgtaggaaccacatcgatgtatagtagttgatacgcatgtactgactaatttgagcaagtaaaatgttactgctcacaattatagcacacggttcatctgtgaaaacaaatatgctcatctcgtgctaatgggcttt

SEQ ID NO: 69639 - DNA, 276 bp, Zea mays
  Clone ID: LIB3078-052-Q1-K1-A1
aaagcgcactactcgattattacggatgtatagaaagagccgagtgtgcactgtaatggacggttagctgctattgatgtgtcttgtgttagttgactaaaagcttcaacagccatgtgtacaaaattcagtttacaagcaaagatctaaggtcgatcgatgattgatcaatcctcatcaaccaaggcaacttcaaagcgctacttctctacgagacgctcgatctcgacatcatccacgaccctgaccaggtggatgactacttcagggacacca

SEQ ID NO: 69640 - DNA, 424 bp, Zea mays
  Clone ID: LIB3078-051-Q1-K1-G6
cggcaacaacaacaatgggagcgccaacggcacttctgtggctgacaagcgcttcaagacattgccgacgagtgagatgctaccgaggaatgaagtccttggtggatacatctttgtctgcaacaacgataccatgcaggaggatctcaagaggcagctttttggtttgccagcaagatatcgtgattcagtccgagcaatcactcctggcttgcctcttttcctctataactacacaacccaccagcttcatggggtatttgaggctgccagttttggtgggtccaatatcgatcctactgcatgggaggataagaagtgtaaaggtgaatctagattcccagcgcatgtgaggatctgcattaggaagctgtgcaagccgttggaagaggattccttcaggccagttttgcaccattatgat

SEQ ID NO: 69641 - DNA, 429 bp, Zea mays
  Clone ID: LIB3078-051-Q1-K1-G7
cccacgcgtccggaactaccacatgaaatgactctaaaagatgtcatggatactgtaggtaaagacgtataggaaattaatgatgtgaaagctagcacatgatgaatgatatcagctacttcttatgcattgggtttataaggaattgctaagtctacatggtatcttcttaccttgactcgcgcttgaacaggcacaacagttactgtatttcctgtgataggttatgattgcgctcacaaatcattacaaaggaataagcaggatgaagatgatgatggaactctggctgacatgacagtgatatatgcttatgaacctggaagatttaagcattgccgacatcatgctaagacatacatgttgatagaagatactgcattgcaacatgattagctaaaggaaatttaatcatcatcttatctaacg

SEQ ID NO: 69642 - DNA, 225 bp, Zea mays
  Clone ID: LIB3078-051-Q1-K1-G9
tcatcctccgactcttccatctaccctcactaacatttgactctaccatcctctacgggacccacgggctcttctaccaccacttggaacagctcctatgcctactactctaccacctctctctcatcaccatcatcatcaagcgcaaggacttctactacacactgatcaccagcaacaagatactcctcataacatcacactactacatgcatcatatccgtc

SEQ ID NO: 69643 - DNA, 414 bp, Zea mays
  unsure at all n locations
  Clone ID: LIB3078-051-Q1-K1-H1
gccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgatcctgagaagaaggagcggctgcagctggcggagatcaagcacgcgcgcctcgccatggtcgccttcctcggcttcgccgtgcaggccgncgncaccggcaaggggccgctcaacaactgggccacccacctgagcgacccgctccacactaccatcttcgacacgttc

SEQ ID NO: 69644 - DNA, 439 bp, Zea mays
  unsure at all n locations
  Clone ID: LIB3078-051-Q1-K1-H10
cgcgactgcaagttctagattggagaggcctaaacgtgttgttccccgagcattttctgtttctaatcaaagaagtttgttcggaataaatggtggtgtgaccaatccattggccaataaggataaatctggtgataaaagtagcatctctccagcaagcatgacaaagaagagtacgcatgtggcacttaggaagactttgcagcctgagaaggcatttcatcctctggaagaggactcctttctacacaaaattagaggagaaacataaagctttggaagcagagaaggacgaggctgatgccaggaaaaaggaagagcaagacgttgctttaaaacaactaacgaagtcattggtgattagagcgaaacccatgccaagcttctatcatgaagggcccncaccaaaggctgaactgaagaaagtgcctcctacccg

SEQ ID NO: 69645 - DNA, 383 bp, Zea mays
  unsure at all n locations
  Clone ID: LIB3078-051-Q1-K1-H11
cccacgcgtccgcccacgcgtccgcggacgcgtggggtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcgggcaggaagcggcgcggcggcgcgttcggcgcccagatgaacgacgccgtcgagatcttcaggatcgccgtcaccatgaacggnctcgtgctcgtcggcgtcgccgtcgggttcgtgctgctccgggtggaggccgccgtcaaggattccgagt

SEQ ID NO: 69646 - DNA, 438 bp, Zea mays
  unsure at all n locations
  Clone ID: LIB3078-051-Q1-K1-H12
tcggtcgcccgtgctccccaccgatggtctccccgacgatttcgactggagggaccacggggccgtctgccccgtcaagaaccagggttcgtgcgggtcgtgctggtcgttcagcgcgtctggagcgctggagggtgcgcactacctcgcaactggcaagctggaggtgctttcggagcagcagttcgtcgactgtgaccacgagtgtgattcatcggagcctgattcatgtgattcgggttgcaatggtgggctaatgacgacggcattcagttatctccagaaggccggtggccttgagagtgagaaggattacccttacactgggagtgatggcaaatgcaagtttgacaagtccaagattgttgcttcagttcagaacttcagtgttgtgtctgtggacgaggctcanatttctgctaacctcatcaaacatgg

SEQ ID NO: 69647 - DNA, 443 bp, Zea mays
  Clone ID: LIB3078-051-Q1-K1-H2
cccacgcgtccgcccacgcgtccgggaggcggcgctggtcgggggacggaaccacagggacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcgggccggggctggtggtgccagggatctactactcggacgacaagatgctgcagtgccgggtgttcgcctacgccgacacgcagcgctacaggctgggtcccaactacctgatgctgcccgtcaacgcgccgcgctgcgcgcaccacaacaaccactacg

SEQ ID NO: 69648 - DNA, 429 bp, Zea mays
  unsure at all n locations
  Clone ID: LIB3078-051-Q1-K1-H3
attcccccgacgcgaggcctcaaatcgctctctgcccccgatcaccggtcgcctcccggccggtcccctgcctgcctaatccctccggccaccccgaaaccgctcgctcgctcgctcgctccccgcgcccagagacaagcccggagaccatggcggaccagctcactgacgaccaaatcgccgagttcaaggaggccttcagcctcttcgataaggacggcgacagttgcatcacaaccaaggagcttggaactgtcatgcgttcactgggtcagaacccaacggaggctgaactccaggacatgatcaatgaagtggatgccgacggcaatggcacgatcgacttccccgagttcctcaacctcatggcccgcaagatgaaggacaccgactccgaggaggagcntcaaggaggcgttcaggtgttcg

SEQ ID NO: 69649 - DNA, 415 bp, Zea mays
  Clone ID: LIB3078-051-Q1-K1-H4
gtttatcttctcccctcctctgcccccatctcgcttctcgcacacggcagccggattgcgaagcgcaccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcaccccaaagtacacttcactgaagcctctgggagatagggtgcttgtgaagctcggtgccgcagaggagaagacagttggtggcattttgcttccatctactgcccagactaaacccacaggaggtgaggttgttgctgttggagc

SEQ ID NO: 69650 - DNA, 411 bp, Zea mays
  Clone ID: LIB3078-051-Q1-K1-H5
cccacgcgtccggccgcctcaccgcctctctcaatctgataccgcagatccgtcgtccggtgagtggaagccgcacgaacccatggcctccggcgagcttgcctgcacctacgccgctctcatcctcagcgacgatggcatcgccatcaccgccgagaagatcgccacgatcgtgaaggcggccaacatcaaggtcgagtcctactggccggccctcttcgccaagctcctggagaagcgcaacgtcgaggacctcatcctctccgttggatctggtggcggagctgctccagttgctgctgccgcacctgctggtggtgctgcggctgctgctgccccggctgtcgaggagaagaaggaagaggccaaggaagagtctgatgacgacatgggcttcagcctgttcgactg

SEQ ID NO: 69651 - DNA, 453 bp, Zea mays
  unsure at all n locations
  Clone ID: LIB3078-051-Q1-K1-H6
ggcgcctccgaggaggtgaagcagctggaggaccaggcggcggccatcatgaaggcggcgcgcgccgagatcgcggcggcgcttaacaagatgaagaaggagaccaccgcggagctggaggccaagctggacgaggggcgcagccgtgtggaggccgagctcgtagaggcgctcgccaacctcgaggcgcagaaggaggaggctgttaaggcgctcgacgcccagatcgcctcgctcagtgatgagatcgtcaagaaggtgctcccatccgcgtgatgaaaccaaaccggccctgccttatcctacgactatagttacatgaacatcataaattaatgataattgtgaagaaattggccgatgactccgacactgtactcatgaaagattattggatgggttgtgtccaccgnctgtgttgggtgtggatgggtgtagactcgcagtgatctt

SEQ ID NO: 69652 - DNA, 428 bp, Zea mays
  Clone ID: LIB3078-051-Q1-K1-H7
gtgaagcacgagcagaagcttgactgcggtggtggctacgtcaagttgctgggtggtgatgtagaccagaagaaatttggtggagacacatcttacagcattatgtttggaccagatatctgtgggtacagcaccaagaaggttcacactatcctgaccaaggatggcaagaaccacttgatcaagaaggatgtgccttgtgagactgatcagttgactcatgtttacactttgatcatccgtcctgatgcaacatacagcattctcattgataatgaagagaagcaaactggcagcatctacgagcactgggatattcttccccctaagaaaatcaaggacccagaggctaagaagcctgaggactgggatgacaaggagtacattcctgaccctgaggacaagaagccagagggctatgatgatat

SEQ ID NO: 69653 - DNA, 332 bp, Zea mays
  Clone ID: LIB3078-051-Q1-K1-H9
acgacaccaagtcgaggagctcgagggctccaatcatggccggcgtgaagtccatcgtggtcgggctcaagcccgccgcggcagtgccgcaggccgtcgtcggctcatcgtcggcgaagcggttgcagctggccgcgcccgagggccgacgcgccgctctgctcggcttggcggtcgtcttcgacgtcacggccaccatcgggtcggccaaggccacgatcttcgatgagtacctcgagaagagcaaggccaacatggagctgaacgacaagaagaggctggccaccagtggcgccaactttgcgcgcgcctacaccgtggagttcggcagc

SEQ ID NO: 69654 - DNA, 439 bp, Zea mays
  Clone ID: LIB3078-051-Q1-K1-G5
ggaaggagggcgggtacgaggtgatcaaggcggccatcgagaagctgaagctgcggcagagggagcacatcgcggcctacggcgagggcaacgagcgccggctcaccggcaggcacgagaccgccgacatcaacacgttcagctggggcgtggccaaccgcggcgcgtcggtgcgcgtgggccgggagacggagcagaacggcaagggctacttcgaggaccgccgcccggcgtccaacatggacccctacgtggtcacctccatgatcgccgagaccaccatcatctggaagccctgagcgccgcggccgttgcgttgcagggtccccgaagcgattgcaaagccattgttccttccgttccgtttgcttattattgttattatctagctagatcatctgggggtcaggtcgtcgtggtgtgccaaaacagaacacag

SEQ ID NO: 69655 - DNA, 334 bp, Zea mays
  Clone ID: LIB3078-051-Q1-K1-E9
aaatatacacgggttgtgactccctcggccatcgtcaagactcgtgaggcctccgagcgggcagcggagagatcaaactgagagatggagagagggagagtcgtgctcgcgggttgtgtccgtggcccggggggaggaaattttctgggcgcctccacctttggtgctcgcgccatcgacgaagaaaggagagcaaagagagagaacagagagtgggtcaccgcgtccgaggctagcaccaaggaacccaatgccgccatggtcggtgtccgcggtgtcgatgtcagtttccacgggatctggctcgtcggcgcgctcgcggattccttcgcgt

SEQ ID NO: 69656 - DNA, 433 bp, Zea mays
  unsure at all n locations
  Clone ID: LIB3078-051-Q1-K1-F10
cccacgcgtccgcccacgcgtccgggcagatctgagttagccggcggatgcgatccgggcgcgtgctgctgtgtgtgtgtcggtggagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgacccgttcatcggcagcctggagacgccggtcacctccagcccgctcgtggcgtggtacctctccaacctcccggcctaccgcaccgtcgtgagcccgctgctgcggngcgtcgaggtcggcctcgcgcacggctacctnctcgtggggcccttcgcgctcacgggc

SEQ ID NO: 69657 - DNA, 343 bp, Zea mays
  Clone ID: LIB3078-051-Q1-K1-F11
aaaggagcggcggcgaggtctatggcgtcgacggcggggtacctggcgcggcgggcggggcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattgttccatgggcaccaggcggcactaaattcacaagataccccccttcacctcaggggatcgagatcatctaca

SEQ ID NO: 69658 - DNA, 434 bp, Zea mays
  unsure at all n locations
  Clone ID: LIB3078-051-Q1-K1-F12
cggacgcgtgggcggacgcgtgggcggacgcgtgggcggacgcgtggggcgccacaggtgaccggaaaaccacggccggcgttcctgcttctctacccggtccgaattgctgaccggatcaacccgagaccttgcaggattatcgatctgattgcggcatgatccgcttcatcctgctgcagaaccggcaggggaagactcgactggccaagtattacgtcccgctcgaggactcggaaaagcacaaggttgaatacgaggtacaccggctcgtggtcaatcgggaccctaagttcaccaacttcgtcgagtttcgcacacacaaagttatctataggagatatgctggactgtttttttcaatatgtgtggacataactgataatgaattggcatacttggaatgcattcactnngttgtcgagatattggac

SEQ ID NO: 69659 - DNA, 296 bp, Zea mays
  Clone ID: LIB3078-051-Q1-K1-F2
cactcctctcgtccgcgcttgtttgttcgcgtcttctccctgtagggaactccgttacggggccccggctgtgcgtggcgtcagcacgccccgcgggcaggagggtgaggctgctgagcgtgaggtgcgagcagggagccaagggcggtggcgggctggacgtgtggctgagccgcggggcgatgctgggcttcgtcggagcggtggccgtggagctgaccaccgggaaaggcgtgcttcagaatgtgggattgaccgcgccggtgccgacgctggcgctggcgctcaccggcgcg

SEQ ID NO: 69660 - DNA, 416 bp, Zea mays
  Clone ID: LIB3078-051-Q1-K1-F3
gttcatcatggacaactgcgaagagctgatccctgagtggctgagcttcgttaagggtattggtgactctgaggaccttgccctcaatatctctcgtgagactcttcagcagaacaagatcctgaaggtgatcaggaagaaccttgtgaagaagtgtgttgagctcttctttgagattgctgagaacaaggaggactacaacaagttttacgaggctttctccaagaacctcaagcttggcatccacgaggactcgcagaacaggaccaagatcgccgagcttctgagataccactccaccaagagtggtgatgagctgaccagcctcaaggactacgtgaccaggatgaaggagggacagaatgacatatactatatcactggtgagagcaagaaggcagtggagaactccccct

SEQ ID NO: 69661 - DNA, 395 bp, Zea mays
  Clone ID: LIB3078-051-Q1-K1-F4
ggccgtccagcgtcccggccatcaacggcaacagcctcacggggctcttcttctccaggatgggccaggagctggcccacttccccacgcccccgcccgtcacctcccagttctggctgtggctagtgacgtggcacctgggcctgttcatcgtgctcaccttcggccagatcggattcaagggcaagaccgaggactacttcgagaagtgaagcggttaagatcctatccatcatccctggtgctgcgctgcgttgcgttgcgtgcgtgctcgccgcaatcgaacccttgctgtatagggttccgatttcgtcgaatgtaatgtatgatgctacttttgcgcttcattataaaatctatgccgcccggccccaaaaaaaaaaaaaatataaaaa

SEQ ID NO: 69662 - DNA, 402 bp, Zea mays
  unsure at all n locations
  Clone ID: LIB3078-051-Q1-K1-F5
cccacgcgtccgatgcacttgacatgttttgaagaaatggtggcgcataacaaatacggttgtccaatatgctctaaaacagctcttgatttgacacatcattgggaaatgttggatcaagagatcgaagccacgatcatgcctcttgtgtatcgctacaagatttgggtgctttgcaacgattgcaacaaggtctcagaggtgaactttcacgtgattggccacaagtgcagccactgcagatcgtacaacacccgaacgacatcgcgccctgcagatttatcgggaagcagctcaccttcaacagactcatccgacaacaacatatagagaagaaaccattgacagagccaatatgattgaagaaccgaaggaggaaatattgtttcggngcgtgcgtgc

SEQ ID NO: 69663 - DNA, 445 bp, Zea mays
  Clone ID: LIB3078-051-Q1-K1-F6
cccacgcgtccggccaagcaagctaatactctgtactggtctcctgctgggcgcttcagagttcttgctggactgaagggtttcaacgggcagctggaattctacaatgttgatgaactagagacaatggcaacaggagagcattttatggcaacagatatcatgtgggatccaactgggagatatctcgcgactgcagttacctcagttcatgaaatggagaatggctttcaaatatggtccttcagtggcaagcatctttacaaggtgtcaaaggatcatttctatcagtttatatggcgcccgagaccgtcctcactactgacggccgagaaggaagaagagatctcaaggaacctgaagaagtatagcaagaagtacgaacaagaagaccaggatgcattcaatcagttgagcgagcaggaccgcaagaggcggacacagc

SEQ ID NO: 69664 - DNA, 425 bp, Zea mays
  unsure at all n locations
  Clone ID: LIB3078-051-Q1-K1-F7
gcgagatgtatgcaagagataatactggtgattatgtccttcgacttggtgctgaccggtcatctgagaacttaacattgctggaaactggtgagcctatctattccccgacactgcaggaaggccccatcatgacagcagagcttataaaagaaacagaggagctagtgttacggacaggaagtcttggtgctggatgctctcaacttctatcagatatgcaggctttcaaggcagcaaatcctggttgtgtcctggaagactttgttagatggcactctccacccgattggtctgaggattgtgctgcaaacagtaccacagttggggaaggctcatctagacgtgggcggttaagtgataggatgcanacaaaagaaggtaacttgtggaaggaactgtgggaggctgcaaaacctatacct

SEQ ID NO: 69665 - DNA, 395 bp, Zea mays
  Clone ID: LIB3078-051-Q1-K1-F8
aacgccttcagcacctacggcgaggtcctcgagtccaagatcatcctcgatcgggaggggcataggtcccgcggcttcggcttcgtcaccttctccacggatgaggcgatgcggaacgccatcgagggcatgaacggcaaggagctggacggccgcaacatcaccgtcaacgaggcccagtcccgcggcggccgtggaggcggcggctgtgggtacagtggcggccgttgaagccgctgctacggcggtggctggcgccgtgatggcggtggcggctaccgcggtggcagcggctacagtggcggccgcggctacggaggtcgtggcggcagctacggcggtggcaaccgcggctgcggctacggcaactccgacgggaactggacgaactgaac

SEQ ID NO: 69666 - DNA, 354 bp, Zea mays
  Clone ID: LIB3078-051-Q1-K1-F9
cccacgcgtccgcccacgcgtccggggagttctccgaggacctcaagctgttcgtcggtgacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgtcacctagagatggatccgcaccaagagcaccaatgtgtggtggtggtgggggtggtgcggcagctttgtcgattc

SEQ ID NO: 69667 - DNA, 349 bp, Zea mays
  Clone ID: LIB3078-051-Q1-K1-G1
aggacttcctcctcaccgcgaggaggaatgatgcccgctcagtgaagatcaagaggagcaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgggttgaactacccaagcttctttatcagtagcagagcatgctactcatgtacttttggaacctaagctattagacctgtcagtgttggatgtgtggatcttgcatttttgtggagaaataccaatttacctcgttcaaggatgc

SEQ ID NO: 69668 - DNA, 379 bp, Zea mays
  unsure at all n locations
  Clone ID: LIB3078-051-Q1-K1-G11
cggacgcgtgggcggacgcgtgggagcaacagctaagcctctcccacaagacagcaacgtggctgaggaggaggccaagaaggtggaggtggaggtcaccaaggagcccgaggcggcggcgaaggaggacgtagccgatgacaaggccgtcatccccgcgaccgacccgccgccgccgccgccgccggccgacgactccaaggccctggccatcgtcgagaaagttgcagatgaacctgctcccgagaagcctgcccctgcgaagcaagggggctccaatgacagggatctcgctcttgcaagggtgganacagagaagaggaactctttgatcaaagcttgggaggagaatgagaagacaaaagctgagaacaaggct

SEQ ID NO: 69669 - DNA, 437 bp, Zea mays
  unsure at all n locations
  Clone ID: LIB3078-051-Q1-K1-G12
cacgcgtccgcgaccgttcgctcgcgcaggggctcaagggtgacccggcgtacctggtggtggagcaggacaagacgctggccacctacgggatcaacgccgtgtgcacccacctcggctgcgtcgtgccgtggaacggcgccgagaacaagttcatctgcccctgccatggatcccagtacaacaaccagggcaaggtggtccgcggaccggcgcctctgtcgctggccctggttcacgccgacgtcgacgacggcaaggtcctcttcgtcccgtgggtggagaccgacttcaggaccggccaggacccgtggtggagtgcatgaggaggatcatccgatacaagcggtgctcagtgctcataggctntctccgagggcgttgttgctacaaattcacttgcctcttgccttcanattatatatattacacacact

SEQ ID NO: 69670 - DNA, 208 bp, Zea mays
  Clone ID: LIB3078-051-Q1-K1-E8
cacacgcgtgcgtcgacacacgcttcttagaccccttaatgatgacttacatgagctgggtatatagtgtgctacagtgagactctctagctagccaagatgactaccaatgcggaggacttcacaatcaacctcatactgtatcatctctctgcctcacattacaacatcttaccactggcctatctagggactattctgctaatca

SEQ ID NO: 69671 - DNA, 410 bp, Zea mays
  Clone ID: LIB3078-047-Q1-K1-G5
cgtccggaccgggtcgggccaagccgtccggcggggcgtctaggtcggcctcgcgcactgctacctcctcgtggggcccttcgcgctggcgggcccgctccgcagcacgcccgttcacggccaggccggcgcgctcggcgccgccggcctcgtcgccatcctcagcgtctgcctcaccatgtacggcgtcgcctccttcaacgagggggacccgtccacggcgcccacgctcacgctcaccggcaggaagaaggaggccgacaagctgcagacctccgacggctgggccaagttcaccgggggattcttcttcggcggcatctccggcgtgctctgggcctactttctcctctacgtgctcgacctcccctacttcttcaagtagatatcatcaaagatgcgtatatata

SEQ ID NO: 69672 - DNA, 422 bp, Zea mays
  Clone ID: LIB3078-047-Q1-K1-G6
actcggtgaagaccggggcgagccacgccttcggggggctttctttaaaaccgctggtccattatacaagaaaatccaagatggcatgtgggatgtatcaaatgagtccaacgggatcaaagttggctacgctgttcccaactcatctggaggtggtgctggctcgtcctctcaggctggtggctgctgcagttgagtggtggcagcaagtcatacaaatgcacaaggttctccctgcagtatcttgatgtttgcctatagctggacccggatgatttgttctttcagccatcatgtttcaatccataagcaaatcatcttcagtgtttaactgtccttttgcaattcacgattactgctccctatgtgtcttctgtaaccaaattgaaatcaagtttatggtattcatttgttcaacatgt

SEQ ID NO: 69673 - DNA, 366 bp, Zea mays
  Clone ID: LIB3078-047-Q1-K1-G7
gcaacctcctcttcgtcgtgcccatgacgctcggttaccttgccatgctccgggggggacgtcacgccggcctcatcaccttcctcggcgccttcggcttcctcatcgcatgtcatgtgtactacatgagcggagatgcgtggaaggagggaggcattgatgcaactggagctttaatggctttaacgctgaaagtcatttcgtgctcaataaactacagtgatggtatcttgaaggaagagggtttacgcgatgctcagaaaaaaaaccgattgactaatgctccttctctaatagaatatcttgggtactgtctcttgtgtgggagccactttgctggaccggcatatgagatgaaagattatc

SEQ ID NO: 69674 - DNA, 256 bp, Zea mays
  Clone ID: LIB3078-047-Q1-K1-G8
cgaatgcctggaacgcggagatcggataccggaagtcatggtgaacaggtccggggggaactggagtatgacgtcgtccccctggagagcactgtgggggcgctacagtgcttcccttatctgggggacgtgcgcatcttcacctacggctgtagcatggctcaagagtgcgagtgtggcggatgccgctgcagctagccttactctcgcccgaagccaccaccagctggaagttctttcacagacgcgaccgtga

SEQ ID NO: 69675 - DNA, 396 bp, Zea mays
  Clone ID: LIB3078-047-Q1-K1-G9
attatggtttcgttccaaggactctttgtgaagacaatgacccattggatgtgtgggtcctgatgcaggagcctgttattcctggttcgttcctgcgagcaagagcaatcggccttatgcccatgattgaccagcgtgaaaaggatgacaagataatagcagtctgtgctgatgatcctgaatatcgtcactacaacgacatcagtgagctgtctgctaatcgcctgcaagagatcaagcagttctttgaagattatcagaagaatgagaataaagaagttgctgtcgatgcattcttgcctgctaccacagctcgagaggccattcagtactccatggatctgtatgcgcagtatatactgcaaagctcgaggcagtagattggaagcaactatt

SEQ ID NO: 69676 - DNA, 401 bp, Zea mays
  Clone ID: LIB3078-047-Q1-K1-H1
cggacgcgtgggcccgcattgaacgtgagcgcgaagtgatcctacgagagatggaggaggttgagggacagtctgaagaagttatatttgatcatctccatgcaactgcattccaatatacatcccttggcagaccaatcttgggttctgcagataacgtcaagtcaatcaccaaagaggacctcgagaactacattgcaactcattatacagcttctagaatggttatcacaactgcaagcaatgttaaacatgaagacattgttgagcaagcaaagaagttgttcagcaagctatcaactgaccctacaacaacaaacatgttggtctctaagcagccagcctctttcactggttctgaggttcgaatcattgatgatgacatgcccctcgctcaattt

SEQ ID NO: 69677 - DNA, 115 bp, Zea mays
  Clone ID: LIB3078-047-Q1-K1-H10
ggcactgctgtgatggggtgggtggagtcgaacgggggggcttggcagccgtctcccagccgggaggtccaccctggtccgactgcgaaactcctacttcaccggagcaggctac

SEQ ID NO: 69678 - DNA, 305 bp, Zea mays
  Clone ID: LIB3078-047-Q1-K1-H11
atcggaaatgctctgcaacaggtctatgtagttgtcgaaggtgttgagaagggtggtggtttggatccaagtgatcctattgttcaattggcagttgtgcttggaggttcagtgacaatttggacaacgtactggctcttcacatacagtggctattctggagacttgtcacctgaatcagcgtttgacttattgaataacgatgacaaagccgtactcattgatgttcggactgaggatttgagggaaaaagatggtgttcctgatctacaccttggggctaggtctaaatatgcaagtgtagc

SEQ ID NO: 69679 - DNA, 380 bp, Zea mays
  unsure at all n locations
  Clone ID: LIB3078-047-Q1-K1-H3
ccgtgcaagcacatcatcctgtagaacattgataacaagcctgtcacaaacagccgctgcacgcatgagatacgcctcgaacaaggccttcanatgctcaagatattcaaggatcatgtcagcaagacttccatcctcgacgactttgccttctacgagagccgccagaagttgatgcaggataagaggtcgaaacagcagcagctccaaaagcaggtctgggacactaggacccccgtttctgtcaccggtgagcgaccgcaggaacctgctaatgggaagcccaatccgtccgtaccagatggtgtcacggcagaggtgaaagcggtgaaggctcccgcagagaacggcatcactgctcctgttgtttcctatgcagc

SEQ ID NO: 69680 - DNA, 190 bp, Zea mays
  Clone ID: LIB3078-047-Q1-K1-H4
ctttagttcctgcccagctgcagggctgctccaatggccaccttgtccgccatggtgtggaacgtctgctactgcaaggcaccaaccctgagctggaaaggaagcggagtaccaagccggattgtggtctccatgtccaccacccgaagaggcctcgtctccctaagacgacgatcccctcggtttcgcg

SEQ ID NO: 69681 - DNA, 337 bp, Zea mays
  unsure at all n locations
  Clone ID: LIB3078-047-Q1-K1-H5
gtcgaggagggcatcgggataggactagtctacgccggtgtgcggtggcggcggtggcgcggtaacgtttccctgcagcttcnatcatgttggtggcggcgccggccacaaaaggctcacccaccaaggatttgacggctgtcgagcccggggacgagtcggtgttcgacgcagggggagctatgggttcggtctcggtttgtcaggcgaatggcaaccaccagccgtcgccgtcgcatgcaaaagcggagcatgtcgtcgaggatggcgttgccgtcgacaggatcaatggcaactaccatccgcttgatctggtggctgatgcggggcatgtcgt

SEQ ID NO: 69682 - DNA, 378 bp, Zea mays
  Clone ID: LIB3078-047-Q1-K1-H6
cgacccatccgttcgaggtgcttttcaatgtgccgggggagtacctgtacatcggggcggccgtctgcagggtggtgttctgcgtcatcgagatgggcaagcccgacaagccgcacaacttcgagccggagatctacatgatggagaggtcggcccgcgacaagctcatcgccgactacaactccatggacatctgggacttcaacgagaagtacggcgagctctgggacttcaccgtcaacaccagggacgacatcgtcaagtcgacctagatgcattgcgtacaccgctcgctgcccttcagatttgtgcctcacagcaaaaaaaaccctgtgaaaggaagctgtagctgctaggaaaatctcttgaataaaaagg

SEQ ID NO: 69683 - DNA, 377 bp, Zea mays
  Clone ID: LIB3078-047-Q1-K1-H7
ctgaggatgtgggcgagctcagccgttcaatgcgctcaagctctcggcgggcggcgccggagcccgggctgctgccttctctatctccaggttcttctccactgttcacgatgggttgaagtacactcagtctcacgaatgggtcaagacgacgggcgacgtcgccaccgttggcatcacggaccatgctcagggccacctgggagaggtggtgttcgtggagctgccggaacaccgcacgaatgtggccgcgggaggacccttcggcaacgtggagagcgtgaaggccaccagcgacgtcaactccccgatctccggcgaggtcgtcgaggtcaatgccaaactgtcagagacgcccggcctgatcaacacgagcc

SEQ ID NO: 69684 - DNA, 139 bp, Zea mays
  Clone ID: LIB3078-047-Q1-K1-H8
cagcctctgccagccacctccccgtcgctctcacgctctttgtgcccggcggggggggtcttccgctccagctgactccttccgtctgacgcacatggccttcatcgccagatcttgcggtctattcttcgccatgcct

SEQ ID NO: 69685 - DNA, 388 bp, Zea mays
  Clone ID: LIB3078-047-Q1-K1-H9
cccacgcgtccggaacaatttaagattgagataccaaagatacctgcatatggcacgggaactggagatttgacaactgctctcctactaggatggagtaataaatatcctgatagcctcgagaaagcggcagaactggcagtttccagtttgcaggcacttctgaaaagaactgtggaagactataaaatggccggcttcgacccatcgaccagcagcttagagatccggttgatccaaagccaggacgagatccgaaacccaactgttacatgcaaggctgtgaagtatggaagctgaatccatagtacccccactgacaaaggtgccaacaataatgagcagtgcctgcaccgtcgataagcgggtgcacctacttccatgactc

SEQ ID NO: 69686 - DNA, 379 bp, Zea mays
  unsure at all n locations
  Clone ID: LIB3078-048-Q1-K1-A1
ggggctcaagggtgaccccacgtacctggtggtggagcaggacaagacgctggccaggtacgggatcaacgccgtgtgcactcacctcggctgcgtcgtgccgtggaacggcgccgagaacaagttcatctgcccatgccacggatcccagtacaacaaccagggcaaggtggtccgtggaccggcgcctctgtcgctggccctggttcacgccgacgtcgacgacggcaaggtcctcttcgtcccgtgggtggagaccgacttcaggaccggcgaggacccgtggtggaaggcatgaggatgatccgaaaccagcggtgctcagtgctcacacatgagacctacgtatgcctncggtccttgtgatgaggaaatatgc

SEQ ID NO: 69687 - DNA, 438 bp, Zea mays
  Clone ID: LIB3078-048-Q1-K1-A10
caacatccaggccgggaagcagattggcctccacacggtgctggtgggcaaatcgcagcgggtgaaaggcgcggaccacgcgctggagagcatccacaacatcagggaagcgctgccggagctgtgggaggaggccgagaaggcggaggacgtgctctaccccgaacgcgttgcgatggagacctcggtcaccgcgtaaaacccctgaatgcctccggtgcaccgtcagccgaactttctcgacatctccaggaccgcatcaacgatcacatgtcactcgctccccgagccagggccggtgatgatctcgcgctggaactgaatccaccagcaatggccgggccgaggatcgatttccgacagcaggaagggtgcagcatgtaaagggggaacagatgagatcatgtttgggtggtcccccgttgtatatgtagttat

SEQ ID NO: 69688 - DNA, 365 bp, Zea mays
  Clone ID: LIB3078-047-Q1-K1-G4
cccacgcgtccggtcgccaacgggtgcggcacctacatcagccgcgccgccgcgcggccgcatcaagtgcggcgtcgccctgccttacaagatcagcaccaacgttaactgcaacacgattaattaaatgaggcgtcctgtgcgcgtccgggcgaggaatgcatgcatggcggagagtaataaagtaatgctactggtattttaagctagatcgaggtgtgcctgtctctagtcatttatggtgtttagcaatcgtctacacagttcgtaaacggtgtatcgtggatgcatgttgccgcgagcagagtacgtatgcatgaaccgatgtgtgcgcttctgtctgtgtactctctctatgtagtaat

SEQ ID NO: 69689 - DNA, 361 bp, Zea mays
  Clone ID: LIB3078-048-Q1-K1-A11
gaaagaggtcgcagctcggatgagagagatcaccgcgctggggcctgatggggcaagtccgaaggtgtcaccgctctggtgggctgagcttgagattatgacttctgagagctgagttcgactcgtgccagaagatattgtttctcctagtgtgactgagaattctttgagctactactggctgctgctaatcttgtttgtggaagtggtgattaggtagactttgttatgtgtgcagaattgcatatagggattggtattgtacttgtacatgtcaagaaggtttaacacacaacatactgatatgcaggcattccagccaggtgagcaatagaaagcatgtgtggcttgtttttgctgc

SEQ ID NO: 69690 - DNA, 366 bp, Zea mays
  Clone ID: LIB3078-047-Q1-K1-E8
tgactcttgggctgactcgtttttctggccgacctctcccgttcgcaggtgggggggcactggcgagaggcgtcgtccgtctctaataatctacttcagagcacggtgaaggcggcgtggatctcttggacaaccttcctggtgctggtggtgccactgatcatcgtgatggaccgggagcagcagctcaacgacctttagctgcatcagcagacgcttctgggctgtgcctcaacttcgacggcgaccaagttgattgatccgtgcatcgaccctttcgcatccacccctctcgatctgtagaggtatctgatactatcaagttcatcattcgagttactatcaaggtcatcattcgagttacta

SEQ ID NO: 69691 - DNA, 394 bp, Zea mays
  Clone ID: LIB3078-047-Q1-K1-E9
ctcgggtgcgtgttcccggagctgctcgcccgcaacggcgtcaagttcggcgagggcgtgtggttcaaggccgggtcccagatcttcagcgagggcgggcttgactacctcggcaacccgagcctgatccacgcgcagagcatcctggccatctgggcgtgccatgtggtgctcatgggcgccgtcgaggggtaccgcatcgccggtggcccgctcggggaggtggtcgacccgctgtaccccggcggcagcttcgacccgctcgggctcgccgacgacccggaggcgttcgcggagctcaaggtcaaggagatcaagaacggccgcctcgccatgttctccatgttcggcttcttcgtgcaggccatcgtcaccggcaagggtcccgttgaga

SEQ ID NO: 69692 - DNA, 383 bp, Zea mays
  Clone ID: LIB3078-047-Q1-K1-F1
ggataaagtgacgaaccctctattctagaagaggccgaagcagttcggcatcggcggggcgttgccgcccaagaaggacctgcaccggttcgtcaagtggcccaaggtcgtgcgtatccagcgacagcgccgcatcctcaagcagcgcctcaaggtaccaccggcgctcaaccagttcacccgcaccctcgacaagaacctcgctacgaacctgtttaagatgcttctcaagtaccggcctgaagacaaggctgccaagaaagagaggcttctgaagagggcccaagctgagaatgaaggaaaaactgttgagtcgaagaaaccaattgttgtgaagtatggccttaaccatgtgacttacctcatcgagcagaacaaggctc

SEQ ID NO: 69693 - DNA, 93 bp, Zea mays
  Clone ID: LIB3078-047-Q1-K1-F10
gccacgcttccatagaaacgagagggtcgctccaaccgcagtaccggttgggggggctgagttcgacctcagactgcctatctactgcctatc

SEQ ID NO: 69694 - DNA, 297 bp, Zea mays
  Clone ID: LIB3078-047-Q1-K1-F11
gatcgcgagcggcctaccttttttttttttttttttaacgacggtaggtttggaggtgctgaaactgaagtatctgtgttacatgtgtatgttcacagcagatgaacttttactagcagatgaactttacagcgttacatgtgtatgttcacggcagcaccctgtgtgtatgtgtatgtgtatgcgcctgcgcaacctactactttgcgggctcctactccccctcctcctgctttcagaccggaaggatgccttgcccatccagcctcttgtatacccagaacaccacgtacttgg

SEQ ID NO: 69695 - DNA, 365 bp, Zea mays
  Clone ID: LIB3078-047-Q1-K1-F12
gcgctttcttcgtgttcatggatgaatttcgcaaggagttcaaggagaagaaccgtaagaacaagtctgtcgctgcggtggggaaagctgctggcgacaggtggaaatccctgagcgagtcggacaaggctccctatgtagccaaggctaacaagctcaagctcgagtacaacaaggccatcgctgcctacaacaagggcgagagcactgcagctaagaaggctcctgccaaagaggaagaggaagaggatgatgaacagggtagtgaggaggatgaaaatgatgacgagtgatggagctcctcgagacaatggaccgtgcttcatccaacaatggagcggctacacaaggccccgtggcgatca

SEQ ID NO: 69696 - DNA, 183 bp, Zea mays
  unsure at all n locations
  Clone ID: LIB3078-047-Q1-K1-F2
gcatatcccccggagaccgcgctgncgtggttcaagacgggcgtcattcctgccgcgggcacctacaactactgggccgactcctacacgctcttcgtcttcaacatggcgctcatgggcttcgccgagcaccgtcgtcttcaagactggtacaacccgggctccatgggcaaagcaagtact

SEQ ID NO: 69697 - DNA, 305 bp, Zea mays
  Clone ID: LIB3078-047-Q1-K1-F3
tcgattcaagaaaatttttttaatccatgtggttaaatctaatctaagggggaaggtctggcgaacatccattgtaataacgtcacatagtcatatgctgtgtacaagatgcacggtgagatgagctttgttgtattggggcaccctattagatggtgttgttgttgaaaagcacggaatggtggctgctggagccctcgtacggcagaatactaggatcccttgtggagaggtatggggagggaaccctgccaaatttctgatgaagctcacagatgacgagatcagtttcattgcggaatcag

SEQ ID NO: 69698 - DNA, 369 bp, Zea mays
  Clone ID: LIB3078-047-Q1-K1-F4
ccttccaaagtggttcagttgatatcgttactttcaaggggtcaaaagtgaaaacgattaaagaagtctggatcggtcttgaatcaagttcatggagattagatggtttgagcttgaaagtaatacatggaccagttggtcagcctaaagaaataaatggaactccagaacagaagttcagcggtttgcagtacacttttgagaacgtaaatgtgttccttggagatgatggagcttcagtagctgaagcaaggccgacggctatcactgacctctcaggagtcggcctttctgatcttcaacaagggctgttatcctcaagaagcaaagctttaagcattaaggaaagtagagaggatgggttgagag

SEQ ID NO: 69699 - DNA, 383 bp, Zea mays
  Clone ID: LIB3078-047-Q1-K1-F6
agccttccgcaacccttccgagggattgccactttttctacatttccagttcgctatgtggaaggtcgacgagcaacagttacatgaatgggaatcgaaagtatgcagaatgcagggttcatcaaatgggtaccaaggaaaaaaaatgcctcccaagcctgcattgtttgccttctgtttgaggcctcgtggactcgatgtaccatacaagggaccaaagcagcgttctcataagaagcttatgtctacaggctgccatagcttttcaagacagcatgatggcttttaccggcaagtatcaagtaggagatacaatgaatgcactgtggatgggcggatatgcgaattatatgacattggttctctttattccctaacagggt

SEQ ID NO: 69700 - DNA, 142 bp, Zea mays
  Clone ID: LIB3078-047-Q1-K1-F8
gggggtcccttctctcaaaaatcattttataacaagccaaactaacaagcctgagaagggtcttttcaataagggggcgccctacacccataattctaccgaagaaagaacgctcctaggcgatgacagggattactactgc

SEQ ID NO: 69701 - DNA, 406 bp, Zea mays
  Clone ID: LIB3078-047-Q1-K1-F9
cccacgcgtccgctgggatgtcgggggtcaggacaagatcagacctctctggaggggttacttccagaacacacagggtcttatctttgttgtggatagcaatgaccgtgaccgtgttgttgaagccagagatgagctgcacaggatgctgaacgaggatgagctacgtgatgctgtgctgcttgttttcgccaacaagcaagatcttcctaatgccatgaatgctgctgagatcactgacaagcttggattacactccctgcggcagcgacactggtacatccagagcacttgtgccacaactggcgagggtctgtacgaaggcctggactggctgtccagcaacattgcgagcaaggcttgaatatcaaatgcgaactgactaggagctccggatgtatcatgg

SEQ ID NO: 69702 - DNA, 397 bp, Zea mays
  unsure at all n locations
  Clone ID: LIB3078-047-Q1-K1-G1
gtcggtctggttgacaaatgtctaactggacagtagtgctcccttgtgttataggtgtagaattatatttggttataattcacaaatctatatgtgtctgcgcaattggtacagttgtgaaccagttagccagagcataaaaggcttgtttacatgaagagatacatggctggtgaccaaccggttgaagttgcggttcacgttgatgcaaatgcagcacgcccgacaccttacacctncgaactccgatgttgctgctgatgcccgcactgtacttgtaacaatctttcaaaggcaaatggaactgtgggatacatgtggcagtgtggcacttcgatgatgtgctcttgtaaatatttttttaggaaacaatatgctcattcnnctactgttttat

SEQ ID NO: 69703 - DNA, 334 bp, Zea mays
  Clone ID: LIB3078-047-Q1-K1-G10
gttgtgctctctctctctattcgttccccgcctcaccccgagccagccgtgtggcgagggtttcgccgccgccgccgccgccgccgtcgctatgcctcgccgcagctcaggaaggtctgccccacgcccagctacccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaagtccccggaccattcagcatgagact

SEQ ID NO: 69704 - DNA, 383 bp, Zea mays
  Clone ID: LIB3078-047-Q1-K1-G11
aggaggttcgccaggccggcctggtgggcacggccactggccttgccaagtggggcatcgcccgcgccgagccaaaggcccgggagctctacacccgctacgagcctgtggcagagcggcgtgccgccgaggcctgggtggccctgaaccgtctccctctggtgccctcggtcaccagggccgtcctccccactgccgcacagatctctgccaggtacaattcggcggtgcgtgatggtgccaagcgcgggaacgccgtggccacctatctcccgctggtgcccactgagcggctcgcccgcgtgttcatgtaccccgtggctgacgttgctgcagcaccaaagatgcagcccattccttcccagtagaagatgaaatggaat

SEQ ID NO: 69705 - DNA, 407 bp, Zea mays
  Clone ID: LIB3078-047-Q1-K1-G12
cccacgcgtccgaccacgcgttcgtttacccacgcgtccgcgacgtcaggtgcgggggtggcctgtggtttgacccgctcggctggggctacggctcgtcggagaatatcaaggagctgcgcaccaaggagatcaagaacggactcctcgccatgctcgccgtcatgggcgcttggttgcaggccgtgtacaccggcaccgggcccatcgacaacctcttcgcccacctaggcgaccctggccacgccaccatcttccaggccttcacccccaaatgaggagctattatgaactttgcagttcgaggagtgctaccacacatgcatgcattgttaggtttgatggacgatatggaactctcttcttttggtgggggcggactactgagtcgactgtcaacgatgatg

SEQ ID NO: 69706 - DNA, 412 bp, Zea mays
  unsure at all n locations
  Clone ID: LIB3078-047-Q1-K1-E6
agccgtcggttggttcaattgatcctggaaaagatcgagcttctttggcaccacaaggtcgaggatgtcttgcaactgcggatcaagctgcggctgcggctcaagctgcaagtgcggcaagaagtaccctgacctggaggagacgagcaccgccgcgcatgccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacatangtattgggtggtgtgtgtg

SEQ ID NO: 69707 - DNA, 254 bp, Zea mays
  Clone ID: LIB3078-047-Q1-K1-G2
agccttccggttttttgggccattatattttttctgtccttctaaaagtggccttatactgtctgcaggagcctaacttaaccaaactctatattcaaacctaactctttaaacagtgaaggctgcagtccaaaaccctggcaaaatatggtttggcccggttttatgcacgatttgttgggacattgagctcaccaatacgaataagtggacgtgcaaaacattattctagcactggtgatgtattatagaca

SEQ ID NO: 69708 - DNA, 369 bp, Zea mays
  Clone ID: LIB3078-047-Q1-K1-G3
ggaacccttccggaggattaaggctgtcaggcagatgattatggctcccacgcttgagcggatgcatcatgcgctcgaccgtctcttgccgtatcagaggtctgacttcgaaggcattttccgtgctatggatggactcccggtgaccatccgactcctggacccttccctgcacgagttccttccagaagggaacatcgaggacattgtaagtgaattatgtgctgagacgggagccaaccaagaagatgccctcgcgcgaattgaaaagctttcagaagtaaacccgatgcttggcttccgtgggtgcaagcttggtatatcgtaccctgaattgacagagatgcaagcccgggccatttttgaagc

SEQ ID NO: 69709 - DNA, 409 bp, Zea mays
  Clone ID: LIB3078-047-Q1-K1-C8
cgtgaacccgccgccgacgcatcagcaggagacgcgccaaggagtgcccgcaaggaggcgactatgagggccaagtggaagaagaagcgcatgaggaggctgaagaggaagcgccgaaagatgaggcagagatccaagtacgctgatggggattgtggatggtggtgtcggcataattgtgttacgtttcttcgatgcgtgagttcatggagagatgtcacatcctatttcgtcgtcaccgtttgccatgggtacaatggctcgtattggaaacctgcacttcagtaagccatctatcgtggtttctagctatatccagagttttgtgctaagacaaatcagtcagtccgtttgtgaacctattatgatggagctttatttgctgctaatatcgacctaccttgtaagt

SEQ ID NO: 69710 - DNA, 372 bp, Zea mays
  Clone ID: LIB3078-047-Q1-K1-C9
gcgactagggacagggaggcaggatactcctgtcaggccgcgacgtatccgtggggtcttgctctacccgccatcctctgcttatcgtccacctgggattagatccatttcttggtacctgagcgttcgagtgaaatcgatctatccaaggtgcggctgacgcggcttattcacgaattttccgtgttctttggaaagccgccatgaacgagtggattcgccaagccgaggtgtgggtgctccaatccgtgagctggatccgtcatcagcccccggagcagatctatgtcgcggtcacggtggtcagcgtcacaatcctgctgcttatcgtagcatcttatctgaaatcctgtaaaccaagcaccatagtgc

SEQ ID NO: 69711 - DNA, 247 bp, Zea mays
  Clone ID: LIB3078-047-Q1-K1-D10
ctgtacttgtgttgtgttgtgttgtgtgctgcaagaagaagaggaggaggaagaggatgtgctgagaagcctgccagcgcgctttacgacaagcatatatgggggagatcaccaagcctttgcgaagcagaagcttccgaagatggcctacgactactacgcgtccggcgccgatgatgagtggacgctgcatgagaacatggaggccttctccaggatcttgagcagcggttgatgagataagatt

SEQ ID NO: 69712 - DNA, 318 bp, Zea mays
  unsure at all n locations
  Clone ID: LIB3078-047-Q1-K1-D11
gtcttcttgtgttttctagcgtttttctctgccagaagaacaggattctgcggaggattttttaagagggccgggaaggccctccacnacaagcttataaggaggagctcaccaagccttctcgtatcataagctttccaagttggcctactactactacgcttgcggcgccgaagttccgtggtcgctgctcgagaacatggaggccctctccaccatctcgatctcatcttgatgagtttagattgcctagaaacgtactccgtggctggcttcttatgtctaacctggcttcttaagtagcttcttcttattctt

SEQ ID NO: 69713 - DNA, 377 bp, Zea mays
  Clone ID: LIB3078-047-Q1-K1-D12
gcggacgcggatccggcggcggagcggagatggcggagaagaagcgaggcgccggcgctcgcaaggatgaggtggtgacacgcgagtacactatcaacctccacaaacgcctccacggatgcacctttaagaagaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtgtcagaattgcccgcaaccggaacgatgaggaagacgccaaggaggaactctactctctggtcacagttgctgagatcccaccggagggtctcaaaggtttgggaact

SEQ ID NO: 69714 - DNA, 412 bp, Zea mays
  Clone ID: LIB3078-047-Q1-K1-D2
gaccaacccttccggttgaggagaattccgcggcgttctggacgacaatagcgccgaacgtggactattgcagctcgtctgtggcgcggctgatcgcccgggatcggggcagctagtgaggggcatcatctggtgcggtgacatcacggcggggggcctgcggcgtggggaagaagtgatgaagaagagcgtgggtcccagcacgaagccgacccatgtgaagcccagcactctcagaaggatgaagagggctaggagggttacaaagatgtccaacagggtggcaaactcaatcctgtctggggttctgaaagtcactggctttgtcacaagcaccgtgttgaactccaaaccagcacaaaagtttttcaagttaatgcctggtgaagttattcttgcttcacttgatgga

SEQ ID NO: 69715 - DNA, 412 bp, Zea mays
  Clone ID: LIB3078-047-Q1-K1-D4
agccgtcggttccgggtgacattccgactcctgtaccttcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattg

SEQ ID NO: 69716 - DNA, 419 bp, Zea mays
  Clone ID: LIB3078-047-Q1-K1-D5
agccttccgaggaggtccaacttccgacgacaactactcaggcgccacacatggcatcccatctgtcggccgccgtaccccggttccacggcctccggggctacgccgcgcacaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgactgcggggctgaagctggaagcgcgcgactccggcctgcagacgggtgaccccgccgggttcaccctcgccgacacgctggcctgcggcgccgtctgccacatccctcgcgtcggcatcgtgctcgggctc

SEQ ID NO: 69717 - DNA, 86 bp, Zea mays
  Clone ID: LIB3078-047-Q1-K1-D6
taagatgggtcgtggtattagcagtgggggtggtcagagttccttgggctatctctttggcagtgacgaagctccaaaatcatttg

SEQ ID NO: 69718 - DNA, 344 bp, Zea mays
  unsure at all n locations
  Clone ID: LIB3078-047-Q1-K1-D7
tgacggacgactgaaccaccgacagacaacatggccgcctccgcctccaccggctgcggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttncccacgcc

SEQ ID NO: 69719 - DNA, 360 bp, Zea mays
  Clone ID: LIB3078-047-Q1-K1-D8
ctcgcccgcaacggcgtcaagttcggcgaggccgtgtggttcaaggccgggggcgagatcttcagcgagggcgggcttgactacctcggcaacccgagcctgatccacgcgcagagcatcctggccatctgggcgtgccaggtggtgctcatgggcgccgtcaaggggtaccgcatcgccggtggcccgctcggggaggtgggcgacccgctgtaccccggcggcagcttctacccgctcgggctcgccaacgacccggaggcgttcgcggagctcaaggtcaaggagatcaagaacggccgcctctccatgttctccatgttcggcttcttcgtgcatgccatcgtcaccggcaagggt

SEQ ID NO: 69720 - DNA, 338 bp, Zea mays
  unsure at all n locations
  Clone ID: LIB3078-047-Q1-K1-D9
accgtctccggcctcgccggctctcttcctggccagccgcccggcgttctccggcagcttcactcggggcagccgggtgtccgcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaagagctggcccactttctcacgcccccgcccgtcacctnccagttctggcttgggctagtgacgt

SEQ ID NO: 69721 - DNA, 375 bp, Zea mays
  unsure at all n locations
  Clone ID: LIB3078-047-Q1-K1-E1
ggaaaacccgcggngagggatgcgtncgcgcactcgtncgaaaaaaaaaaaacctcatttttaaaaaaaaaaaaaaaaaaaaaaaaaaagtttgtaaaaaaaaaaatacccccccccaaaaaaaaacaaaaaaaaaaaaaaaaccccaaaaacggcaaaaaatttaaaaaaacaaaaccaaaaaaaaaaaaaggggggagcccttttaaaagaaaaaaagataccaaaaccctgttaccaacttaaaattttaaaaaaaacccaacaaaaaaaaaaaccaaaagcccaaattaaaaaaatcgccaaaaaaaaaaaacctttccaaaacaaaaaaaaaagccatggaaaaaaaacacccttcaaaaagtaagcaat

SEQ ID NO: 69722 - DNA, 398 bp, Zea mays
  Clone ID: LIB3078-047-Q1-K1-E10
cccaggccggccaagccccgcgtagctaccatggcggcggcctcccgtcgagcggcggtagcggcctcccgtcgagcaaagcgcttggaagtacgctagtttgttgtcatgaagaagtcattcaagttccttccattggtgcataaggctgcaacaccatctagtggagggtgttctggacaaagaaagcttgtaccttaaaataggaggatacaagaagctggagtggttgtctgaaggcttttgaactgcttgaaacattagtgtagctttggtgcttttgtgactgatcagctctggagcagctagagcgatatagttgtgggcttttgaacaatagttagagtgatagttagagtgatatgaaacattagtgatctagttgtgaatgatattat

SEQ ID NO: 69723 - DNA, 384 bp, Zea mays
  Clone ID: LIB3078-047-Q1-K1-E12
cgtcgatctcctctgaccggccgctgtggttccccggcgccgtggcgcccgactgcctcgacggctcgctggtcggcgactacgggttcgacccgttcgggctcgggaagcccgtggagtacctgcagttcgaactggactcgctggaccagaacctgtccaagaacgaggccggcggcatcatcggcacccggttcgagtcctccgacgtcaagtccaccccgctccagccctacagcgaggtgttcggcctccagcggttccgcgagtgcgagctcatccacggccgatgggccatgctcgccaccctcggcgccctcaccgtcgagtggctcaccggcgtcacctggcaagatgctggcaaggtggagctggtggatgggt

SEQ ID NO: 69724 - DNA, 65 bp, Zea mays
  Clone ID: LIB3078-047-Q1-K1-E2
agccttccggcctaccaaaaaagccaaaagcccgttaggttacttcgctgcctgaggagccccgg

SEQ ID NO: 69725 - DNA, 395 bp, Zea mays
  Clone ID: LIB3078-047-Q1-K1-E4
tcggccaagccttccaaaaaaggaggagatggagcacaggcccaagcagcacctcggcgagggcggcgccatcgccgccggcgccttcgcactctacgagaagcacgaggcgaataatgaccccgagcacgcgcacaggcacaagatcacggaggaggtcgctgccgcggcggccgtcggcgccggcggctacgtattccacgagcaccacgagaagaagaaggaccacattgacgccgatgaggccagcggcgagaagaagcaccaccacctcttcggctgaccgtagtaccggccggcgcgcgaccgagctagctagcttcggcgcacacaaccacacacctgtttaattctgtactgcatgcgtgtgtaatttgatggttcacaataatgag

SEQ ID NO: 69726 - DNA, 289 bp, Zea mays
  Clone ID: LIB3078-047-Q1-K1-C7
ctcgtctttctcacgagccacaggctcaggcaggctctcgagctcagtccacccgtcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcggggaggaagcggcgcggcggctcgttc

SEQ ID NO: 69727 - DNA, 403 bp, Zea mays
  Clone ID: LIB3078-047-Q1-K1-E5
cccacgcgtccgcccacgcgtccgcccacgcgtccgcggacgcgtgggttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaactcgctcatgatgcacgggcgcaacaacggcaagaaggtcatggctgtccgcatcatcaagcataccctggagatcatccacctgctcaccgatgccaaccccatccaggtcgtcgtcgacgcgatcatcaacagtggaccccgtgaggatgccacccgtattggttccgcttgtgttgtgagggagc

SEQ ID NO: 69728 - DNA, 392 bp, Zea mays
  Clone ID: LIB3078-050-Q1-K1-G6
agcaaaggcagcacactcagctatccagcaaaagagatcgagacgcaggagtcatgggcaccgtcagcgccgccgtggtgaccaccatcgttgcccgcgccgcgatcgccaggcccaatgctctagggctgcctgcgctgagggcgaggagcgagagggtgcggtgcagctacgccaaggacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctggtccctctacaccatctacacc

SEQ ID NO: 69729 - DNA, 358 bp, Zea mays
  Clone ID: LIB3078-050-Q1-K1-G7
gctggtgctgccggacgtcgcggaggccgcgcagtccggcgggctcacgccgtcgctgaagaacttcctcctcagcatcgtgtccggtggggtcgtgctcgttggtattgtcggcgccgtcgtcgccgtctccaacttcgaccccgtcaagagggcctgatcggaatccatcgtatcgatcgtctcgcctgtgtcctgtcctgtgcctgtgctgtctgtatcgactggtggtgctatatcccctgtgtgttaattgattttggagaatgttcagacgtatatctatgtctaagaaatggagttcgagttaaactttgctgagacttctcttgtctatataatattattagtaggaatc

SEQ ID NO: 69730 - DNA, 379 bp, Zea mays
  unsure at all n locations
  Clone ID: LIB3078-050-Q1-K1-G9
ccaattgtcacttgctctccctccaacaagctaattaaggccggtcatccctcttctaggtcgtttcattatccatggcggaggagaagcaccaccaccaccacctgttccaccacaagaaggacgaggagcagctcgccgccggcgggtacggcgagtccgccgagtacacggaggccacggtgacggaggtggtgtccacgggcgagaacgagtacgacgagtacaagaaggaggagaaggagcacaagcacaagcagcacctcggcgaggccggcgccatcgccgtcggcgccttcgcactctacgagaagcacgaggcgaagaatgaccctgagcacgcgcaccgtcacaagatcgangaggaggtcgcggcggc

SEQ ID NO: 69731 - DNA, 382 bp, Zea mays
  Clone ID: LIB3078-050-Q1-K1-H1
cgacgcatacatgcggcgagggagcggtagaagtcagtaaattctgtcgctccaatccggacgaggagatgccgcggatccctctgatcaagttccccaagcggaatctgaaagccccatccgcgccagtgccgtcgcaacccgcagatcagcacgcgaccctcatgtcccggttgggggctaaagcagaggcaccatcttctggagggattaaaaattaccgctttagttcagatgtgccttccgcaccgtcgcatactgctgtacgaggtcaagcttcactccttcctaagcgtaaacctctgactgaagaagagattgaggctattatgctgggtggctccatctgatatcacctcatatgaattggaatttctaggaa

SEQ ID NO: 69732 - DNA, 390 bp, Zea mays
  Clone ID: LIB3078-050-Q1-K1-H10
ccgacgcgtccgctcgctttatcaaccattcatgtgatggaggcaacctgcacccagtgctggtgaggagctctggtttgttgctcccaaggctctgcttctttgctgccagggatatcgtggagggagaagagctcaccttcagttacggtgatgctagggttaggcccaagggtttgccatgcttttgtggaagctcgggttgttctggtgtgcttccttcagaagaaacttaagaactgatgccatcaccttggatgtcttacaaatgagtttgattctatttctgacttcgcaataacatggcttcatgaggaattgcctggcccattcttttagccatactgtaatgtgtgcaacatacaaaaaacaagctgtcagtttttggtg

SEQ ID NO: 69733 - DNA, 394 bp, Zea mays
  unsure at all n locations
  Clone ID: LIB3078-050-Q1-K1-H11
tttgccggaggctcatttttttgcaggaatcctcctgtgaggatatctgtttcttgagcgcttgncagccattgctatggcactctgccccctttgtcccaaactaagccctcgtgatcagtcgttccaccatgcagtttctcaagttgtgnttgaaacccaagtatctgtgtcaagtgtgtgttcttttccggtattcctgggtatagagctgcagacatcaacactcttttgattgcaattgtagcaagtccagttgtcggtggttgcaactctccatccagaattgcagacatcaacattcttttgagtgcaattgtatcaagtccaacctgtcggtgtctccattcaaagaaacttagctncatgtctttgatgtctgggtgcctgcaat

SEQ ID NO: 69734 - DNA, 477 bp, Zea mays
  Clone ID: LIB3078-050-Q1-K1-H12
aaccggtgcggagtcccaggcgtgacgccagacgaaccgctgtgtcacacacccactcacaacacgggggccgaaccggcggagggaccataaaggggtgctctctccgtccgaagtgctctctgaaattccccccaaatatcccagccactgccgtcgtgcagtcaaagtgtcaaaccatgccggcagtagcgttcgcgtcggctcctgccatattcgcctccgcctccgcgcgtccctgccgcagcgcggctccgggcatcctttcctccgactccgggcggccccgccgcggcgcgcgtggcgccgtccagtgtgaggtcgcctcctcctcggcaccgtcggcggctggaccccaggccgtccggtgggcccagaggaccgtggtcatcccgccacagcgccgcgggtgccacctcatcaccaacaagatcgtaaatgagatagggaaatgacctgccgacttcaagtgtggca

SEQ ID NO: 69735 - DNA, 239 bp, Zea mays
  Clone ID: LIB3078-050-Q1-K1-H2
tgccagcgtaacatgctgcgtgcgactaacgctcgtgaaagtctaaggtgagcttgcctagagcgcggtgctgcagccgagactgaggacgaagcttggccatcaaatcatgctgaaggaattcatgctgtataggcctctccgtagctatgaacagcatactccaacccttgcttcgctagatccagcgggtgacattatcaggacgcttgtagtggggctctgacttatgcatatca

SEQ ID NO: 69736 - DNA, 408 bp, Zea mays
  Clone ID: LIB3078-050-Q1-K1-H3
caaggatggagattggatgcttgttggcgatgtaccatgggagatgttcgctgactcttgccgcaggctcaggatcatgaaaggatcagatgcaattggacttgctccaagggcagctgataagtccaagaatcgcaactagaatggttgcttcttacagtccagagcaagagggagatatccagtgactgtagggatctttgtggaagccggaaaacgtctaacagtttcaagaagaattctgccttatggtctgtaccacatgtttttgctgctacgcaagtaaagaactccacgtctgtcaatgttagttttacaacatcgtctacggacaaaaaaaaaaccccccgctatttgattgttgctaagccttcgtacgacgtgtaaatggtttggtacaatgagtgc

SEQ ID NO: 69737 - DNA, 370 bp, Zea mays
  Clone ID: LIB3078-050-Q1-K1-H4
cgcacgggagccacggagagcaaaggcagcacactcagctatccagcaaaagagatcgagacgcaggagtcatggccaccgtcagcgccgccgtggtgaccaccatcgttgcccgcgccgcgatcgccaggcccaatgctctagggctgcctgcgttgagggcgaggagcgagagggtgcggtgcagctacgccaaggatgccaagaacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggat

SEQ ID NO: 69738 - DNA, 400 bp, Zea mays
  Clone ID: LIB3078-050-Q1-K1-H5
cccacgcgtccgcagaacctggtcaagctgatcagagtgctcggcgacgcccaggtcggtggtgacgatatcacagaggagctgaagagcgtgctgaacagcgctgcccctgaagtacgccgtccttactgcaactgtctgatcgatgtatgccgcaaccacggcttccctccacagagggcaagggaagtcttccaccttgcccagacctatggtttgtactccaagcttcagagcaggaaggacgaggagtggtcgctggacctgcggtcgctctcggttggtgcagccaagacagcgtttgatgactggatgcagactgtctcggagcgctgggcgcagcagaaggacttgccagagtccttcagcgtgtacaccggatccagcacccacaagtttg

SEQ ID NO: 69739 - DNA, 276 bp, Zea mays
  Clone ID: LIB3078-050-Q1-K1-H6
ctgactctttcttttaacctgtttattcttttcatattgcttttttactcttaggtggttttttactatattacatatgatcttattatcgttctttaacattttctttccttaattactccttccttactgcaactgtctgatcgatgtatgcctaaccacggcttccctccacagagggcaagggaagtctttcaccttgcccagacctatggtttgtactccaagcttcagagcatgaatgactaggagtggtcgctggacctgcggtcgctc

SEQ ID NO: 69740 - DNA, 401 bp, Zea mays
  Clone ID: LIB3078-050-Q1-K1-H7
gaaaggccgagaagcgctttatccggccgtacgtagcgataagagtggtgcacccgtagcggcacggcatggcggccacggcgtactccgtggcgctcctcggcggcgcacgcctgccggccgccttcctccctcgacgcagcagcgtgtgccaccaccagcttcgcctccaagacgcaccgaggctgatctccctgcaccgtgccagggccgcttccgaggacacgtcggcctccggcggcgacgagctcatcgaagacctcaaggcaaagtgggacgccgttgaggacaagcccaccgtcctcctgtacggcggcggcgccgtcgtcgcgctatggttgacgtccgttgtcgtcggcgccatcaacgccgtgccgctgctccccaagatcctggagctc

SEQ ID NO: 69741 - DNA, 243 bp, Zea mays
  Clone ID: LIB3078-050-Q1-K1-H8
gcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtagacggatacagcccaatctacaacgaggatgactggtctcacaccggagacgtatacgtcggtggaaccactgggcttgtgatct

SEQ ID NO: 69742 - DNA, 381 bp, Zea mays
  Clone ID: LIB3078-050-Q1-K1-H9
cccacgcgtccgcccacgcgtccgcgccaagcaacaaagagggaccccgcatccatggaggtggtgggcggcgtgtcgctgaggccgtcgccagcgccggcgcgtatccggactaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgctgctgccgaaaatcgaggacgacggcaacccgcgattcgtcatcttcatccgcaccgccaatgtctacttctggtacccgctcaacatcatcacgggcggtacgacggcgaagatcatgctc

SEQ ID NO: 69743 - DNA, 383 bp, Zea mays
  Clone ID: LIB3078-051-Q1-K1-A1
tcgtacccttcctctcccaacccacgcagcctcactagggtttagcggcggcggcgagatggtgcagcgcctcacgtaccggaagcgtcacagctacgctacgaagtccaaccagacccgagtcgtcaagaccccaggcgggaagcttgtgtaccagtacaccaagaagagggcgagcgggcccaagtgccccgtcaccgggaagaaaatccaggggatccctcacttgaggcctgctgagtacaaaaggtccaggttgcctaggagccgcaggactgtgaaccgtccttatggtggagtactctctggaattgctgttagggagagaatcattcgtgccttcttggtcgaggagcagaagattgtcaagaagggtcctgaaa

SEQ ID NO: 69744 - DNA, 367 bp, Zea mays
  Clone ID: LIB3078-051-Q1-K1-A10
ggacggctccggtgggccacggacgggggcaagtacaaggtcaactacgggtacgcgcggttcgcgtccgacttctcggagctggccgtcgtcggctcccgcgccgacccggtgctccgcgtcccgcgccgggacggcgccgcccaccaggacctcctcgcgctcatgacggccgactacgccgtcgtgacgccgcggaagcgcgcggccatgcgcgcgttcagggcgcggcagatgacgtacacggtgtgctacgacgccgtgcggtacgcggacgggccgttccccgagtgcgacaactcggacgaggagagggagtccttctcggcctggggcgagtccaagaccgtcgtcatgaggccacgcg

SEQ ID NO: 69745 - DNA, 387 bp, Zea mays
  Clone ID: LIB3078-050-Q1-K1-G5
cggacgcgtgggccggcgactacgggtgggacaccgcggggctgtcggcggacccggagaccttcgccaagaaccgcgagctggaggtgatccactgccgctgggccatgctcggcgcgctcgggtgcgtgttcccggagctgctcgcccgcaacggcgtcaagttcggcgaggcggtgtggttcaaggcgggctcccagatcttcagcgagggcgggctggactacctcggcaacccgagcctggtccacgcgcagagcatcctggccatctgggcgtgccaggtggtgctcatgggcgccgtcgaggggtaccgcgtcgccggcggcccgctcggggaggtggtcgacccgctgtaccctggcggcagcttcgacccgctcgggc

SEQ ID NO: 69746 - DNA, 317 bp, Zea mays
  unsure at all n locations
  Clone ID: LIB3078-050-Q1-K1-F11
tcgcggactcgtggtctgactcgtgggcggactcgtgggatagactgcagatcgagggtctggcagcttgccgtggcagttgggtgattacgactaatagagatgggccttctcgacaagctgtgggacgacaccgtcgcatgcccgcgcccggacaccgggctcggtcgncttcgcaagcagcctgtgcgttccgccgccgtcaagatcagtgatccggccggggacgctgcggcgttcgtgccgccctcgccggcttcgggtagcgaggagacgccggtgaaggtgactcgcatcatcatgatcaagcgccccgc

SEQ ID NO: 69747 - DNA, 374 bp, Zea mays
  Clone ID: LIB3078-050-Q1-K1-F12
cccacccggggccaaatttaccaagaagaacctccaaacgaaaaccgggaaaaaggccacctcttcaagcggcaccataacgttgaccgtcaccaaaagcaaccctgatacccgctaggtaatcggagtcttctaaagcgtgcatccgtccgacaccgacctcggggccaatgcgcccaaggatgtcaagatccacggggtctggtacgctcagctcgagtgattcgagtgtctaactgctaggtgtccgaccgccgtcatggatcttgggaaggtgtatgtataccatggaaaactttggagagcagaggaggaatcgtgtatgtaatgtacttgttaatgcaaattcgggctgtcgcttttttaaataaaaa

SEQ ID NO: 69748 - DNA, 407 bp, Zea mays
  Clone ID: LIB3078-050-Q1-K1-F2
cgccttcgctcgcgccgccgccgccgtcgccgctacgccccgcacctcgcttcatttggtgtggccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtaattgctcttgtcaggcatgttgtgggg

SEQ ID NO: 69749 - DNA, 386 bp, Zea mays
  Clone ID: LIB3078-050-Q1-K1-F3
caagagggaacctgggaattgatcttccacctgagaaggtctttttgtttcaaaaatgtgcgcttcacaagtgcaacatggctggaaagcctgctgttgtcactcgtgttgtggacagtatgactgacaacctcaggcctactcgagcggaggcaactgatgtggcaaatgcagtacttgatgggagtgatgccattctccttggtgctgagactctccgaggtttatatccagttgagactatttcgacagtgggcagaatttgtgctgaggctgagaaggtattcaaccaagatttatacttcaagcaaactgtgaaatatgtcggagaacccatgacccatttggagtccattgcttcctcagctgtgcgagctgctatcaaa

SEQ ID NO: 69750 - DNA, 309 bp, Zea mays
  Clone ID: LIB3078-050-Q1-K1-F4
cccacgcgtccgaagggacagacagcgtcatagcgatgctccactacgccattgttgaggcgtagctgtaacgatgggccacgaataagaagtttgcctatggcctgtgggggagttccctgcgggttttaaagtgtaataacacccttcataatcgatgccttaagctggtgctgccgagtgccgactagctaggccggcatgtaagagcagcctagactgatgttgatgtggtctggcagacgtcctgtgctgtgcctgcctctgtatttcggtcaaataaataaactagatggagtttgcatgttt

SEQ ID NO: 69751 - DNA, 385 bp, Zea mays
  Clone ID: LIB3078-050-Q1-K1-F5
cctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctactgtggtggtggcggcggctacggcggtggcaaccgtggcggcggctacggcaactccgacgggaactggaggaactgagcggtggggcccgcgcggtcaagttatcctgttcgc

SEQ ID NO: 69752 - DNA, 397 bp, Zea mays
  Clone ID: LIB3078-050-Q1-K1-F6
ggggcaggcgaagcgactgtcgcgaggcaaggccatcgtccgccatgacgctctccctgtccacctctttcctctccatccccgccgccgcgaggaccaccgcccgcaccctacgctccgtcgtcccctcccaggggatgcgctgctcgatgcgcaagaaggggttgcacccggagatctacgaggacgcgaaggtgtactgcaacggcgagctggtgctggtgacggggggcacaaagccggagtacacggtggacgtgtggtccggaaaccacccctactatgtcggcgacacctcggcgctcgtggtcatggacagccagatcgagaagttccgcaagaagtggggccacatcaaggagtactggcccgaggaccagtggagggagatgcaccc

SEQ ID NO: 69753 - DNA, 397 bp, Zea mays
  Clone ID: LIB3078-050-Q1-K1-F7
gtgacgtgggcagatgaagttataggatagggtcagggtgtagatgaggacaccactggtggaaatggttcaagaagagtgatgattgttaaggaaggagcaggtagtgttcaagctctgcttggtgtcatgcggctactgaagtatctttctggtttgacattatttagaaaggatgagaaagttcatatcgtggtacattctggaacaggaacaactgctgtggggttagctcttggagcggtatgtctaggactccagtggagggttactgctgttatgcttgctgacacacttgaaggatataaacatcgacagagatctctattatctgattttgagaaagttttcccggaaatctaccatggcatggtcgaagatgctactcatgacaatc

SEQ ID NO: 69754 - DNA, 405 bp, Zea mays
  Clone ID: LIB3078-050-Q1-K1-F8
cattaccctgtctcacgcctccttggctgtgttgaggtggtaggctgcctcaggtctgaagagcttgtttgctgggaacatgtgcctgagtctgtcaggcttgaagggctgactgacttttgttggctctgtgaaaatccacagaagttggtggttccattcgagatgcgtggttaccagggtgtctacaatttagaaagaaggatctatgatggggctgtgaggggccttttacctgttcaaggtccactgcctgtcaagttccctcttccagatcccagagaccccttctccttgaagccaggatctcttacatttgctgcttccaaacccactctgcaaaaatctgaaagtgttgctgcagcaatagccggggctcgagctgcagccactcaattctcaaag

SEQ ID NO: 69755 - DNA, 169 bp, Zea mays
  Clone ID: LIB3078-050-Q1-K1-F9
aatacccgttccgacgccactcgtccgccagagctgacagacatttagatagatgaattcgaggagactactattcatgatgttaagatcatctaagaagagattcgcaggaagcaagctcacgctgcccacgaggcatacgagcaggacgactacatccaaaccacca

SEQ ID NO: 69756 - DNA, 400 bp, Zea mays
  Clone ID: LIB3078-050-Q1-K1-G1
cggacgcgtgggccggcgactacggctgggacaccgccgggctgtccgccgaccccgagacggtcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggactggccgacgaccc

SEQ ID NO: 69757 - DNA, 414 bp, Zea mays
  Clone ID: LIB3078-050-Q1-K1-G10
tcgagcgagtcagccacatcactagctagctgtgcagaggcaatggcgtccaaggttgagcgggtggtggaggtcaagtccccggctgacaagctgtgggcggcgctgcgcgactccacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaaggcggacggcgagggcggcgccgtcgtcagctgggccatggagttcgac

SEQ ID NO: 69758 - DNA, 443 bp, Zea mays
  Clone ID: LIB3078-050-Q1-K1-G12
tcgctgttcttggaaattggtaggttgaacaatggctgcaagaatcagcagggccattggtgagatttatcagcaggaacagaattaatagaaggctacaaattacctgaaaagggcagctgacctttttgacagtgagggacagtcgtctcaatcaaacaccatcaaacagaaagttgcagaaattgctgctcagttggaacagtacccaaaagcaactgagatatttgaagcgatcgctcgtcagtcaatcaacaacaatcttcttaagtatagtgtcagaggaattcttcttaatgctggcatctgtcaactatgtaaaggtgatcctattgccatcacaaattcattggagcgataccaggaaattgacccgactttctctgggacacgtgaatacaagcttttagctgatcttgctgcatctatggatgaaagggatg

SEQ ID NO: 69759 - DNA, 390 bp, Zea mays
  Clone ID: LIB3078-050-Q1-K1-G2
gtttacgcgatgctcagaaaaaaaaccgtttgactaagcttccttctctaattgaatattttgggtattgtctctgttgtgggagccactttgctggaccggtatatgagatgaaagattatcttgaatggactgaaaggaaaggaatatgggctagcccaactccttcgccattgttacctactttgcgtgctctagttcaggctggtatatgcatggggttatatttatacctgtcacctaaatttccactctcacggtttagtgagcccctatattatgaatggggtttttggcaccgactcttctatcagtacatgtcaggctttaccgctcgttggaaatattactttatatggtcaatttcagaagcctcaattatcatatctg

SEQ ID NO: 69760 - DNA, 387 bp, Zea mays
  Clone ID: LIB3078-050-Q1-K1-G3
gatatctgtgggtacagcaccaagaaggttcacactatcctgaccaaggatggcaagagccacttgatcaagaaggatgtgccttgtgagactgatcagttgactcatgtttacactttgatcatccgtcctgatgcaacatacagcattctcattgataatgaagagaagcaaactggcagcatctacgagcattgggatattcttccccctaagaaaatcaaggacccagaggctaagaagcctgaggactgggatgacaaggagtacattcctgaccctgaggacaagaagccagagggctatgatgatattcccaaggaaattcctgaccctgatgctaagaagcctgaggactgggacgatgaggaagatggtgaatggact

SEQ ID NO: 69761 - DNA, 403 bp, Zea mays
  Clone ID: LIB3078-050-Q1-K1-G4
cccacgcgtccgcccacgcgtccgcccacgcgtccgctagaatatcatgatgacactggacccgggtctattctgtgtgttggaagtgagtggcatcgctatccatcatcgttcttcataccctcctatatcagtgaagtccggtggatagatgatggcttccgtgggttacttccatttcccttcaacgagacactgggtgggaccactgcagctccgtcctacttcaataacaagaacaaggcggctgaagggcaatatctgaaagacattggagcatgtaacttactggtggaacttgatctaagacggccttacccctcgcgcgggagtgacttgtcgacatgggaggcattggccgcactgccgttcctggacagagagctttcccctgcattatatc

SEQ ID NO: 69762 - DNA, 416 bp, Zea mays
  unsure at all n locations
  Clone ID: LIB3078-050-Q1-K1-F10
tcgtccacgccttcgctgatggcacgcaagattaaggacacagactcttaagaagaactcagggaagcctggcccgtgttcgacaaggaccagaaccggttcatctctgctgctgaacttcgacatgtcatgaccaacctaagggagaaactgacggacgaagaagtggatgagatgatccgtgaaaccgacgtggacggtgatggccagatcaactacgaggagttcgtgaaggtgatgatggccaagtgagatgatgtgcctgttttgaagctagttcctctcttgatggtagtagctagtctagtgttggagactgactgcatttggtccgccttgttcctctcgctgcatcaatggacatatccgtttgttttctcccaagggattttaccatgtcngtaatttcgttcaaa

SEQ ID NO: 69763 - DNA, 407 bp, Zea mays
  Clone ID: LIB3078-050-Q1-K1-D7
cccacgcgtccgcaccatttcttccttgtctctgtctcaacacggcgccgccgcttctgccgccgggagccgagcccaagcctaagcgaaagccatggcgattggttctctgatcgcctctactttcgccagatctagccatgccctccccgctgccgccgcttcggccatctctcaggctcccagatcccagcacaccgcatctcctctactctccggccttggagcagcggctcgtgctttcagctcaagggctctatggaagggagcattcgttgacgctttcctgtctagaattaagaagaacagagaaaatatgaatggcaagaagatttggtctcgtagatcctctattttgccggaatttgttggttcctctgtgctcatttacaatgggaaaactcatg

SEQ ID NO: 69764 - DNA, 385 bp, Zea mays
  Clone ID: LIB3078-050-Q1-K1-D8
cccacgcgtccggttcgatcggatgacgagggtggagggcctggtgccaaatgccatggcgttcgtcgcggtgctcagtgcctgcaaccacggtggactggtcgacgaagggaggaggtactttgctgccatggtcagtgagcacgggatcaggccgaggatcgagcactacgggtgcatggtggacatccttgcacgggcggggttcatcgaggaggccctcgatgttgtggccgggatgaactgccgtcctgattccatcatctggaggagcctccttgacgcgtgctgcaagaggaatgctgggctggagctcagtgaggctatggccaagctggcgcttgatgtccctgacgacgctgtgagtggcgtctacgtccttctc

SEQ ID NO: 69765 - DNA, 357 bp, Zea mays
  Clone ID: LIB3078-050-Q1-K1-D9
cccactcgtccgctggcctcactggccgtaagatcatcatcgacacctacggtggctggggagcccacggcgggggcgccttctccggcaaggacccgaccaaggtggaccgcagcggggcctacgtcgcgaggcaggctgccaagagcatcgtcgccgccggcctcgcccgccgtgccatcgtccaggtctcctacgccatcggcgtgcccgagcccctgtcggtgttcgtggacacgtacggcaccggcgcgatccccgacaaggagatcctgaagatcgtgaaggagaacttcgacttcaggcccggcatgatcatcatcaacctcgacctcaagaaaggcggcaacgggcgct

SEQ ID NO: 69766 - DNA, 396 bp, Zea mays
  Clone ID: LIB3078-050-Q1-K1-E1
ggaaaaggtggcagtgggtgatgttatatacattgaagcaaatagtggagcagtgaagagaggtggtagatgtgattcttttgctacagaatatgatcttgaagctgaagagtatgttcctatccccaaaggtgaagtccataagaaaaaggaaatagtgcaggatgtcacactccatgaccttgatgcagcaaatgcccagccacaaggtggccaagatattttgtcccttatgggccagatgatgaagccacggaagactgaaatcaccgaaaagctacgccaagaaatcaataaggtggtaaacagatatatcgacgaaggaatcgcagagcttgtacctggtgttttgttcattgatgaggtccacatgttggatattgaatgcttttctta

SEQ ID NO: 69767 - DNA, 399 bp, Zea mays
  unsure at all n locations
  Clone ID: LIB3078-050-Q1-K1-E10
ggggagattgtcaaaggagtctgctcaaacttcctgtgtgacttgaaacctggcgccggtgtgaagatcacagggccagtgggcaaggagatgctcatgcccaaagaccccaatgcaacagtcatcatgctcgcaacggggaccggtattgctccgttccgctccttcttgtggaagatgttcctggaggagcacgaggactacaagttcagcggccttgcgtggctgttcttgggagtcccgacgagcgacagcctgctgtacaaggaggagctggagaagatgaaggagatggcgccggacaacttccggctggacttcgcggtgagccgggagcagacgaacgcggccggggagaagatgtacatncagacgcgcatggcngagtacanggaggag

SEQ ID NO: 69768 - DNA, 342 bp, Zea mays
  Clone ID: LIB3078-050-Q1-K1-E11
cccacgcgtccgggacaacctcatctcggcgctctacttcatggcgctcttctcactggcgtcaaacgtcccagcagagcccaagacggcgacggcgagtccgcagaaggacggcgagcggctgtcggtgctgaacggtggcgcggcggtcgctttgtccttcatcatctgcaaggccgggtcggccatggccgcgcggctggggctccagggcggcacgctgccctgcgtcacggcgctggccgtgttcctggccacggcgttcccggcgccgctcggcaggctggcgcctgccggcgagaccctggcgctcatcctcatgcagctcttcttcgccgtcgt

SEQ ID NO: 69769 - DNA, 397 bp, Zea mays
  unsure at all n locations
  Clone ID: LIB3078-050-Q1-K1-E12
gtgggttggcttctcctccccctccggttcgggttcgggttcgtgaggttctccgggggtcggtttcgtgggtgagcggatcgagatggcggcgtcngatgttgagtaccgctgcttcgtcggcggcctcgcctgggccacggacgaccactcccttcacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggc

SEQ ID NO: 69770 - DNA, 404 bp, Zea mays
  Clone ID: LIB3078-050-Q1-K1-E2
gtcgccggcggcccgctcggagaggtcgtcgacccgctctaccccggcggcagcttcgacccgctcggcctcgccgacgaccctgaggccttcgcggagctcaaggtgaaggagctcaagaacggccgcctcgccatgttctccatgttcgggttcttcgtccaggccatcgtcaccggcaagggcccgctcgagaacctcgccgaccacctcgccgaccccgtcaacaacaacgcatgggcctatgccaccaactttgtgcccggcaagtgagggggtggaggcgccaccgtccaccggccaccgctgcggatatctaggtgttcggatgcacgtgagcgcgcactggttccagtttgtaccatgatgtaaattacttacccgtaccaggttcaatcggcaag

SEQ ID NO: 69771 - DNA, 433 bp, Zea mays
  Clone ID: LIB3078-050-Q1-K1-E3
ccaaaatattaataaacgctagttgctatgaaaaccatttgcctttttgactcttcgacgccgtctactagtgaggaacttgcattgatctttctgcatagtacagtactacttgctttctttacagtaaagtattagctagtatctgatgtgtgtctccaatttatatatatttttggaacctcatgtgtggccgttgtgagatctttctcgatggtagatattgaggacttgttttcaaatgcttcgagttaagaataagacaacataaaaagtgttaaatattaaagtccttcgcctatcaagacattatgtctcttcgggtataataaattcttgacgaaggttaatgaaggaaaaagccttcgtgaacacaatggatgataaggaagaattcatatacgaaatacgaaaaattatatagatatcatta

SEQ ID NO: 69772 - DNA, 388 bp, Zea mays
  Clone ID: LIB3078-050-Q1-K1-E4
ctcgctcattaaaggaacagtattgatgactacctcatatggcgcatatatcgacatgcaaggcaagtctactgcttttttgcccttagatgaggcatgtcttcttgatatcgataatgttgaagaggctggcattcgttctgggttagtagaagaattcatgataattgatgagaacccacgtgatgaaactttgattctaagtttgcaagcaattcagcaagaacttgcatgggaaaggtgccggcaacttcaggccgaagatgtcgttgtcacgggtaaagtaattggtggaaacaaatgaggtgtagtagctcttgtggatgggcttaagggtttccttacattttcgcaagtgtcatcgaaaacaaccgccgaagagctgctt

SEQ ID NO: 69773 - DNA, 408 bp, Zea mays
  Clone ID: LIB3078-050-Q1-K1-E5
cgcgatgcgagcccaaggggacactgcatatggagctaacctggaggcacgcttgaaggacaaagactatccgatagcccagtccctctcaaccttgggtctctctctgatgaagtggcgtcgggaccttgctctgggcgcaaacttgcagtcccagttttccatcggaagggggtcgaagatggcagttcgacttggtctgaacaacaagctgagtgggcagatcaccgtcaggacaagcacctcagagcaggtccagattgcacttctgggtctcgtaccggttgcagcctccatttaccggagtttccggcccagtgaaccatcctttgcttattagcttgtcaggagtctcagtttaattatttcatgatcacatcgtttctcttagcaattttgcttttcata

SEQ ID NO: 69774 - DNA, 366 bp, Zea mays
  Clone ID: LIB3078-050-Q1-K1-E6
cggacgcgtgggcgaccgaggcggtgcctgcgcaggagcagcaggccaacggtagcggggagcagaagacgcggcactccgaggtctgtcacaagagcctgctcaagagcgacgacctctaccagtacatcctgtacacgagcgtgtacccgcgggagccggagagcatgaaggagctccgcgagatcaccgactagcacccatggaacctgatgacgacctccgtcgacgaggggcagttcctgaacatgctcatcaagctcatcggcgccaagaagaccatggagatcggcgtgtacaccggctactccctgctcgccacggcgctcgcccttccggaggacggcacgatcttggccatggaca

SEQ ID NO: 69775 - DNA, 326 bp, Zea mays
  Clone ID: LIB3078-050-Q1-K1-E7
aaaaaaaaaaaaaaaaaaaaaaaattaattaaaaaaaaaaaaaaaaaaaaaaaaaaaaaagaaaaaataaaaaaaaaaaaaaaaaaaaaaaaaaaaaataaaataaaaatataaaaaaaaaaaaaaaaaaaaaaaaataaaaaaaaaaaaaaaaaaaaaaagggctctcctttttaaagtccccaactttatatcccctccattcacctaaattacttttttattaggcacctcaaattcaattcaattacctctcttttaaaaacgtctatacttaaaaaccctttcattttccaattttttctctttcaaaaaaattccccttt

SEQ ID NO: 69776 - DNA, 413 bp, Zea mays
  unsure at all n locations
  Clone ID: LIB3078-050-Q1-K1-E8
cccctccgagcctcagttcgcatccacgcgcgccgccgccgcctcgcagctcgacgctgaccgcgcagccatggcggaacagactgagaaggctttcctcaagcagccaaaggttttcctcagctcaaagaaatccggcaaaggtaagaagcctggcaagggcggcaaccgattctggaagagcattggccttggcttcaagactcccagggaagcaattgaagggacctacattgacaagaaatgcccattcactggaactgtttctatcagaggcagaattattgctgggacatgccacagtgctaagatgaacagaactatcattgttcgcaggaactacctncactttgtaaagaaataccagaggtatgagaagaggcactccaacattcctgctcacatcttcccat

SEQ ID NO: 69777 - DNA, 422 bp, Zea mays
  unsure at all n locations
  Clone ID: LIB3078-050-Q1-K1-E9
gtcggtgttcagcggcgatgagaccgcccccttcttcggcttccttggcgccgccgccgcgctcgtcgtctcatgcatgggggcggcgtacgggacggccaagagtggcgtcggcgtggcgtccatgggtgtcatgcgcccagagctcgtcatgaagtccatcgtgcccgtggtcatggctggtgtgctgggtatctacggtctcatcatcgccgtcatcatcagcactgggatcaaccccaaggccaagccatactacctctttgacggctatgcccacctgtcgtccggccttgcctgtggtcttgctgggcttgctgcangcatggccattggcatcgttggtgatgctggtgtcagggcgaacgcncagcattcaaagctgtttgtgggcatgatcctcaatctcattttcgccgaac

SEQ ID NO: 69778 - DNA, 383 bp, Zea mays
  Clone ID: LIB3078-050-Q1-K1-F1
cgacatcgtcccttcgtccccacgagctaccgataatccgccggcgttgagatgttgggttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcggatgagttcaaaaa

SEQ ID NO: 69779 - DNA, 382 bp, Zea mays
  unsure at all n locations
  Clone ID: LIB3078-050-Q1-K1-D6
cccacgcgtccgcccacgcgtccgacgccgtcggggccgcactggcacgcgctcctcgtcgagatcgtcgtcaccttcaacatgatgttcgtcacctgcgccgtcgccaccgactccagggcggtgggtgagttggccgggttagcagtcgggtccgcggtttgcattacttccatcttcgcagggccggtgtcgggcggatcgatgaacccggcgcggacgctggcgccggcggtggccagcaacgtcttcacgggcctctggatctacttcctcggccccgtcatcggcacgctctccggggcgtgggtctacacctacatccgcttcgaggaggcccccgccgtcaaggacacgcagaggctctcctncttcaagctcc

SEQ ID NO: 69780 - DNA, 177 bp, Zea mays
  Clone ID: LIB3078-036-Q1-K1-F9
cccacgcgtccggtgtttccagaagtctaattgtcatgtcatttgtcactaagagcatactatgagaataaagctgagtaggtttgtatacacttataccgtgttactatgttagtgaaatagtgaagtaacatcatttgggaaccttgctatgacttatgagcttattctccttct

SEQ ID NO: 69781 - DNA, 294 bp, Zea mays
  Clone ID: LIB3078-036-Q1-K1-G10
ctggtgcagcgcctccgccgccgccgccttatctaacgcagttccctccgccgcagcccgatgcatgatggttctccagagcgacattgatctgctcaacccgccggcagaactcgagaagctcaagcacaagaaaaagagactcgtccagtctcccaactccttcttcatggatgttaagtgccaggggtgcttcagcataaccactgtttttagccactcccagactgctgttgtgtgccctggctgccaaactggtcttttgctactcacacgacgaatggcacggcttac

SEQ ID NO: 69782 - DNA, 387 bp, Zea mays
  unsure at all n locations
  Clone ID: LIB3078-036-Q1-K1-G11
ggcgaccattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcaaggtcgctggcctgttaagtcagccaggttcatattggatttgcttgagaatgctgagagtaacgctgatgtgaaaggcttgnacgtggacaacctctatgtttcacaca

SEQ ID NO: 69783 - DNA, 428 bp, Zea mays
  Clone ID: LIB3078-036-Q1-K1-G12
caagagttctcggcttctcgcgagtcgcgacagataaagaggtcgagaaagaggcggatgttcggttaagatgcatagcagcagcatgaatagggagatcagctaggcctacgacaccattctctttggcatcaacgcctgcttcaaagtcgaccttgccacgtcgtatctgttctagtctactatccaatctgagactaagttctggtctgacatgattaagttcgttactgattctatatactgatctgttttaatatccttaagttttttattcataatttgtcttttgttttcattattttttttgtgttatgctcttatttttatttttatacctttttttatatatctttttttttttttattttcttttgttttttttttttttttcttttttctttatttttataattatttttttattt

SEQ ID NO: 69784 - DNA, 312 bp, Zea mays
  Clone ID: LIB3078-036-Q1-K1-G2
aaagtggccaccgtgaatccccagctggacttcaacaacctgcctaacctcctgcctaagtatatgcaccagtcctgcggcccgctgcagaactcgcatttcccgctggagacctcaggcgcgccgctgccatacctcaaccaggggaaccctctaataggctgcggcctacccaacggcatggacaacagccagagctccatgcacccgctcgacccggcgttttgccggccgatgagctcgcagcagcaccctttcctcaacggtgtcagcgacgcagcgtccaaagtcgggactttctggcaagatgac

SEQ ID NO: 69785 - DNA, 316 bp, Zea mays
  Clone ID: LIB3078-036-Q1-K1-G4
ccgacgcgtccgggccggcgtcgtcgagtgtcgccgaggttatttacaacaaagagactggccagagccgtgggtttggctttgttaccatgagcactattgaggaagctgataaagccattgagatgttcaaccgctatgacattagtgggaggcttctgaatgtaaacagggcatctcctaggggcactcgcatggaaaggccttcgagacaatttgcgcctgctttcagagcttatgttggcaacttgccatggcaagctgatgactctaggctggtgcaattgttcagcgagtactgagaaatctttaatgc

SEQ ID NO: 69786 - DNA, 288 bp, Zea mays
  Clone ID: LIB3078-036-Q1-K1-G5
cccgcgcgtccggctagggccgcccttttttttcttttcttttttttaagaacaaacatgaggaagtgacatatttttaagaagagaaatggatgaaagttacctgtttaaaagtttgccacattgtacgagtacccaaagtcttgccacaagcacatcaaacaagttttcttttgcagcaccgctacatatgctatgctaatacaaaaggcttattgagccacctcatctgtaggcacttcagtatcgccttcatgagcattggaattatcaataattgcgacaccc

SEQ ID NO: 69787 - DNA, 234 bp, Zea mays
  Clone ID: LIB3078-036-Q1-K1-G6
gcgacacacataaccataggttctatggtttgcattctacggatatttggtctccctgggtatgagcaaatgtaggaatcaaacacagcggccgagtgatgggaattcatggtgcctaatttgtttcttctgccatcatcctcattatactgtggtgatggatagactgattgcacatggatacatcaccgtcacaagagggaagggtcctggcggtgattactgctcttagct

SEQ ID NO: 69788 - DNA, 313 bp, Zea mays
  Clone ID: LIB3078-036-Q1-K1-G7
gcagagttcccttctctctgtggctttctcttgcccctgttgtcatcggtgtttcaatgggatccgttactgagctctcatgcaactggactggcttcatcaatgccatgatatcaaacatctcattcacctacaggagcatttattccaagaaagccatgactgacatggatagcaccaacgtgtatgcttacatttcaataattgctctcattgtttgcattccgcctgcagtgatctttgaagggccccggctaatgcagcatggattcagtgatgccattgcaaaagtaggcttgacaaattttgttag

SEQ ID NO: 69789 - DNA, 295 bp, Zea mays
  Clone ID: LIB3078-036-Q1-K1-G8
ggttatttacaacaaagagactggtcagattctaatgtttggctgggttaccattatcactattgatgaagctgataaagccattgatatgttcaaccgctatgacattagtgtcaggcttctgaatgtattcttgtcattttctatgttcactatcattgtaaggcctttcttacttatttttctctttttcttatctttattttttctatttttttttttagttttttttcttatattctttttcttttttttaatttattattttatattttttttatatttattttttttt

SEQ ID NO: 69790 - DNA, 444 bp, Zea mays
  unsure at all n locations
  Clone ID: LIB3078-036-Q1-K1-G9
gcgcttcgacatagacctcaaggagcagaaggtgacagtcaaaggcaatgtcaagcctgagggcgtcttccagacggtttccaagtcggggaagaggacctcctactgggagggcgaagccacggccccggacgctgcggcggcttctggagccgaagcagctcccggcaccgcggcagaagcgcctcctgctgctgctccggcggcgccagagatcaccccagccaaagctgacgcctgatcgtcacgctattattcactcacatgtgatgctgcggctgcgactcctaaaccttaaatctagaaatagctggngattgggtttgcattgcatcgtgttcttgccggtctagcangtgactattagaataatggaataaacgatgacccagtgtgtgtatgatttcccgtctgaagaacacacatcctttgcaggaattgtgt

SEQ ID NO: 69791 - DNA, 406 bp, Zea mays
  Clone ID: LIB3078-036-Q1-K1-H11
cgcagatttgccgcagaagaatcagatccaaaccccgtatcttctcttcttccggctccgtccccattgtccccgccgctgccatggccaccggcggcgccgcccccaccgcctccgatgccgggtccaagaagaagttgctcatcttcgactccgaggaggatctcgcggtttctcttgcgaagtacactgcggagctgtcggagaagttcgcggccgagaggggtgccttcaccgccgtgctctctggcggatccctcatcgaggcactcaggaagctgacggagccgacgtacctggattcagtggactggagcaagtggcacgtcttctgggtggatgagagggtcgtgcccaaagaccatgtggatagcaactacaagctcgcctatgatggtttctctcc

SEQ ID NO: 69792 - DNA, 318 bp, Zea mays
  Clone ID: LIB3078-036-Q1-K1-H12
atcgaccttacaggtcccatcgttaaagttttcctaacattgaaagtttataatgctcgtgcaaactcttaagcatcacgagttcttctcaccttcacgcccacaaagtttcaacatctctctattgtcaaagccacaagaaccaaagctaaacccaagaataaagcattcctacccctcttggtccaaaccttttaactcaccaacacctctcccaactcccctcgcctctactcttgtctacttaacacttctcttaaacccgtctaatcaaccactttaaaagtgctattcattctcacttactttttaaaaccc

SEQ ID NO: 69793 - DNA, 120 bp, Zea mays
  Clone ID: LIB3078-036-Q1-K1-H4
attcgtcgaccacgcgtcgtatgtaggtcagagaacctgaacgatatctaagatgaggataccagagccatgacagccatagactgatacaaatataacagtaacctgacaatttaacta

SEQ ID NO: 69794 - DNA, 259 bp, Zea mays
  Clone ID: LIB3078-036-Q1-K1-H5
attcccgtcgaccacgctcgccgcctcgccacctgctgagattctagttgcaccccattccactggtcgtattctcacttggatgacaatagatttctgtgcttccattcaggactctatttctttcatttttttcctttttttattttttttttttttttttttttttttttttttttttttattttttttttttttttttttttttttttttttttttttttttttttttttttttttttttttttttttttttttt

SEQ ID NO: 69795 - DNA, 440 bp, Zea mays
  Clone ID: LIB3078-036-Q1-K1-H9
gatggtgggaacagccgtgtggtgtcggagaaaaaggcaaaggcatggtgcgcgtctaaagggaacatcccgtactttgagacgtctgctaaggatggaacgaacgtggaagatgccttccagtgtattgtaaagaatgctctgaagaatgaaccggaggaagaattgtatgtgccagataccgtggatgtggtaggtggcaaccgggctcagagatcatctggctgctgttaagacatgaggcatccacgaggcgtggtgatcatcatcggctatgcagtgaccaaacaatacctcaacattgctgggcctccatggttatctacgtgtccgtattccatttgttacctttccagtctcctgctatgtacccaagggcgcatttcccatgctgtcagtcaatccgtagacttcatttgtgcagttccatcaatagcgtc

SEQ ID NO: 69796 - DNA, 448 bp, Zea mays
  unsure at all n locations
  Clone ID: LIB3078-037-Q1-K1-A1
tggaaataatgcacatgcgccacaaatttgatgttgacacccgtctggttgagggtctggtcctggaccacggttctcgtcaccctgacatgaagcgcagggcagagaattgttacatcttgacctgcaatgtctcattagaatatgagaaaagtgaaatcaatgcaggatttttttactcaaacgcagaacaaagagagaagatggttgctgcagagagacgccaagttgatgaacgtgtcaaacagattattgaattgaaaaataaggtttgtgctggaggcgataaaaactttgtggtgatcaatcagaagggcattgacccttcatctctggatctccttgctagagcggngattattgctcttcgaagagcaaagaggagaaatatggagaggcttgtgctagcatgtggtggtgaagcttgcaattcaggtgatgagttgac

SEQ ID NO: 69797 - DNA, 434 bp, Zea mays
  Clone ID: LIB3078-037-Q1-K1-A2
cttctgtgtgccgtcaggagtgcgcaaggaggagatcagggtggaggtggaggacgccaggtacctcgtcatccgcaccgagctggacgccggcaccggcaccggcggcgccgtcgcggacgcgaggagcttcgaccggaagtttcggctgccggggatggtggacgtggacggcatctcggcggcgtacacccacggcgtgctgaccgtgaaggtcccgcggatgcacacccgggccaggcctgtagttgacatcctcggtgcgggggcggggccggccagcgaccacgcggcccgggcggcctgattcgtgatttatagcatcaagcatgtactcgctctatcctataaaaaaattatatttagagttcaaattttatttcaaaataaatacacatttagaaataagatcatatgggcttaagtggttttcc

SEQ ID NO: 69798 - DNA, 334 bp, Zea mays
  Clone ID: LIB3078-036-Q1-K1-F6
cccgcgcgtccgaatggcacctcaaagaatctctctctttcgcgcaatgtcatctgctcgaagttgtatggcaagggctcgaagtctggtgcttcaatgaggtgccctgggtgccagggctcatgcatgaaagtcactattcttcagctgtgcccttccatgatacagcatatgcatcagtctttcaatgaattcaattgtactgtatagagcattatttttatttacctgtatgttttttgttttattgttttttaatctatattttttatattttatttctttctttttttttttttatatttttttttattttttttatttttatttttat

SEQ ID NO: 69799 - DNA, 405 bp, Zea mays
  Clone ID: LIB3078-036-Q1-K1-C9
tggacagcaagttcccttctctctgtggctttctcttgcccctgttgtcatcggggtttgaatggcatcccttactgagctctcattcaactggactggcttcatcaatgccatgatatcaaacatctcattcacctacaggagcatttattccaagaaagccatgactgacatggatagcaccaacgtgtatgcttacatttcaataattgctctcattgtttgcattccgcctgcagtgatctttgaagggccccggctaatgcagcatggattcagtgatgccattgcaaaagtaggcttgacaaagtttgttagtgacctattcttggttggactgttctaccatctgtacaaccagattgctacgaacaccttggagcgagtggctcctctgacacatgc

SEQ ID NO: 69800 - DNA, 248 bp, Zea mays
  Clone ID: LIB3078-036-Q1-K1-D1
gcgcccgcgcgtccgctggaggtcatccactctcgctgggccatgctgggcgcgtggggctgggtgttcccggagctgctcgcccgcaacggcgtcaagttcggcgaggccgtgtggttcaaggccgggtcgcagatcttcagcgagggtgggctggactacctcggcaacccgagcctgatccacgcgcatagcatcctctccatctgggcctgccaggtcgtgctcatgggcgccatctaggggta

SEQ ID NO: 69801 - DNA, 412 bp, Zea mays
  unsure at all n locations
  Clone ID: LIB3078-036-Q1-K1-D10
gactnacgatgccttactgttctctgttcgacgttaccgccccttccttcgcctcaccgtcaccggtccactccgaggtgagaatgatgtccttcaccgtgcgcgcctctctccgcaaggccaccgaaggagatagacgaggagctgggagccccccttaacatcctagacaagatcatttgggacaaggagattgaagtagctgacgagcatgctaagaagcctcttgaggaggtgattcaggctgcaacgaaagcccctccttcaagagacttctatggcgctttagaagctgcctacaagcgtaatggggtgcctgcattgattgctgaggtcaagaaagcatccccgagtaagggtgtgctcagggagaactttaatcctgttgaaattgctcaagcttattaaaaag

SEQ ID NO: 69802 - DNA, 238 bp, Zea mays
  Clone ID: LIB3078-036-Q1-K1-D11
ttcttcgtccaggccatcgtcaccgggaagggcccgctcgagaacctcgctgagcacatggccgaccccgtcaacaacaacgcttgggcctacgccaccaacttcgtccccggcaagtgagggaggcgccgccggtgacctttaggtgtccggatgcatgtgagcgcacgctggttttcggtttgtaccatgatgtaaactattgttcaatcgacaaggaataattgtgttcattgtc

SEQ ID NO: 69803 - DNA, 407 bp, Zea mays
  Clone ID: LIB3078-036-Q1-K1-D12
gctgatcccagtgctgagacagctgcagttatgctcaacagaatgtccatgaagaaggtgttcagggtcatactagatactctcaccacacgcaagcagccactctatcaactcactggctgcttgaatgagcatgccaacctcaagggccccagtgttatcaacgatatcttcattatactgaccctgggtattatcgcagcaggcatgtataatatgcaccactgtaacgagcatatgaagactaggtccttctatgacatgcttgacaaagtccatatcagcgttgtcgtcgacgactaaagagttcttcccagttattttcaaagaactcttttgagaacatgacaaaatgattgcttgctttggagatttgtcctggaaataagcacaaccatttgggaaca

SEQ ID NO: 69804 - DNA, 255 bp, Zea mays
  Clone ID: LIB3078-036-Q1-K1-D2
tacgaccttttcagtgctatagtataggattttcttttgacggccattaaaccgcctcagggtgccttttcaaagagcgctcctgctctcactagttcaatcattcctctcctaagaaacttctactcttctacatttccttcttctttacatcttctttcattatattttctttatcttcattttttattattttttattattatatttttttatttttaatattattattttttttatattttattttatatt

SEQ ID NO: 69805 - DNA, 299 bp, Zea mays
  Clone ID: LIB3078-036-Q1-K1-D6
tctcgaccagaggaagactgtagccatgatattgatataacttcagacgaacctggtcgcagccctggtcaattccatcaccactctcatcaaatgtatggtacatattatagcagacactcactccacagggatcatcgcaagcgcatactaatccaagatccaggcttatctccactagatgaagactgtatctattaaaggtaaagaacttcatactaactttttctcatcccttattgtttccattattattttctttacaatttatgatactttttttatcatacatttttatt

SEQ ID NO: 69806 - DNA, 191 bp, Zea mays
  Clone ID: LIB3078-036-Q1-K1-E10
acggcagtccatttgctgctagaggctccggttaccttctctcggatgcggctcacgtccctgtacaggttcaacgtggcgctgggcgtctgacctcaacaagcaagaaagcacatggcaagcggcaaggttgcacatgccaccctcaagggcccgagtgaggctgaatgagatcttcattggactgaccc

SEQ ID NO: 69807 - DNA, 328 bp, Zea mays
  Clone ID: LIB3078-036-Q1-K1-E11
gcggagctcaaggtgaaggagctcaagaacggccgcctcgccatgttctccatggtcggggtcttcgtccaggccatcgtcaccggcaagggcccgctcgagaacctcgccgaccacctcgccgaccccgtcaacaacaacgcatgggcctatgccaccaactttgtgcccggcaagtgagggggtggaggcgccaccgcccaccggccaccgctgcggatatctaggtgttcggatgcacgtgagcgcgcactggttccagtttgtaccatgatgtaaattacttaccgtaccagggttcaatcggcaaggaagaattgttgtgttc

SEQ ID NO: 69808 - DNA, 230 bp, Zea mays
  Clone ID: LIB3078-036-Q1-K1-E12
acagctatctcctaaccctgtttatcttttggacaactctctagattccatcgctaatgtaacattttcacacctactaccaaatctaagttgaaacccttctcaacctcccaaagaagatacaaacattcaggaactaccctttccctaacctgattaatatactactgctttacccattactatactcatacacacttacatcacatatccacttcacactcaaccct

SEQ ID NO: 69809 - DNA, 321 bp, Zea mays
  Clone ID: LIB3078-036-Q1-K1-E5
cccactcatcctcctactcctttattcatacctatctcattcttaccaatccacatcttcccttctttaatgtcacttttatatacattatctgcactatcataatcatctatatcttacttttttctcttttttcctttatttttttttttcttttctttttatattttacttttcactttttctttttttttattcttctttattttttacttcttttatcttattttttttttttttattttttttatttattttattcttttttttttttttttcatttcttattcttcttttttttttttttttttttctcttttt

SEQ ID NO: 69810 - DNA, 121 bp, Zea mays
  Clone ID: LIB3078-036-Q1-K1-E6
ttttttttttttttttttttttttttttttttttttatttttttttttatttttttttttttttttttttttttttcttttttttttttttttttttttttttttttttttttattttttt

SEQ ID NO: 69811 - DNA, 353 bp, Zea mays
  unsure at all n locations
  Clone ID: LIB3078-036-Q1-K1-E7
ctgcattggtaatntaataaaatctcagttacttccagattctaagcctaaactatcttggaaaatttttatctcttgattcatctactgtaaacataatactatttcaatcgagtctagaatcaatttataataatgttatcatatcattttcttttttaatttaatatctcttttaatttcttattattttattctttttatttttttactcctttatttatttattttttctatttctttatttttatattttttttctttttattttatttatttcttttatttatttatctctttttttttcttttatttatctcattatatctttcttttttttttttatttttttt

SEQ ID NO: 69812 - DNA, 411 bp, Zea mays
  Clone ID: LIB3078-036-Q1-K1-E9
cccacgcgtccgcccacgcgtccgcccacgcgtccgggcgattgccagtgtcatgcccaatttcctcatgggtatcatcataggggccgggattcagggaatattcatgctggtctctggctacttcagacttccatacgacatcccgaagcccttttggagataccccatgcagtacatcagcttccactactgggcactgcagggccagtgccagaacgacatgaagggcctcgtgttcgacaaccagtacccggaccaacccaagatccccggggacttcatcctcaagtacatcttccagatcaacgtggaccgttccaagtggatcgacctgtcggtcattttcagcatgatcttcatctaccgcatcctcttcttcctcatgatcaagatcaacgaggacgcgct

SEQ ID NO: 69813 - DNA, 433 bp, Zea mays
  Clone ID: LIB3078-036-Q1-K1-F10
agagctatctgttaagcctgtttatgtctaggatgatttttttgattccctggctaatgtaacatttggacgtggaggaccaaatggaaggggtagaccttctgaacggcgcagagtagatacagaggtttaggaactaccctttccctcccttgatttttctgctagtgctttacccatttttattggcgtgcagacttttggcgaatttccacggcacaggcaaccctaccgtggtggcgcccgaggttaccgtggcggtggacgttcccgaggttcatattatggtggcagaggctatggaaacacagggaccggatgctatggaaacacagggacaggtggccctggaaattcttattctcaccggtgctatggcagagattgattatagcaaaaatgctcactctaccatacttgtagctattgtagt

SEQ ID NO: 69814 - DNA, 303 bp, Zea mays
  Clone ID: LIB3078-036-Q1-K1-C6
ctctatggcaacagcggatgttgtggactctgaggttagggaactcgtggagaaggcctgctctagatcaattcagataatcaccacgcacatcgacatcctccacaagctcgcccagctcctgatcgagaaggagaccgtggactgggaggaattcatgagcttgttcattgactgccaggccgagctgtttgtcgcttgagatgtcacaaggcttgcagtgcgtatgcttttcggtgttttgtgtcagatcgagcaatcacaaagcaattgatagcccaacttgtaagaaccacatttatt

SEQ ID NO: 69815 - DNA, 213 bp, Zea mays
  Clone ID: LIB3078-036-Q1-K1-F12
cttttaattatccctacacactcaacttctaccattaaccaataaatttaatacactacttatcaatcatcccaatacaacactacttcacaacaatctcttacattaactcaatatatctccaacaccattcttacaaaaacttacatactcaacaactactctttccctaaagctaaaacctcttattatttcctcctattaacaccttta

SEQ ID NO: 69816 - DNA, 170 bp, Zea mays
  Clone ID: LIB3078-036-Q1-K1-F2
tgcagactgcacacagctgaggctgtgttatttgtattctgaagctttcttgtgggtcggggtgaattctactctaacttggatcctgcactatcagataaactgtaaattgatagataataagatgttttctatctcatgtttagtgtcaaactctttatatttatttc

SEQ ID NO: 69817 - DNA, 331 bp, Zea mays
  Clone ID: LIB3078-036-Q1-K1-F4
tgtgaatgtaaagagcagcccgtttgttattcgtagcatcgaccgtgacgtgagatatcgtagtctaattattgcaactggagctactgctaagcacctacatctacctcgtcaagataaattctgcagtttcggcatcaactcatgtgcaatatgagatggaccttcaccacttttcaaggtccaggttcttgcaattgttattatttgtgcttcatatttataatgatctgttcttttatttatttaattattttatttttttctttttattttgctttttttttttctctttttattttttcttattatttttatatttttttttttt

SEQ ID NO: 69818 - DNA, 396 bp, Zea mays
  Clone ID: LIB3078-036-Q1-K1-A12
cggacgcgtgggcccaacctggtgcacgcgcagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgtgcatacgccacgaacttcgtcccccgcaactaactgactgagcaacgccgtacatgtgtacta

SEQ ID NO: 69819 - DNA, 273 bp, Zea mays
  Clone ID: LIB3078-036-Q1-K1-A2
aaaacaacaaaaaacaacaggaaccgcaaaattgcaaaacggacataccccacccccaataacaaataacaaaaataaacacaaacaaaaaaaaaacaaaaaacaataaaaaaaacaaacaaaaaaaaaaaaaaaaaaaaaaaaaaactaaaaaaaaccaaaaaaacaaaaaaaaaaaaaaaacaacaaaaaaaacacacaacaaaaaaataaaaaaaaaaaaaaaaaaacacacatacaaatacaaaaaaaaaaaaaaacaacaaacaaaaa

SEQ ID NO: 69820 - DNA, 317 bp, Zea mays
  Clone ID: LIB3078-036-Q1-K1-A9
aacgtttcctggtagacatggagctgaatgcaaagactggtattctcgtagcgtatgatggtgacttcattggcttggttgggataaccgatcctttgaaaagggaggctgctgtggtcatacaaggtctaaaaaagatgggtgttcatccagttatggtcactggggataactggaggactgcacgagcagttgcaaaggaggttggcatcgatgatgtcagagccgaggttatgccgtccggaaaagccgatgtaatccactccctgcaaaaggatggcagtgttgtcgcgatggtcggagatggcatcaacgac

SEQ ID NO: 69821 - DNA, 390 bp, Zea mays
  Clone ID: LIB3078-036-Q1-K1-B10
ccgggtgggccgagtggtgaaggcgtggaggcacccggaggcggacaccctctgacgttgaggaggtggacgtaggtgaggcggagccccggaccatctgcagcggcctcgtcaacttcctccccatcgaagagctccaggacagaaacgtcattgttcttgctaacctcaaaccaaggaacatgcgtggcatcaagtcaaatggcatgctcatggctgcctctgatgcttcccatgagaatgtggagctgctcatcccttcagaaggttcctttcctggtgaaagagtatggttcggttccgaagaagaaaagaaccgtcaatctgaccctgcatcaccaaatcagggatcgtaaaatataagatagacaatcttgtgggaaatctttc

SEQ ID NO: 69822 - DNA, 387 bp, Zea mays
  unsure at all n locations
  Clone ID: LIB3078-036-Q1-K1-B11
cggacgcgtgggcggacgcgtgggcggacgcgtgggccgtcctagcggcgctcgcaccgcggacgtccaaggtgccgacgctgctgtccttcctggcgaagatcaacctggacgtgacggacctggtggcgctgtcgggcgggcacacggtgggcatcgcgcactgcagctccttcgacaaccggctgttcccgacgcaggacccgacgctgaacaagttcttcgcggggcagctgtaccggacctgcccgaccaacgcgacggtgaacacgacggccaacgacgtccgcacgcccaacgccttcgacaacaagtactacgtggacctgctcaaccgggaaggcctcttcacgtcngaccaggacctgctgacccacgctaccacgc

SEQ ID NO: 69823 - DNA, 368 bp, Zea mays
  Clone ID: LIB3078-036-Q1-K1-B12
gtgatttgacatctctccttagatggccaaccgctccaactgggatggaaatgcctgttgtggaagttcgtaaacatgggctgtggcttttggctaaaaatgtgaaacagtatatccacagaatacttgttgaggctgacttcagtgctggaactggtgatgatttatgggctgctgtgggcgaagctggtaaaaacctttacgctaaaggcgaattcaaagagtcgcaagtggcagaccttgatgtctatttgttgaagaaagttggacttttccctgatgttatagagaggaaaacattgcgccatctcgaaaaaagagataatgtctcaactctcattacttgagaattctatactagagatcaa

SEQ ID NO: 69824 - DNA, 326 bp, Zea mays
  Clone ID: LIB3078-036-Q1-K1-B2
gatgattctaggatatcttcggttcctgtttattattccagaaagctactatcgctattgtagcatcttccactgtatatttctgaaatttttagatctattgtctgtcctttatttttatatctaatatctcattatttttctccacttttttataatcatttatattttatttcatttttagttttattttttttattttttttatttttttattttttttttatttatttttttttttttttttctttcttttttttttttctttttttttctttttttttttttttattttcttttattatttatttctctttatttttttt

SEQ ID NO: 69825 - DNA, 310 bp, Zea mays
  unsure at all n locations
  Clone ID: LIB3078-036-Q1-K1-B4
cccactcgtccggcggctgcgactaccttttaggccgccatcacctgcggtcagttnatgttcaattttaaacggggcctgtcctacacccgcttcacgttgtccgtccccttctcatcctgctttatctgcttatttaaccttataatctcatttagtatcttacttttacattctatttttttaattattttatatctatattttttattttttttttatttatttcttttatattattttttatttattttatatatttatatattatatatttattttttttttttttatattcttttatttattt

SEQ ID NO: 69826 - DNA, 320 bp, Zea mays
  Clone ID: LIB3078-036-Q1-K1-B5
ctcgactgctccccgcaggtgtacgagtctttggagcaccggttggccgtggcagaggcgtcacatatgcttaggctcccagtgctctctcaggacggggaggtccatgagcaggagatcgaaaagcttagcacctattcaagaagttcattctatagcaccctcacaagcgcgacacccatctcaagttcaatctcgacgagttacaacaattatagcatcatctctagtgcggtgactgttgctgttccacattgtagtggtttttctgattcagtttaacctgtattttgttttttattttattttttttttttttt

SEQ ID NO: 69827 - DNA, 318 bp, Zea mays
  Clone ID: LIB3078-036-Q1-K1-B8
gatgtatgttcttaatttcctggcgtggttattgttatcgaattaattgatactttatcagggtctgtttaacttacacctgtgtctaacttaattcgcttcacagatattcccgtgtctctttccatttttcatgcaatattgttctttttactcccacttttcctttattatttttttctttctttctatctttttattatctttttctctttttttttattttttttaattatttcttctattttattattttttttttctattatatctctttttttttttttttattcttttttttttattttatcctctttt

SEQ ID NO: 69828 - DNA, 395 bp, Zea mays
  Clone ID: LIB3078-036-Q1-K1-B9
ggctctttggtctacaacaatccaaaatcatcaccaaaacttgtggaggaacacgttggagacatggcaccagaatacttactaaaagggttgatttcagtgaaggccgacatattcagtttgggcgttataatcatagaggtgatgaccggaggccggaattatcccacttgtgaaaaatcttgcgagcaattcgctgttgatgtggttggacgttggaggaagaggttattggaagaagcaggaaggtacacacccttggaaaaatacgttgagcaagtagagacatgcatcttgataggattgatgtgtgtcgatgatgatcctaacaaaaggcccacgacattggacattatcgaaaggcttaccaaagtagatgtcacgaacactgacag

SEQ ID NO: 69829 - DNA, 320 bp, Zea mays
  Clone ID: LIB3078-036-Q1-K1-C1
attcccgctcgacccactcgtcctctaccctctctaccccggctgcttcttctacccgctcggcctctcctactaccgttatgccttcatttatcatatggttaaccatcttattatctttcttctttccatgttcttctttttcttttttttatatcttttctttcttttttttatcttttattttttttttttttctttttctttttttttttttttttttttttattcttttttttttttttttttttatttatttttttttttttttttttttttttttttattattttttattttatattttttattttttttat

SEQ ID NO: 69830 - DNA, 410 bp, Zea mays
  unsure at all n locations
  Clone ID: LIB3078-036-Q1-K1-C10
cggacgcgtgggggagctcggacaaggcagcgccatcgttcggtttccttgctgaattcgcgatcgctcgcccgctcgaaaagaaagaagctagcttttagcatggcgtctctggcgttcggcagcaccgtagcggcggccgtggcggcgacctcggggaggacgcggccggcgcgccggtccgtgctggtcgtgccgcccgctgccagcaggggcggcccggcgccggccaaggaggagaagggcctcggcgagaccatcttcggcttcatcttcaagaaggaccagctggtggagacggacccgctcctcaacaaggtcggcgccgcgccggccgccgtcttccgcgccaagacgaccgncggcaaaaatgctgccggccgcgacgacagcggcagcggcgggggggt

SEQ ID NO: 69831 - DNA, 429 bp, Zea mays
  unsure at all n locations
  Clone ID: LIB3078-036-Q1-K1-C11
catggtcacctccaaagcaagacccaggctgcttctacaaggagctgtacaaagagtgagtgccagcggggatcttgagtgaacctggcgggtagagtctggttctgttacacttgtaccactgaagagttccgagttccaaaagagaaagagaaaggtaaagcagacaggctagacatgatcattagctggcaatacataggtgcggattagcacggaaagtagctcacttactagcaggcaattctttcgaagtcttaaggccatactgagctgggctggtttggctcagcgttacatactgtgtacaactaatgcccaatgtatcctttcccaacacaatgctgntctgatattctttctcttctttctgtacgtgtccttggtttttatgggacattctatttctatacaagtatacatgtgnga

SEQ ID NO: 69832 - DNA, 374 bp, Zea mays
  Clone ID: LIB3078-036-Q1-K1-C12
tccttccttcgccgcaccggcaccggcccacgccgtggtgagaaggaggtccttcaccgtgcgcgcctctctccgcaaggccaccggcaccgacgccgtggcaatggctgccagcgccctgcttgccggcggtgccatggcccaggaggtgctgctgggcgcaagcgactgcgggctcgtcttcgagcccagccagttcaccgtcaaggccggctacaccatcacattcaagaacaacgccggcttcccgcacaacgtcgtcttcgacgaagactaggtgccgagcggcgtctacgccaccaagatctcgcaggaagagtaccttaacgcgccaggcgagacctacttcgtcaccctcaccgtgcccggaacct

SEQ ID NO: 69833 - DNA, 259 bp, Zea mays
  Clone ID: LIB3078-036-Q1-K1-C2
gtcgatcaagctgctttcatatttagtattcctaaaagaaagttaatggatgaggcacaggtaactcttagaacatctgctgttccaagcaaccatgtgaaggagaaatgggccaagaacctttacattgcttcaatatgctatggccggacagtgtcatgaggcttgctcggctgcatccctagttgggaagagcatgttctgatgagtatatattgtgaaaaaagcatcaatctttgttgctgctctctattaatct

SEQ ID NO: 69834 - DNA, 322 bp, Zea mays
  Clone ID: LIB3078-036-Q1-K1-C4
cgggctcgtgggccggattctgtccggctttaattaaagataccagatgaggcgggaatgtatgcatttatttcgtttgatggcaaaaggaggcagcaactgtcaagaggagattctgatcgtatatccattagtcagcacccactcccaactgttaataaatcttaccaaactggtgattgtttccgtaacctgatcagttgtattaactttaactagatatttatctctaatgcactatttgcactataattttttttatttgtttttttcatttttatttttattctcatatatttttttttttttttttatttttttt

SEQ ID NO: 69835 - DNA, 407 bp, Zea mays
  unsure at all n locations
  Clone ID: LIB3078-036-Q1-K1-A11
gcaagacagactacagggccaggataaggctgattaaccaagacaaaaacaagggcaatgcacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaagccactggtgaggatttctctgttgagccagctgatgagaggagngccttccgtgctctcttggatgttggcctaataggactacgactgggaaccgngtctttggtgccc

SEQ ID NO: 69836 - DNA, 69 bp, Zea mays
  Clone ID: LIB3078-036-Q1-K1-C5
aacccaacccacccactcaaccacacgaatcacatacacttccaccccacctttccaccctccaccacc

SEQ ID NO: 69837 - DNA, 366 bp, Zea mays
  Clone ID: LIB3078-037-Q1-K1-E4
cccacgcgtccgcagtgctggccatgcctggagccgttgcgcttgcgcccacgctcgcggcagcgagcagctccgccgccgcggcctccacgctggctccgaacccgacaagccgaggtgacccgctaactattaggttgtgccgcaatgctcctgctagtgctagcgcaactccacttgttccacttgtagccacccgtcgctacgtgcgtggctgccgcggcgcggctctagtcgccagtccccaccacgctccaaaccctcgcctccgattcgcgtctgcggcagaggggatggctgcggaagcgagcacggcgggtgcagcgtcggcagccgaggcgaagcccttcgccgtcctcttcgtgt

SEQ ID NO: 69838 - DNA, 457 bp, Zea mays
  unsure at all n locations
  Clone ID: LIB3078-037-Q1-K1-E5
cggtggccttgagagtgagaaggattacccttacactgggagtgatggcaaatgcaagtttgacaagtccaagattgttgcttcagttcagaacttcagtgttgtgtctgtggacgaggctcaaatttctgctaacctcatcaaacatgggccattggcaatcggcatcaatgctgcctacatgcagacatacatcggaggcgtgtcatgcccatacatctgtggcaggcaccttgaccatggtgttctccttgttggatatggtgcttctggtttcgcccccattcgcctgaaggacaagccttactggatcatcaagaactcgtggggcgagaactgnggggagaacggatactacaagatatgcaggggttccaacgttcgcaacaagtgcggcgtcgattccatggtctctaccgtgtccgcagtccacgccttcgaagagtagactctggtc

SEQ ID NO: 69839 - DNA, 399 bp, Zea mays
  Clone ID: LIB3078-037-Q1-K1-E6
ttggctcctgctacccctgcggttcggcttcgtgttcgcgaggctctgcgcgctgcggtttcgtgagtgagcgaatcgagatggcgctcataagatgttgagtaccgatgcttcataggcggactcgtctgggccacggacgaccactgcctccacaacaccttgagtacctacggcgaggtactagagtccaagatcatactcgatcgggagactacatacgtgcctgcactccagcttcgtcaccttctccaaggacgacgccatgctgaacgccatcgagggcattaacggcaaggagccggacagacggcacatcacagtcaacgaggccaattctcgcggcggccgtgtaagcggatgcggtggatacggtggtggacttggaagcagtagata

SEQ ID NO: 69840 - DNA, 479 bp, Zea mays
  Clone ID: LIB3078-037-Q1-K1-E7
gcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggcagctccaagcccgcggccgtcgtcagcgcgccagctgccgggacgaccaccaaaacaaggacggtcaaggacgcgctgccgcaggaggtgccgtcctcgccgttcctgccaccgtccggttgggccgtcgaggacctcctcgagctgtcggactacgaatccagcgacaagaaagactcgtctcttgggctcaaggagctggagtggttcgaggacatcgacctgttccacgcccattcgccagctaaaactgccatggcggag

SEQ ID NO: 69841 - DNA, 481 bp, Zea mays
  unsure at all n locations
  Clone ID: LIB3078-037-Q1-K1-E8
cactttccccgtgcttctccgccgtcgaggccgcgtcccagtgcgaagagactccgactcagatggccagccgctgggtccggcccgaggtgtacccgctgttcgcggcgacgggcgtggccgtcggcatctgcgggtttcagctcttccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactacttgctactggggattttacactntgctggcaactcaatatgttggggacatccatgacctctaaaagtaccttgagcgcttggtgatgactnggtatatgtatgatggtggatgagtttgatcg

SEQ ID NO: 69842 - DNA, 409 bp, Zea mays
  Clone ID: LIB3078-037-Q1-K1-F1
cttgctcgcactcgcggagatcgaagagaagcgcaggaggccccagcactagcgccgccccgccgccgcatcagacatggcgctggccgctcgcctcgtctcgcgctcccgtcagctatattcggttcaagccactttggggaatggaggtgtcactcaagttcgctcctttgccaaggatgcagctccagctgaccgtgctcctgtcggtggggatgatctcctgaagggcatattctttgaggtaaagaagaagtttgagacagctcttggtgttcttaaaaaggaaaagatcactattgatccagatgacccagcggcagtttctcggtatgcccaagtcatgaagactgtaagggaaaaagcggatcttctctctgattctcaaaggattaaatataccattgag

SEQ ID NO: 69843 - DNA, 493 bp, Zea mays
  unsure at all n locations
  Clone ID: LIB3078-037-Q1-K1-F2
cccacgcgtccgcccagcgtccacagttcactgcgcgcgcgtcgtgcaggacaccacaccatggcacctgccgcccctgctgccacgggcgcggcgagccccgccgtcaccaagggcggcggcaaggttgcagcacgctccgtcaggctggggctgcccgcgctgccgccgctgcccggcctcagcctcgccgcgcagggccagacccgggccgcgtcgtccttgtacaagcggctggcgagggacgtggtggccatggccgcgggggagccggcggcgcctcaggctgccaacgaggagctgaccgagttcgtcgacgcgttgaaaaaggagtgggacaggatcgaggacaagtacgcggtgaccacgctcgccgtcgccgtcacgcttggcatgtggagcgccggtggagtagtgtcggcaatcgataggctccccgtggttcctggtctgatgcanngccgttggaattggatacagcgggtggttcgcg

SEQ ID NO: 69844 - DNA, 471 bp, Zea mays
  unsure at all n locations
  Clone ID: LIB3078-037-Q1-K1-F3
cccacgcgtccgcactacactacaccacaccacacacacccgacgacgatcacacacacgtagaagatcgagttcgttcgatcgtgaccgtgacgcaggaagctataagctagccaagacaggaataataatggcggcgtcgacggtggcgagcctctctgtcccggtgacgacgacgaccttcgcggcggcgggcggcgccgacgtgctgatcgtcgtcccgaggagggcgggcgccgggcgcgtcgtctggttccccgcggcggcgcgccgcggcggcggcagcgggcggttggtcgccgtgcggtccagcgggccggccacgccgtcggagatctccgacaaggtgtctgagagcatcaagcangcggaagagacgtgcgcggacgaccagaagggcgactccgagtgcgcggcggcgtgggacgaggtggaggagctcatcgccacggtcagccacgcccgcgacag

SEQ ID NO: 69845 - DNA, 470 bp, Zea mays
  unsure at all n locations
  Clone ID: LIB3078-037-Q1-K1-F4
cagaaccatggctgacttgaccactagagatccaattattagggatcacacagcactaccaggggaggcacttgctcgagcagaccgcttggatgatctctaccgttctgatcgtgtggaggaactctaccgttctgatcgacttgttaaccgtgctgtggaccgccctcatccagcctattttacagctgcttatgagaccaaccctgcttatgctgaaacgagcattaggcctgtctctgcaagggtcaatggacccagtgcggcagtttcgtcactctattccttcagtggtggcccagtatatcggtaatgaatgatcatggctctgttgaaagccttagccagactaagaagacagggtattcgtctctttaactgcaactgttgtttgccttagcttctattcggtattntcttaaatatccttccctggatgaatgacattcgttatcaagacttgatggtct

SEQ ID NO: 69846 - DNA, 396 bp, Zea mays
  Clone ID: LIB3078-037-Q1-K1-F5
gtcgacactcccttcggcaacatgaagctgcccataagcaaagagggtggaaccacccgcctcaagaaggaggaggaggaggacgacgacgatgacaactgaagtgaggactgctggggggcgctgctgttacctttcacgaaacgcagcgaagcagaagatgcggggatcgtcgtcgacctgatacccacacccttagcgctggttaagctcttgcctttagcttatggtgctctgttgttttgcattgtctgaacatcctctcacttcctgagtgtacgttcagtttgaggtttcctgtgttgtccatctgaattctttcaaactttgcggttggaactggatgaagaataaaattccaacccgccctggttcttttgtgggtctgtttggaat

SEQ ID NO: 69847 - DNA, 484 bp, Zea mays
  unsure at all n locations
  Clone ID: LIB3078-037-Q1-K1-F6
cccacgcgtccggtcgacgccgccgccgtcgtgctgctcgcagctcgccagcgtggtgcagaccagcccgcagtgcctgtgcgccgcgctcagcagcgactcgtcgtccctcggtggcgtcaccatcgacaggacgcgcgcgctgcaggctgcagctgccccaggcgtgcagcgtcaagaccccgccggcgagcaagtgcaactctgttggtggcggcagcgctccgggcgccgcgacgccggccgcgccgtcgtccggcgtgccagcgaccgcagccgcaggaactggcagtggatcgaaggcgacgccgacggcgccgttcctaacgtccggcggcgcgtcagtccggggcgcggtgagcctggcgctagcattcgcggctgtcaccgtctatgccatatcggccatgtgacagactnggctcgtctatctctgttacccacggcgtttggggattcagacgtgacacgttcaggatttaat

SEQ ID NO: 69848 - DNA, 378 bp, Zea mays
  Clone ID: LIB3078-037-Q1-K1-F7
gccggagagcatcgcgcgcatcaaggacgacttcaaggacgcgacggggcagacctgctccacgttcgacgctgtcacggcggtggtgttcaagtgccgcgcgctggcgatggcgctccccgacgacgccgaggtccggctcggcttcgccgccagcacgcggcacctcctccacggcgtgctgccgtcggtggacggctactacggcaattgcgtgtaccccgtgggcatcacccggaccagcaaggcgatccgtgaggcgtcgcttccggaggtggtcggcgtgatgcgggaggccaaggaggcgctcaccacgcggttcacggactggatgcgcggcggcgccaaggacgaccactacaacgtgccgctggacta

SEQ ID NO: 69849 - DNA, 450 bp, Zea mays
  Clone ID: LIB3078-037-Q1-K1-F8
ggcgtactacttgtcagtgcctttccctgttgagaaggcagctacccacaagatcccactctgtgaggacacgaagaagaatggggtgaccgtgtccaagctgataaattatcctgtgagaggcctggtatttgagggagggaacaccctggacgacctggccactgtggtttctaatgcttgcatttggctgcaagacaacaatgtgccttacaatgtgctcatttctgactgtggcaagagggttttcctgttcccccagtgctacgcagagaagcaggctctgggtgaagtgagccaggagctgctggacactcaggtgaacccagctgtgtgggagatcagtggacacatggtgctgaaacggaggatggactatgaggaggcatctgaaaccttcgcgtggaaactcctcgccgaggtctctctctccgaggagcgcttcgagga

SEQ ID NO: 69850 - DNA, 482 bp, Zea mays
  Clone ID: LIB3078-037-Q1-K1-G1
gcgccgcgtgcgaaccaagcagaccacaacaagaagaagcgtagtcgtcgccggaaggaaaggcgcggagcaaggtgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcaacatggtggtggagaggctcggcgattacctgattgaacatggcttctaaaagttcgctata

SEQ ID NO: 69851 - DNA, 482 bp, Zea mays
  Clone ID: LIB3078-037-Q1-K1-E3
gtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaaactacagaggaagataggcaagaacgctgtagcttagagcattctcatggattgtcttgcaccgaaatgtgtgttctgatgagtacactttttttg

SEQ ID NO: 69852 - DNA, 478 bp, Zea mays
  Clone ID: LIB3078-037-Q1-K1-C5
aggctaggctccccaccaaggtactgtggatgaggaggatgcgcgtgctgaggcgcctgctccgcaagtaccgcgaggccaagaagatcgacaagcacatgtaccacgatatgtacatgaaggtcaaaggtaactcgttcaagaacaagagggtgcttatggagagcatccacaagtccaaggctgagaaggccagggagaagacgctctccgatcagttcgaggccaggcgcgccaagagcaaggcgagtcgcgagaggaagaatgctaggagggaagagaggctggcccagggcccaagagaaataccaccaccagtctcagccacagctcccactaccggggcaccgaagaaagcaaagaagtgaagtattgcaacaaagctgcagctttctagtccagtacttcgtaattttggagcgccctgatcaattttgctgttatacagcttcgtgtcttttattttccaaaagctacc

SEQ ID NO: 69853 - DNA, 413 bp, Zea mays
  Clone ID: LIB3078-037-Q1-K1-C6
cggacgcgtgggcggacgcgtgggcggacgcgtgggcggacgcgtgggttacacaattggcccgttccaaacctccaacggagagaaggccaaactgaaagtgaaagtgcgtctcaacatccatgggaccgttacagttgattcggtgataatgctggaggaggatgtggaagttccagtctcatctgcaaatgaagctccaaacgatactatgaagatggacacagatgatgtgccaagtgatcctgctgctggatctgatgtgactatgcaggagcagcctcctgcagctggaaatggagcacaagataatgaggaaaagtctgtttcgatggaaactgatgcaaaggttgagccgtcaaaaaagaaagttaagaaaactactgttccggtccatgagttggtctatgggg

SEQ ID NO: 69854 - DNA, 486 bp, Zea mays
  Clone ID: LIB3078-037-Q1-K1-C8
cccacgcgtccggaagtatatgccttgacattctcaaagagcagtggagccctgctctgacaatttctaaggtcctgctctccatctgctccctgctgaccgaccccaacccggacgaccctcttgtcccggagattgcccacatgtacaagacggaccggccgaagtacgagtcgacggcccgcagctggacgcagaagtacgcgatgggctgacgaacgctttcctgctcgtccacccgactggcgtctcaagaaagccgttcctgggcgccattgttcccttggatttgttgttggtcgtgtgtatccctgatccatctaggatcatcgtattgtattgtattgtagtgtatgtcgtcggcttaccatcgttgccatccaccatagtgaggtggttggacatgcttcgcctatatgcacctgttcttgccttccttcgggtcggtgctctttggttaatgttcatggaagacgttgatttcaa

SEQ ID NO: 69855 - DNA, 336 bp, Zea mays
  Clone ID: LIB3078-037-Q1-K1-D1
atcgccaccaaggagaacatggagtctctgatatcgatcggccaggagctgctcaagaagccagtggcgagagtgaacatcgacacagggctgtacgagtcctgcgacggtgagggcacaaatgcacagtcgctagctgacttcgccaagcaactctctgacgagcgcaagctacgcaagagcaatctcaactccaactaataaatacctctctcagtcacagcatgtgctctttccgcagattcaccgtttcttatttttaatttaatttcaattctgtgtgtgtgtgattgtgtgtgtgactgtgtgtgtaccaataaacatttaagttcaatc

SEQ ID NO: 69856 - DNA, 454 bp, Zea mays
  Clone ID: LIB3078-037-Q1-K1-D2
cgtccttcgccgccgtggcggtggccgcgccctcgcgccgcggcaccttcgccgtggtcaggtgcgccaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggccccaagaacgggacccccgaggcgaagaagaagtacgcggccatctgcgtcaccatgcccaccgccaaggtctgccacaactgagcacgcccgcgttgcatgcagctgcagggccggggggtggtatataattaatgtacgtgccacggtgttgttgtccctattggtggttcgagctttagatgcatgcctgacgtgaggccgcttaattgctttctgacggcctcggagctgtaagaatatca

SEQ ID NO: 69857 - DNA, 480 bp, Zea mays
  Clone ID: LIB3078-037-Q1-K1-D3
ggccgcaaaccctagcggtgggaggaacactggcggaggaaatggcggcggcgatgcaaatggtgctcggacgaagaaaatatttgtgggcgggctgccctctactctgactgaggatgggtttcggcagtatttccagaccttcggcatcgtcactgatgttgttgtcatgtatgaccagaacacgcagcgcccccgtggcttcggattcatcacctttgactcggaggacgcggttgaccacgtgctgcagaagaccttccatgatcttggtgggaagctggttgaggtgaagcgtgcattgccccgtgaggcgaaccctggtggctctggtagtgggcgttctggggtgagtgggggttaccagagcaacaatggccataacaccagctctggtagctatgatggtagaagtgatggtggcaggtacgggcaggcacagcatggtagtggtgtctatcctggctatggtgctggggc

SEQ ID NO: 69858 - DNA, 437 bp, Zea mays
  Clone ID: LIB3078-037-Q1-K1-D4
tctagatcgcgcccacgcgtccgggcggatggtggccggcagcggggtgccccccgaggtgcgccggccgcacgttgtcgctggcgaggtcggggaggtcgctggcgggaggcggaggatatacgtcgtcggcgccgggctcgacgtcgccgtgggcacggtttctgccgccgcatccgccgccgccgcggtacccggcgtcgaggacgaagtggtggagtgggaggtggtcaagggctccgccgagttcgccgggatggcgccctgcaacgcgcaggtcctatacgcatgaggcgccgtcggaccccgccttcgggtagaacgtccacaaaccgatggttcggtaccagtcggcgcagccacaggggtccaccaggcccgtgccgcatcacgtcgccggcgaagcgcatacctagcccacaatgtaatggaacgcg

SEQ ID NO: 69859 - DNA, 472 bp, Zea mays
  unsure at all n locations
  Clone ID: LIB3078-037-Q1-K1-D5
cccacgcgtccgcccacgcgtccgcgcaactgtattgctgatgagcattatttgccaaccctcttcaatatggttgaccctggtggaatagctaactggtcagtgactcatgttgattggtccgagggaaaatggcatccaaggtcatatagagctgcagatgttacatatcaactcttaaagaacataacgtctgtcaatgagaatgttcacattacaagtgatgataaaaaagttgtgacacagaccccatgtatgtggaatggaacaaaaagaccctgctatctttttgctagaaagttttacccagaatctttgaacaacctgctgaagctattctccagttacacatcggcttgagttctacatgattcttttggcattttgcctaggagattcctctaggatttatctttntgtgcttcatgtaaattgtggaattgatacttanaggcttaacagagttacagat

SEQ ID NO: 69860 - DNA, 419 bp, Zea mays
  Clone ID: LIB3078-037-Q1-K1-D6
tcgggcctgggcaactgggtgaaggcgcaggagtgggcggccgtccccggcgggcaggccacgtacctgggcgccccggtgccgtggggcacgctgccgaccatcctggtgatcgagttcgtggccatcgccttcgccgagcaccagcgcaccatggagaaggaccccgagaagaagaagtaccccggcggcgccttcgacccgctcggcttctccaaggaccccgccaagttcgaggagtacaagctcaaggagatcaagaacggccgtctcgccatgctggccttcgtcggcttctgcgtccagcagtcggcgtaccccggcaccggcccgctggagaacctcgccttccacctcgccgacccgtggcacaacaacatcggcgacatcatcatgcccagatcaatctgcccttgagc

SEQ ID NO: 69861 - DNA, 463 bp, Zea mays
  Clone ID: LIB3078-037-Q1-K1-D7
gtcatcatccagcccacgtccaagaagaccatcgccgactacggctctcccgaggagttcctctcccaggtcgactacctgctcggcaggcaggcctacggcggcaagaccgactccgagggcgggttcgagaccggcgccgtggccaccgccaacgtcctggagagctccacccccgtgatcgacggcaagcagtactacgccgtgtccgtgctcaccaggacggcggacggcgacgagggcggcaagcaccagctcatcgcggccaccgtctccgacggcaagctctacatctgcaaggcgcaggccggcgacaagaggtggttcaagggcgccaggaagggagtcgagaaggccgccgcctccttcagcgtcgcatgatgcagtaatattgtttcttcgatgggatgggatgcacgcactacgtagagagcttggctaggccaggcctggctgagcacgc

SEQ ID NO: 69862 - DNA, 393 bp, Zea mays
  Clone ID: LIB3078-037-Q1-K1-D8
cagagatcaagcttcacccagacgtgacagctcgagtaaggctgaatgtctatgcgaaatgagctcaacagttacagaaccttgagtaatggactttggagaagcctgatgtttgccagagattttgctgcaagtgccaggtgctgcggtagacatgaggcctggtctggccgtgacttgcctggttttgatacacaattcactggctcactgcgcatcctattccctaccgtgtgaagtcaagttttcaacaattatatctgttgattttgaggcggaaaatataaatcgttgtaaagaacaatttgtttgaactgtagagcactacttggccaaaaaaaagagtcgagaatgccggcgtctacttcaacgtcgcatgatgcaataataatt

SEQ ID NO: 69863 - DNA, 476 bp, Zea mays
  Clone ID: LIB3078-037-Q1-K1-E1
ggaagaggaactgaaaaggggcgagctggaggctgacaaagacaaaatgatgagagagtatagagctcaactggatgctgaaagagctcaaaagctagcaaacggaagaaatcactcaaggtcaaactcaaaatcatcatcttccaagaaagagaggaaggataaggacgcaaagaaaagaagtaaaaagaggagaaaggtatactctagcttatgacctgctgcctatttgtgaaattgctgtgatttacctaatggaaatatatttagttatgataactctgttctaggtactttgcttacttaaaatttgtttggtgctctcacatttaaatctttaacagcacataagttcatcagagtcaagttccagctcatcttcagaatcttcaagcagcgacgatgaggataggggttcaaagaagtccagatcacggtcgagatcaagagaacaaggaaagaaaagaagagccggt

SEQ ID NO: 69864 - DNA, 457 bp, Zea mays
  Clone ID: LIB3078-037-Q1-K1-E2
cagccgcatcgaactctacctgcctttctctcgtccctggcggcggcggcaggatggcggcttctactgcgaggacggtgaaggatgtgaacccccacgagtttgtcaaggcctactccgcccatctcaaacgctccggcaagatggagcttcctgagtgggttgacattgtgaagactgcgaggttcaaggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccatttcacgcaacatcctccagcagctgcaggagatgggcatcattgatgtcgatcccaaaggtggacggcgcatcaccttcccaggaaggcgtgatctgga

SEQ ID NO: 69865 - DNA, 425 bp, Zea mays
  unsure at all n locations
  Clone ID: LIB3078-037-Q1-K1-C4
cccacgcgtccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcggcgccgccggcctcgtcgccatcctcagcgtctgcctcaccatgtacggcgtcgcctccttcaacgagggggacccgtccacggcgccctcgctcacgctcaccggcaggaagaaggaggccgacaagctgcagacctncgacggctgggccaagttcaccgggggattcttcttcggcggcatctccggcgtgctctgggcctactnntctctctacgtgcctcgacctccctacttcttcaagtagaaatcatcaaagatgcgtatatatatagc

SEQ ID NO: 69866 - DNA, 366 bp, Zea mays
  Clone ID: LIB3078-037-Q1-K1-A4
ctgggaagctgccatcggttgcggtggcatctcgatgctggcgaagcccaccgcgtacatggggaaggccttcaaagctgctggcttcgacggcgagctggacgcgagcaacatccgggaagccatcctgagggccactgggctgtgcataaacagcagctcctggacggggatccctggctactgccggttcagctttgctctggagaggggggaattcgagcgtgcgatgggatgcatagctcggttcaaggagctggttctgggaggcgctcagatgaatggtgcctgatggagcaatccatgttatacgtaaccttggtgctgtgtagtagcgatgatattgttccaggtgaatgggatatc

SEQ ID NO: 69867 - DNA, 471 bp, Zea mays
  Clone ID: LIB3078-037-Q1-K1-A5
gtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacgtggcacctgggcctgttcatcgtgctcaccttcggccagatcggattcaagggcaagaccgaggactacttcgagaagt

SEQ ID NO: 69868 - DNA, 227 bp, Zea mays
  Clone ID: LIB3078-037-Q1-K1-A7
cgcccgtgctgttcgccaaggcctgcgagctcttcatcctcgagctcactatacgctcctggctccacgccgaggagaacaagcgccgcaccctgcagcgcaacgacgtcgccgcggccatcgcgcgcaccgacgtcttcgatttcctcgtcgacatcgtgccccgcgaggaggccaaggaggagcccggcagcgccctcggcttcgcggcgcccgggaccggcgtc

SEQ ID NO: 69869 - DNA, 349 bp, Zea mays
  unsure at all n locations
  Clone ID: LIB3078-037-Q1-K1-A8
ctcggcttggtcctgctcaatgaagggggaggggctcgctgagagcgtgtcgggccttcgttgagggctctatggagaaggnnttgaagcgccagtgagaaaatcccgagctcgcttcacgtactgtagatcctcacattatccatgcctgcaagggcatgggaagatgggattcggcaatgcatgattctntgatcatgaatagttctcggaaaactctgatcgccgaaggatcatccatacatcttctgcattcatcaaggggtaccttctatcgctgggagaatagaagatgcctgcaaagtatgtcaagtgacatgagcatccaagggacaagaacattcttgtg

SEQ ID NO: 69870 - DNA, 483 bp, Zea mays
  Clone ID: LIB3078-037-Q1-K1-B1
gcgaggcatacacatccacgggccacgcccaccggcatctcacggcggaagcagccaagcagccggccgggcgcctcccgtgccgccgctgagcatggccgctgctcccgtgggcgctcagaatcgctgcgtcttcgttggcaacataccatacgatgcgacagaggagcagctcgtgcagatttgcgaagaggttggcccagtcgtatccttcaggttggtgattgacaaagagactggcaagccaaaaggttatggcttttgcgagtacaaggacgaggaaactgctctaagtgcacggcggaaccttcagggttacgagatcaatggtcgtcagttacgggttgattttgctgaaaatgggaggaacactgacagaaatagagaaaaggtcgacgatcctcaaatttttactgtagaagagcctttcctaccacctttggagttctctgttaatctgagaagttgtatgggcttcggtct

SEQ ID NO: 69871 - DNA, 364 bp, Zea mays
  Clone ID: LIB3078-037-Q1-K1-B2
caagcttcgagattggctttttgccagacagcgctattggggtgaacctttccctgtgagctatcttgatgataccaatgaaatggttcctcttacagaagatgacttgcccttgacccttcctgaattggatgatttcactccaactggtactggggagccacctttgaccaaagcaacaaattgggttagaaccattgactcttcatctgggaagcctgcgagaagagaaacaagcaccatgccacaatgggctggatcttgctggtactatttgaggttcatggatcccaaaaactgcagtatattggttgataaggctaaagaaaggtatttgggtccagttgacatctacgttggtggt

SEQ ID NO: 69872 - DNA, 409 bp, Zea mays
  Clone ID: LIB3078-037-Q1-K1-B3
caccaacttcgagatcgaggcgagccccgatgcatcggttgctgatgtgaagaggatcattgagaccactcaaggtcagagtacctaccgggcggaccagcaaatgctcatataccaagggaaaattctcaaggatgaaaccactttggaaagcaacggagttgctgagaacagcttccttgttataatgttgtccaaggctaaggcatcatcgagtggagcttctaccgctactactgcaaaagctcctgcaactctggcccaacctgctgcccctgtggcccctgctgcatcagttgcaagaacaccaacacaggctcctgttgccacagctgaaacggcaccttcaagtgtccaacctcaggctgctccagctgctacggttgctgctactgatgatgctgatgtg

SEQ ID NO: 69873 - DNA, 477 bp, Zea mays
  Clone ID: LIB3078-037-Q1-K1-B4
cccacgcgtccgaacccatggttaccttgtacctttgattgaaaagctgtgctcaaaatcttctaccaccaaagatgacaattgtcaggacaccaccccaggagcacatgacatggtgttggtcctttgtcccaatgtcatgctctgcgagcaagttgttcgcatggctaattcattacttgacgagtctggcaaaccacttaaaagtgctgctgctgtttgtgggccaaatggctggccagctgttcatccagatattcttgtagccaccccagctgctctattaaactatctatttgactatgaacccggaaaagaggcgaagagagggattcatgcgtaatgtaaaatttgtagtgtttgatgaagcagacatgctactctgtggaaagtttgagaaccaggtcattcgtctcatcaatatgttgagatttgatgaaaagctactttctagagcacaggattctggaaaggatg

SEQ ID NO: 69874 - DNA, 465 bp, Zea mays
  Clone ID: LIB3078-037-Q1-K1-B5
cccacgcgtccgcaagatatggcaataaaaggatagaaccatcaggtgagattcagtttttcccttctccctgcgtcattgggcaagggcatgttaatggcaagaacccagttttccaacccgatggggtgttgctgcctcccaatgaacataatacaggtgagagtacaaggcatgctcgaatttctctggacagtaggacagagggtgctgccatcctgtgttccactagtgccagggaagatgctggtgcaaatagttcttcccatagaaaggacagtatgagccatccctcatatgggtttatacctgttccaattcctgttggtgccacgatgccgtaccattatggtgcgattctgcagcccgtatactacccacagagtcctcttatgcactgtgattcagctggaatcaacaaggcagcaatccagcatgcctctgggcaacctaattaccatgaag

SEQ ID NO: 69875 - DNA, 478 bp, Zea mays
  Clone ID: LIB3078-037-Q1-K1-B7
ggcggcggcgccaacgtcgtggcgcccggctacaccaagggcgacggcctaggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtaatttacaaccagcaccatgcgtgggctgaccactggatcttctgggtcggccccttcatcggcgctgcgctggctgccatctaccaccaggtgatcatcagggcgatcccgttcaagagtaggtcttaaaggagccgatgctgctgcttcgagatgctgccggtcttgaaaggatggattcgtggctgtttcaaatgatcccctactatgttacgtggagttccattcc

SEQ ID NO: 69876 - DNA, 485 bp, Zea mays
  Clone ID: LIB3078-037-Q1-K1-C1
cggacgcgtgggaaccaagcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaacctggagttgtcatccgaggaaagaagggcactggaggcattactatcaagaaaactggcatgtccttgattatcggtatctatgatgagccaatgactccagggcaatgcaatatggtggtggaaaggctcggcgattacctgatcgaacagggcttttaagtttgtcataa

SEQ ID NO: 69877 - DNA, 401 bp, Zea mays
  Clone ID: LIB3078-037-Q1-K1-C2
cccacgcgtccgggcgaaggtaaggcaagatgtacaccgcgaggaagaagatccagaaggataagggccttgagccctccgagttcgaggactccgtcgcccaggctttcttcgacctggagaacggtaaccaggagctcaagagcgacctcaaggacctttacatcaacggtgctatccagctggatgttgccgggagcaggaaggctgttgtgatccacgtcccataccgcttgcgtaaggccttcaggaagatccatgtcaggatcgtcagggagctggagaagaaattcagcggcaaggatgtggtaattgttgccacaaggaggatcgtgaggccgcccaagaagggttcagctgttcagcgccctcgcaccaggactctgactgctgtccatgat

SEQ ID NO: 69878 - DNA, 471 bp, Zea mays
  unsure at all n locations
  Clone ID: LIB3078-037-Q1-K1-C3
gaaagaacctatggcacagtcgtcgtccgcctccgtcaagctgctggttctggttgtcctccctgcgctcctgctgttcctcgtccaagcgcaaggggctcggccagcggcggcgaacacgacgaccccgacccccgccaccaccaccgggtgcgcggcgtcgagcgtgacggtgtcgcagtccaacacgggcgacagggccgggtacgacccggtgttcgaggtgacggtgagcaacgcctgccgctgcgccgtccgcgccgtgcgcctccgctccgagggcttcgccagctcggtgcccgtggacccgcgcctgttccgccgcgccggccgcgactacctcgtcgccgacggccgccggatcgagcccggcgccgacgcgcgcttncgctacgcctgggaccgcgccttccggatgaccgccgncgncgtgcgcgacgactgctcctgatggaatgagtgagtgcggta

SEQ ID NO: 69879 - DNA, 473 bp, Zea mays
  Clone ID: LIB3078-037-Q1-K1-A3
ctgttccagcctcagcaagagcagagccaatggagtggtggtggctattatgggtatccccaaggatacgatccatatggctatgctcggccccctcaagatcctgccatgtacgcctacgcagcatatccagggtatggaaattaccagcaacagccaccacagcagcccccgccacaacagtaatgatgtcccgagagtgatcatttgcaagctggtcgcaaagtagctgggggttggggcgcagcaactttggtgcgttggcatgagaaattttgcggcggttgcttgtgttgtgttgtattgttccgacgcccttgtacacgtagcctgtgttgtaactgaatttttgccgaggccttatgagtgactagtgtttcaactgtaactggattgcacatttttgtcgcaaggaatgtactattattgtgtggctcgtgccgcattgaacgcagagtcccggtattaatgtt

SEQ ID NO: 69880 - DNA, 412 bp, Zea mays
  unsure at all n locations
  Clone ID: LIB3078-056-Q1-K1-F4
cggacgcgtgggcggacgcgtgggcggacgcgtggggccgcactaccacgccatggaggccaccaaggcgatcaggcccatcctcggngactactaccacttcgacccgacccctgttgccaaggcgacctggcgcgaggccagggagtgcatctacgtcgagcccgaggaccgcaagggcgtcttctggtacaacaagaagttctagccgccgccgctcgcagagctgagaggacgctaccataggaatgggagcaggaaccaggaggaggagacggtactcgccccaaagtctccgtcaacctatctaatcgttagtcgtcagtcttttagacgggaagagagatcatttgggcacagagacgaaggcttactgcagtgccatcgctagagctgccatcaagtacaagta

SEQ ID NO: 69881 - DNA, 429 bp, Zea mays
  Clone ID: LIB3078-056-Q1-K1-F5
ggaaacgtctcgaatggtcgaacagtagtttgctcgctattatccatggcgacttctacggctgctgccactgcactgctccgccccaggccggcagttccagccaagaggaggtgcctccatgcggttgctgggtggacgacgatgaggaggaggggagctgcaggggtcgtgcgagctttcttcaaccctctcggggatgagcgcatcctccgagaagccatcaaggagccagtagcattcatgggtggtgtgtttgctggcctcttgaggcttgacctgaatgaggatcctctcaaggaatggataagtcggacagtggaggcttctggaatagctgaggaaaacagctctgaagaatcaagtgaggcagatcaaaatgatgcacctcagcaaattgagattgagtgaggtgcattgtctactttt

SEQ ID NO: 69882 - DNA, 414 bp, Zea mays
  Clone ID: LIB3078-056-Q1-K1-F6
gaccgcgccctgctccgccgcggcgccgccgagcgcgtcgaggacgtcatgctgccgggctcccccgagcggatgcggcgcctgatgcagctcgcctaccaccgcccgcgccgcttcacgccgggcttcgtgctccgggatctcgcccagtatctgtacagcgacaaagtagaagagaagaaggagctaatcaaggggataacgctgggcaacaaagacaagttccagcttactcctctcccccaggaagtccttgtgttgtggggagagcacgaccagatattccccgtcgagaaggcatttcaagtggcaaggaaacttggagcgaatgctaagctggaggtcctcaaggacaccggccacatgcctcaagaagaggatccaaagcggttcaacgaggcaatcctcaacttc

SEQ ID NO: 69883 - DNA, 350 bp, Zea mays
  Clone ID: LIB3078-056-Q1-K1-F7
cggacgcgtgggcggactcgaactttattttactctctattatacatgatgagggcgggatctactgacactgtactgctccttactaagctggcatttcaatgcaagagaaggtaccttcatgccttcgctctgtggaatataatgaagaatgatgtcagctacaaaggtcaagcgaactttcttcataccctatcggatatcagctcatccatacataatacatcaaggatccactatcattcatggatagcgtgtttgatgtcctcttcacgcttgaccttaatgaggatactatgcatgaatggataagtcgaaccttggaggcttttctaatatctaaggaaaac

SEQ ID NO: 69884 - DNA, 433 bp, Zea mays
  Clone ID: LIB3078-056-Q1-K1-F8
ctgaaactgaatataagagagattcattccagaaagtcgcagtctgcaagaactaaggtctcagacgaattcaggaaatcaaaaggtttgatactggtcagttcagacgtatctgcccggggcgttgactatcctgatgtcactcttgtaatacaggttggagttcctgcagatagagagcagtacatacatagactaggccggaccggacggaaaggcaaggaagggcaaggactcctactattggcaccttgggaaaaatattttcttggtgctgttaaggatttgtcaatagcagagtctgctgtaccaccagttgattcaagtgttgagacagaaaaatgcggtcagaaaagtagagatgaagagcaaagaatgtgcctatcaagcatggttagggtactacaactcgaacaagaccattggtcgagat

SEQ ID NO: 69885 - DNA, 440 bp, Zea mays
  Clone ID: LIB3078-056-Q1-K1-F9
ggcaccgtcgcgctccgggagattcgtaagtaccagaagagcacggagctgctcatccgcaagttgcccttccagcgcctcgtccgtgagatcgcgcaggacttcaagaccgatctccgcttccagtcctccgccgtctctgcgctgcaggaggccgccgaggcctacctcgtggggctctttgaggacactaacctgtgcgccatccacgccaagcgcgtcaccatcatgcccaaggacatccagctcgcgcgccgcatcaggggagagagggcctgagcgaggcgagctcctctcaccgcaggcggcgtcgttgttgcttcgggcctgcttgtaggacttgtgcttctcttggtttcctttctggtggcagtggcatcttcgtaccattgtgctggttcttagaatcttagggatagagagttgttcagttgctgggt

SEQ ID NO: 69886 - DNA, 437 bp, Zea mays
  Clone ID: LIB3078-056-Q1-K1-G10
cccacgcgtccgcccacgcgtccgcccacgcgtccggcaggctccgcatccgggtccggaaaacgcacggcctgtacctgcactccccatttccacgctttctctctcctctccgcagctctctgcgtgcgcgcgcggctgctcgcgggccccaggtgtcatagactgcatgcggagtgggatgtggagtgttgctggaaacggagacggatacggagaggagagagaaactgttggccgcgcgttttagggatacggagagggagtctgctggagttggtcttagagcccggagagctggagaagctagctagcgtgcttacagaataacagcagccaagcaaagccaagggtgtgtatataatagacatgccttgggttgtgtcagctgcgactgtatgtatagtttaaacgaagatgaaatggtactgatggtg

SEQ ID NO: 69887 - DNA, 426 bp, Zea mays
  Clone ID: LIB3078-056-Q1-K1-G12
ggtttttctgagctacagcggatgggaattggattagtcctgtccattctcgcgatgggatctgcagctctagttgagttgaagcgtttagagattgccaggtctgaaggtctcattcatgagaaggctgctgttccaatgagcattctttggcaaataccacaatatttcttggtgggcgctgctgaggtgtttacttgtattggtcaagttgagttcttttacgatcaggccccagatgccatgaggagtttatgtagtgcacttgcacttattacagtctcactgggaaactatataagctccatcatactgacattggtgtcgtacattacaactcagggaggagatcctggatggatccctgacaatctgaatgaaggccatctcgaccggttcttttggttaattgcagggataaagctt

SEQ ID NO: 69888 - DNA, 411 bp, Zea mays
  unsure at all n locations
  Clone ID: LIB3078-056-Q1-K1-G2
gggaacccgagcctcatccacgcgcagagcatctttgccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgnctcgccatgttctccatgttcggattcttcgtccaggccatcgtcaccgggaagggcccgctcgagaacctcgctgaccacattgccgaccccgtcaacaacaaccgctgggcctacgccaccaacttcgtccccggcaagtgaaggaggcgccgncggtgacctttaggtgtccggatgcatgtgagcgcacgc

SEQ ID NO: 69889 - DNA, 335 bp, Zea mays
  Clone ID: LIB3078-056-Q1-K1-G3
cccacgcgtccggcaagctagccgcgcgcgcttgttggaggacatcatttgctagatggcgcgtaccaagcagaccgctcgcaagtccactggaggaaaggctcctaggaagcaactcgctacaaaggcagcccggaagtctgcacccacaactggaggagtgaagaagcctcaccgttaccgcccagggactgttgctcttcgtgagatccgcaagtaccagaagagcactgagttgctgattaggaagctgccgttccagaggcttgtcagggagattgctcaggatttcaagacggatctgcgcttccagagccatgccgtgcttgctctgc

SEQ ID NO: 69890 - DNA, 352 bp, Zea mays
  unsure at all n locations
  Clone ID: LIB3078-056-Q1-K1-G4
cacgcctcctacgcgcgcctcctggtgcagcacgccaccgccttcgtcgaggacctcgtccgcgtcggtgcgcgccgcgtcgccttcatcggcatcccgcccatcggctgcgtcccgtcgcagcgcaccatgtccggcggtctcgaccggggctgctcgcagggccacaacgagatcgccgtcgcatacaacgccgggatggtgcagcagctggcggcgctgcgggccaagtaccccgacacgctgctcgtcttcatggacatctacggcttcctctacgacatgatgatgcacccgcgcagctacggcttcacgcagtccaccagaggatgctgcggcacgggcctnctcg

SEQ ID NO: 69891 - DNA, 386 bp, Zea mays
  Clone ID: LIB3078-056-Q1-K1-G5
cgagtacgcgctgcgctccatgagggccggcggcaagcggcgggtggtcgtcccgccgggcctcgggttcggcgacgacggcgccgacttcggggaggagcacgtccaggtcccgcccggcgcgacgctcgagtacatcgtgcaggtcgacagggtgtccatcgcgccggcgtgaggcggcagtagatagatcgcagtcctgtggtgttctgatctttattccatggctcggctcggttcttctgtactggcagtctgacactcggtagcgtgaccacaattgttctagacccatgggacaagttcattctcgttttttcaagcaagatctcccaaaagagcagagagatttctggagcttgcaaaccaagctcgttttgagcttc

SEQ ID NO: 69892 - DNA, 448 bp, Zea mays
  unsure at all n locations
  Clone ID: LIB3078-056-Q1-K1-G7
gcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgtcggcgtcaccggacctcctgccgatcaagaagggacctcaggagccgccgcagccgggcccgcgcggcaagatctaagctcagcttctccatttgcatggtctagtagcttgctttgtactgctagcgccggtcgatccgtcgcaatcgtcatggatcatctctctatcttggtggtacgctgntcataatttggtatatttgccattccgctatggtgtactncttggcatacatacaataat

SEQ ID NO: 69893 - DNA, 451 bp, Zea mays
  Clone ID: LIB3078-056-Q1-K1-G8
cccacgcgtccgcttcaagtccgggtaccagtagttgcagagctcttcttccaaatggtggatgcacaggaaaaatgtacagtccaaacaacaatatgtcatttcctccaggaggatgcacatcgctgcgtttgcctgtggtggttacaggccaagaatttactcatgttgcgagaagcagacgtgtatatgcccatgcccatgactaccatattaattccatttcaaataatagcgatggagaaacgttcatatcagcagatgatctgcgaataaacctttggaatttagaaattagcaatcagagctttaacattgttgatgtgaaacctgcaaacatggaggatctaactgaggtgatcacttgtgcggagttccatccaactcactgtaatacactagcatatagtagctcaaaaggtactattcggctttatgatctgcgacagtc

SEQ ID NO: 69894 - DNA, 450 bp, Zea mays
  Clone ID: LIB3078-056-Q1-K1-G9
gcgcccacgcgtccggggccagaaggtcaccgttcactgcaccggctacgggaaggagcgtgagctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcgcatctgtcagctatggaaacgttggccatgcttctcaagtaatgaaataattccgttgtcacctcatgctacatacagcagattggtgttacgagttaaatcctgtgaaactttagcattctgtaaccgtggatgtcgagtttat

SEQ ID NO: 69895 - DNA, 250 bp, Zea mays
  Clone ID: LIB3078-056-Q1-K1-H1
cggacgcgtgggcggacgcgtgggtccggcgcgtgggcggacgcgtgggccaaggccatccagatgttcgatggcgccctgctgggagggaggacggctagggtgaactacccggaggtgccgcgtggcggggagaggagaacagtcaccatgagtggccgcaggcgtgacgatggcacttacaagatttatgccggcaacctggggtggggggtgcgtgccgacacgttgaggaacgtgttcgagggta

SEQ ID NO: 69896 - DNA, 149 bp, Zea mays
  Clone ID: LIB3078-056-Q1-K1-F3
ccgttacccggcgtcttaaaccctagttcccattccatcttcgattccgctccgccggcggggatttagtgcttacttcttgagcgctaacctgtatccactgtcaagcgtgagccagtacattgctccactctgtacgttacatatgc

SEQ ID NO: 69897 - DNA, 331 bp, Zea mays
  Clone ID: LIB3078-056-Q1-K1-D9
tcggttactctaactcttacgccaacttatcttattctttcaaggattcaaaaaagcttatgggggagctatgctccaaaataaaggtgggtgatagatgtgaagttatgcctgttgccaaaaggggcactgtaaaatttgttggtagagctcaagcccttggacgtggattttaggctgtaatgcagtatgatgagccacttgtgaagcatgaccgcatggtgaaaggcatccgcttctttgagtgccctcaaggtcatggggcattcgtaaggccacagaaagtaaaggttgtcgacttaccggatagagacccttttgaagacgacga

SEQ ID NO: 69898 - DNA, 223 bp, Zea mays
  Clone ID: LIB3078-056-Q1-K1-E1
actagttctagatcgcgggcggccgctcgcggcgccactgagccactcaacgtcgagatcgagacgacccgagtccgccgcgcccgtgcaccaccgaccgtcgaactcccgaaagtaactctatttcttgatcaacatcaacatgtcgcgggaggataatgtttacatggccaagctggctgagcaagcagaacggtacgaggaaatggttgagtacatggag

SEQ ID NO: 69899 - DNA, 418 bp, Zea mays
  unsure at all n locations
  Clone ID: LIB3078-056-Q1-K1-E10
gngtactacccacttacccttcatttcagtgaagattacccaagcaagcctcccgaatgcaagttcccacagggttttttccacccaaatgtttatccttcaggaacagtctgcctctcaattctcaatgaggatagtggttggagacctgctatcactgttaagcagattctagttggaatacaagacttgcttgatcagcccaatccagctgatcctgcccaaactgatggttatcacctattcatccaggatccaacagattttaagcgacgtgttcgtctgcaggccaagcattatcctgctctggtctgaggatgttggcataccatagatccatgatccatcctgcacatccgcatagtagttgcaaatgttaaaattatggtctcaaattggatttgacaagacataagtt

SEQ ID NO: 69900 - DNA, 453 bp, Zea mays
  Clone ID: LIB3078-056-Q1-K1-E11
caccactccgcgctagctgaggacggtacagcggcacagaggtgcgacgtacgaggacgacgacgcaggcgccacacatggcatcccagctctccgccgccgtgccccggttccacggcctccggggctacgccgcgcccatgtccgcggtggcagcgctgccgtccgtgagggtgggcaggaagaggtcgtcgtcgcagggcatccgctgcgactacatcggctacgccaccaacctgatcatggtgacgacgacgacgctgatgctgttcgcggggcggttcgggctggcgccgtacgcgaaccgcaaggcgacggcggtgctgaagctggaggcgcgcgactccggcctgcagacgggtgaccccgccgggttcaccctcgccgacacgctggcctgcggcgccgtcggccacttcctcggcgtcgcttcgtgctcgggctcaagaacac

SEQ ID NO: 69901 - DNA, 423 bp, Zea mays
  Clone ID: LIB3078-056-Q1-K1-E12
cagaacctcaagagctaccccttcgtcaaggaagggctggccggcgggacgctcaagctggttggcgcccactacgacttcgtcaaagggcagttcgtcacatgggagcctccccaggacgccatcgagcgcttgacgagcgggttccagcagttcaaggtcaatgtctatgacaagaagccggagcttttcgggcctctcaagtccggccaggcccccaagtacatggtgttcgcttgctccgactcccgtgtgtgcccatcggtgaccctgggcctgcagcccggcgaggccttcaccgttcgcaacatagccgccatggtcccaggctacgacaagaccaagtacaccggcatcgggtccgccatcgagtacgctgtgtgcgctctcaaagtggaggtcctcgtggtcattggccatagc

SEQ ID NO: 69902 - DNA, 346 bp, Zea mays
  unsure at all n locations
  Clone ID: LIB3078-056-Q1-K1-E2
cggacgcgtgggctcgccgcaagaccgtcaccgncatggatgttgcgtacgccctcaagcgccagggccgcactctgtacgggttcggcggttgagcgcatctcttccctcgtctgcagcggctgccggtggcgtttcctcagttccctctgacttgcttggcttgatgtacagagttatcagattaaaatatctctgatgtgcttcggtattgggcggaatcatgggtcccagcagtgctggggaatcaaggatcaagatgtatctttctttgccagaattgaatggtcaaatcgaaatcaagatggatctttctttgcaagtaaaaaactttgctattgggccc

SEQ ID NO: 69903 - DNA, 378 bp, Zea mays
  Clone ID: LIB3078-056-Q1-K1-E3
cccgtccacgttcgccacgctcgccatggacccggacaggaagcgggaggtcgttgacgaccgcgacatgttccgcgacggcagggactactacgcgtccgtgggcaaggcgtggaagcgcggttacctgctgttcggcccgtccggcaccggcaagttcaccatgatcgccgccatggccaactacctgggctacgacatctacgacctggagctcacggcggtcaagagcaacacggagctcaagaagctcttcatcgagaccaagagcaagtccatcatcgtcatcgaggacatcgactgctgcatcgacctcaccggcaagcgaaagaagaagaagaaggacaagaacgatactaggaagaagaagaagaagcg

SEQ ID NO: 69904 - DNA, 395 bp, Zea mays
  Clone ID: LIB3078-056-Q1-K1-E4
gccgaagcggctgccagtaaatctgaagccgacacgaagacgacaccttcagaggaggcagctgctactcctagcgcggtgaacggggctcaggcctctctagagaacctcttgagtagagccaaagtgatcagtgcggatttctcgtgggagaagttcagcacacagtttgccgacgtgacgacccctctaacctcatcactagagaaggaacccaacaaggcacagatagccactgtgcgaggccaggaaaaagcgaagaagctggcaccgcggattgctgttgtgaagccagcagcgcagaaggcgaagcagccggatcccaaaccagaagtgagagcactgtttggtggcctcttcaaacaagaaacggtgtatgtggatgatgactaaaa

SEQ ID NO: 69905 - DNA, 433 bp, Zea mays
  Clone ID: LIB3078-056-Q1-K1-E5
ctcgtttcgccgcctccgccgacaccgactgcctacctcagctgccgtcgccatgggcagaaggcctgctagatgctatcgccagatcaagaacaagccgtaccctaagtccaggtactgccgtggtgtccctgaccccaagatcaggatctacgatgtcgggatgaagaggaagggtgttgatgagttcccctactgtgtgcaccttgtctcttgggagaaggagaatgtctccagtgaggcgctcgaggctgcccgcattgcctgcaacaagtacatgaccaagtctgcaggaaaggatgccttccaccttagggtccgggttcacccgttccatgtcctccgtatcaacaagatgctttcctgtgccggggctgataggctccagactggaatgaggggtgcctttggcaagcctcaaggcacctgtgct

SEQ ID NO: 69906 - DNA, 446 bp, Zea mays
  Clone ID: LIB3078-056-Q1-K1-E8
gcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgcgctggcgcgcgacgccgcggagcagcttcggctgccgcgggccggcacgtcggcgtcggcgtcggcgccgtggcagcgggcgcgaggaccacctccacggccacggcaagacggccaaggtgatgcacctgctgctctggggacccaagtgaagcggcgagaggccaccgtaccgccgggctctcccgctggcgttgctcgttgtgctctgcctgcaatccgccccgcacggactgtactgtacctatatatacacctacatactacgacgtgcacctgtactacgacgtgctggtgtccatac

SEQ ID NO: 69907 - DNA, 394 bp, Zea mays
  Clone ID: LIB3078-056-Q1-K1-E9
gccgcccctgttcctgaagatagtctactatcctctaagactgcgccttgcctcacacgagacatggttgttagaatctagtccttaacgaaggctcaacacgaacagcccatggctgcactctgatatcaagaaaagtggtcccatgttttcttttatatcatctgcactaaacgaagggaagactcgtatgtatggagttgtccttgccgaaagagaatgtggttctggataatgcgagttgtcagggaaaccatggactcatgctatatacttatttgggacagtgaaacagcgcatgatacatctaaacattgaggattttgtgcatgactactattcactacagaagttcaagatggtgtatcactttcagattaatctaatgagtgac

SEQ ID NO: 69908 - DNA, 410 bp, Zea mays
  Clone ID: LIB3078-056-Q1-K1-F1
cgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccacgctggcacggagtacaagattgatctgtgcaggttcgacgagagcttgacggagatctccgggaccacgggcccagcctacaacattgacaatctggtcaagtctctcaaattcgtcaccaacaaacgcgcttacggaccgtacggcagggacgagggcaccccgttccgtgtcaaggtgatgaacaacggccacgtcgctggcttcttt

SEQ ID NO: 69909 - DNA, 429 bp, Zea mays
  Clone ID: LIB3078-056-Q1-K1-F10
gcctgtggttatcccgcacctgcccgttcacggccactccgtgccgcctgtcaccaaggcgccgccggtagacgttcctgagcacaaaccggcgccggtgcccgtgccggaccacaagcctccgtcgacgccgccggtagacgctcctgagcacaaaccggcgccggtgcccgagccggagcacaagcctccgtcgacgccggcgaacgctgcaccgtcgacgcccacggagccgtcagcgccggttaattcgccgccgaagccagcccccatctaccacccaccggcaaggcacgacgctgccactggcccgtagctcttcaagaggctgctcccgttcttcaagaagttgcccttctttcctccttctgcgatggagagtcagcactagaatgtttggacagtgtttcttggcttttgcaggttatg

SEQ ID NO: 69910 - DNA, 448 bp, Zea mays
  Clone ID: LIB3078-056-Q1-K1-F11
cccacgcgtccgcccacgcgtccgcccacgcgtccgggcgaggagcggagcggagaggagggcccttctgcttgtttctccgctttgcaagatgtcgtccccgagcaagcgccgcgagatggaccttatgaagctgatgatgagcgactacaaggtggagatggtgaacgacgggatgcaggaattcttcgtcgaattcaagggcccggccgaaagtatctaccaaggtggtgtctggaaggttcgggtagaactgcctgatgcatacccttacaaatccccgtccatcggcttcatcaacaagatttatcacccgaatgtcgatgagatgtctggctctgtctgtttggatgtcataaaccagacatggagcccaatgtttgatctagtaaatgtttttgaagtattccttccacagctgttgctgtacccaaatccttctgatcca

SEQ ID NO: 69911 - DNA, 432 bp, Zea mays
  Clone ID: LIB3078-056-Q1-K1-F12
gcggctctggtcgatggtgcccgccggcaaggccgcggaggcggccggcgcggaccaggcgcccgctcgtcgacgtgacgcagttcggctacttcaaggtgctcggcaaggggatgctgccgtccaggcccatcgtcgtcaaggccaagctcatctccaaggtcgccgagaagaagatcaaggctgccggaggcgccgtcctgctgaccgcttaggtccttttgcatcttgtttcaactatctgcgctaagaaatattctatctttttttgggtggatctatgagaccctggttttgagcacttggtaacgaatatgagttcgattatatcgatgctgcatacctcttgctgcatgtattattcattctatgcagttgcagttcatgtgggctgtgctactgagatatgaaatgttttggcatttttctgat

SEQ ID NO: 69912 - DNA, 400 bp, Zea mays
  unsure at all n locations
  Clone ID: LIB3078-056-Q1-K1-F2
cccacgcgtccgctaagctggccaaagctattttcaattcagtgataaattgctgcatgtaggttctagggcttcaaaggttgacactttgttcttttatagcaagggaagtgtctcaatatttttttggtctatgttgatgacattgtagttgctagctctntataggatgctattgatgctatgctccaagatttgagttcagagattgcatcgaaggacctaagacaactccattacttccttggaattgaggtatagaaaactggtgatggcaattacttgtctcagactaagtacacgttagattcgcttttaggttgaaatgatgaattgcaggcctactttgactttgccagtacttcagaaaagttaagaactggtgaangtgaactactag

SEQ ID NO: 69913 - DNA, 403 bp, Zea mays
  Clone ID: LIB3078-056-Q1-K1-D8
gcgccacccacccacccactcgcttcagccgcctccgccgcgcgtaccaagcaggtggagacaggatgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaagagttccgcctgaggaaggcgaagaatga

SEQ ID NO: 69914 - DNA, 220 bp, Zea mays
  Clone ID: LIB3078-056-Q1-K1-C3
cgggactggatcgtatctatccggctttactttagaatgacctacggatttcacaaggtgagggtgaatcggactacgagtctggacacattactcatgaatgacttcagaagtcatattgacgaaccatagcatccctgtatccattggcaaacatactatgattctctatcgaccgatgatgtgagaccattagcactgatcaagctcaactgcttga

SEQ ID NO: 69915 - DNA, 436 bp, Zea mays
  unsure at all n locations
  Clone ID: LIB3078-056-Q1-K1-C4
ggcgctacaagatcggcagccactacttcccggacatcggcgggctggaccacagcagcccggccgccacccacggccagttcctccccggggccgacgacacctgggtgcccaaccccggcttcgaggtccccaaccccttcatgcccggcgcgggcactccctgaacacgtacccgcgctggcgaaggtggctctcggtcgatctgatcgtcgcgcgccgncgnccgccctgaacgaaatatactactagctactactcgctctgctacgtattagctagccgtgcttgcctgctgcatgtacgcatgtcttcgtgtggcctgtcccacgtctctcttctagtctctgtgcactttacgctccagtgaagttactgaagtgtgcgcgcgcgatgcgtagcagatcttttggccggtaagttgtgctggaagtgt

SEQ ID NO: 69916 - DNA, 365 bp, Zea mays
  unsure at all n locations
  Clone ID: LIB3078-056-Q1-K1-C5
ggtagatattaagtccagttcccctgaaaatgctagttcaagcaactctgaaaagcaggaaccgaaaaaaatggtgcctgaagatactcgggtgaagaacattaagggtgataatgtgatgccagtaacaccatctttagatcctgctacgtcaacttccaaggctggtaaagggaagacacgggaaccagagcccactgagcggcaaggagatgggtcagtctcggtggctaatccaaagaaagaatctagaccagtttttgaagataacattgttctgggcgtagcccttgagggttccaggaggacactgcctattgaagaaggaaatcctcatctatcactatctgagactgangtggaca

SEQ ID NO: 69917 - DNA, 378 bp, Zea mays
  Clone ID: LIB3078-056-Q1-K1-C6
cccacgcgtccgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtccaggttggcaaggaaccgcaggactgtgaaccgtccatatggtggtgttctgtctggtaccgcagtgagagagaggatcatccgtgcctttttggtcgaggagcagaagatcgtgaagaaggtttttgaga

SEQ ID NO: 69918 - DNA, 365 bp, Zea mays
  Clone ID: LIB3078-056-Q1-K1-C7
cggacgcgtgggcggacgcgtggaggtcggccaggaccaggatggccgtcgtgcgggcgtacgagcaaaagcagcacccggccaacgagtgtgcggccgcggctgccgtggcggtggcgctggtgctgccggatgtcgcggaggctgcgcctgggatctccacatcgctcaagaacttcctcctcagcatcgtctcccgtggggtcgtgctcgtcgccatcgtcggcgccgtcaacgccgtctctaacttgcatcccgtcacgcggtgctgagctgtatgcgtcgttgtgtgacgtatgatcgtacctatgtactgagatctgttcccccgtgtgcttaccaatgaaaacagggtttaatgcatg

SEQ ID NO: 69919 - DNA, 396 bp, Zea mays
  Clone ID: LIB3078-056-Q1-K1-C8
cagatgctgatataacagttgcagccctgccaatggatgaacaacgtgcaactgcatgtggtcttatgaaaattgatgatgaagggaggatagttgagtttgcagaaaaaccaaaaggagagaagctgagatcaatgatggtagacaccactatattgggccttgatcctgaaagggccaaagaactgccttatattgccagtatgggaatctatgtttttagcaaagatgtgatgcttcgtcttctcagagaaaattttcctgcagcaaatgactttggaagtgaggttattcctggcgcaacagaaattggattaagggtgcaagcttacttatatgatggttactgggaagatattggtactattgaagcattttataatgcaaacttgggaa

SEQ ID NO: 69920 - DNA, 419 bp, Zea mays
  Clone ID: LIB3078-056-Q1-K1-C9
acgccgaatctcacgcgaccacccacgcatacccggattcgagggtacccatatcgagaacaggcaagcgatcgcaacagcgatgaaccgctgtctcctcctactcgcctgcatcgccaagacgacccaaccaacttatcgcggataccatgccaccggcgtgaagagaatcatacgacatggacatgaagagccatactacatgcatacccaacacatgtataacctgcacttcatgaagcctacggcgatcaatgtgacacctatcctagctgggagcggatagcactagtgtcggagaacctgaatatacagccatattgcaacactaagacgactgtctcaggctgacatgattcctatcgctgtctgcatatgcctacttattttcagacacattcttttgaaagaaaaagctt

SEQ ID NO: 69921 - DNA, 362 bp, Zea mays
  Clone ID: LIB3078-056-Q1-K1-D1
cggacgcgtgggctgagcgtccagataactggagggagaatgctggtccagctcaagaggtatttgctagaactgcaattgccatttcaaagtttgaacccgtcacgttatgtgcaagtgccaagcagtaccccaaagtccacgagctgatggaacatcaaaccaacatcagggtcgttgagatgagcatgaacgattcctggttccgcgacatgggccccacttttgtcacctgtaaaggggattcaggaattgcagaacaaacaatagcaggaattgattggcaattcaatgcctggggaggaatctatgacgactggagtcttgacagcgatgttgccaagaaaatagtcgagatcgag

SEQ ID NO: 69922 - DNA, 442 bp, Zea mays
  unsure at all n locations
  Clone ID: LIB3078-056-Q1-K1-D10
gttactagtcagatttatgtacatagcaagttaatgatagttgatgaccgcatcacattgattggctcagctaatattaatgatagaagcttgcttggatcaagagactccgagattgctgtggtcatcgaagataaagaggttgttaattcaaaaatggatggaagaccttgggaagctgggaagtcctctttaagcctacgcctctcgctgtgggtggaacaccttggccttcatccaggagaggttagccatatcatggatcctatagatgattcaacattcaaaaatatctggatggccactgccaagacaaataccatgatataccaagatgtcttcgggtgtgtacccaacgatctcattcactcaagggttcaatttcggcaaagctttgctcacttgagggacaaaattggccacactacaatngatttgggtg

SEQ ID NO: 69923 - DNA, 198 bp, Zea mays
  Clone ID: LIB3078-056-Q1-K1-D11
acgcgtagcttattcagtatgcacatatcctcgtacactcttttctctcatagtgtcgtaatgggcaaggctgttcctgaaagagtgttgggtaactgcgatcccgtataccctactgcctacgtccatacattgaatggatctgaacgaaataccttatatacgcagcttcttaaattaaagcaaaaaatgctgacc

SEQ ID NO: 69924 - DNA, 427 bp, Zea mays
  Clone ID: LIB3078-056-Q1-K1-D12
cggacgcgtgggggctcaccagcgtcttcggtggcgccgcggagccgcccaagggcggggacccggactccaacacgctcatcagtgacaccacgacagtgatatgcctcgacgactaccattccctggacaggaacggcaggaaggagaaaggtgtgaccgccctcgaccctagggccaacaactgtgatctcatgtatgactaggtgaaggcgatcaaggaaggccaggcagtcgagaagcccatgtacaaccatgtcactggcctactcgaccctccggagcttatcgcgccaccaaagattttcgtcattgaaggtctgcacccaatgttcgatgagcgagtgagggacctcttagatttcagtatctacttggacatcagtgatgaagttaagtttgcatggaagatccagcgggacatggc

SEQ ID NO: 69925 - DNA, 363 bp, Zea mays
  Clone ID: LIB3078-056-Q1-K1-D2
cccacgcgtccgcccacgcgtccggtggtggcgagcgtgcggcgcggggactactacgggacgtggcccggctggtactggcccttccacatggtcatgtgcgccgcgccggagctgctcgactggttctcccgggccttctacgtctgcagcaagttcggcggccaagacggcggcggcgccgcgctgagtaagaagatcctggaagccgtcggcgggaaaaagttcctttacccccagaccatcccgtgccagcagaccaccatgggtggcagctaataactactgactcgctcaagatggtagccagacataaagataccacattttacatgtataaactcgcgcatgcatggtcgatct

SEQ ID NO: 69926 - DNA, 423 bp, Zea mays
  Clone ID: LIB3078-056-Q1-K1-D3
cccacgcgtccggattctccatctctggagcgtgcaagtgatggcaaatattggtccggatcaccgtctggtggatgctagaaaggtttgatttcctactgcgatggcactcctgattcagctgggaagtacgtttccaccggatgtactacctttggccattgtctctagatccgtccagtgttacttcactactgtagagaagagaacggttttggtccttgaggcgcccactgtactggtgttgtctgtgtacaactgatacttaaggtgtttgggatgatcgtgagctgccttagattatcttaagactagtaatctgagcttagactacgctcatgctgaacatgtatcacggattcagcttaattaccattggtggaacttggatgttataaggattgacgcataggagatcattac

SEQ ID NO: 69927 - DNA, 302 bp, Zea mays
  Clone ID: LIB3078-056-Q1-K1-D4
cccacgcgtccgcagacgcgtgggcacgagccacaggcacaggcaggctctcgagctcagtccacccatcgcatgggatggcgtcgtccttcgccgtggcaacagtgccgtcgctagccgccccggcagccaagaagcggtccggcggcgtcacgtacgtagagggcatgaacgcctacagcggcctcaaggggctgaacaaggtgaacatgctccgggtgcgcaagaccgtcgactactacttcggcaatgtcgtggcgtctctcagacccgcagggaggaaactgcgctgcggcgcattc

SEQ ID NO: 69928 - DNA, 431 bp, Zea mays
  unsure at all n locations
  Clone ID: LIB3078-056-Q1-K1-D6
cccacgcgtccgggagtactcccgttccgagcacactagtcttccctgcgcttgctcgctccttcttgcccccatggcgctgctcgccgtccagggcatggccatgtccaccgccgccgcggccctcccatctcacaaccacggcgccgtctcatcctacgtctccacctcctcctacgcgctcgcagcctccgccgccttcccccgcgcccgagctgcgttcgccgtcggcaccgtcttgtcggccaccgtcactccagttcttgacgtctactgcgggagaggggacaagaaaacgaaaaggggcaaaaggttcaaccattcatatggcaatgcgaggccgcgcaacaagaagaagggaactgggcctgcgcggctctttgctcctgcaactcctncaaagaaagatcagttcgatgatggggagatca

SEQ ID NO: 69929 - DNA, 441 bp, Zea mays
  Clone ID: LIB3078-056-Q1-K1-D7
gccagtcaaggtcagcaagaagaactcggctgcagtcaccaagttcctcgatgagctggctaagattgacttccctggagccaaggtggtgagcgaggcggtggccaagtccggcacctcgcccctgcttccggcgatcaccttcatcttggacaaggtcgcaccgtttatccccaaggaggagcccaaggcggagccggcggcggaggccacctcccgggaagtcgccgtggaggagaagaaggaggaggccgagccagctgcagcgactgaggcggcaccggcgccggcagagacaccgtcggaggcggcggtggtagaggagaagaaggaagaagagaagaaggaagaggaggataagccggctgccgaagaagcggcgccgtcagcagaagcagcagctgctgctgaggagaagtgatcctgttgacggatcgagca

SEQ ID NO: 69930 - DNA, 422 bp, Zea mays
  Clone ID: LIB3078-056-Q1-K1-C2
cacgaatagattggatctatccggctgcactttagaatattcttagtattatcttggtgaataagaaaaggtgcacgatctcgacaaattacttctgaataacttcagaaatcatatggaagaaccatagcatttcgcgattcattggtaaatttactatgattctctatagaccaataatgtgagaccattaacacggttaaaggctaaactgctggagtccgggcaaaaagggggactctttctacaactacattagcattagtctcgaaatgctttaaacgggaaatagctaacgtagaatttatctgatctagaacactcatatcgattaaataggtagaactatgtactagaaaggcacgcagcccttttttcaatgccaaatcgacgacctatgtatgaaaaaaaaaaataagggc

SEQ ID NO: 69931 - DNA, 260 bp, Zea mays
  Clone ID: LIB3078-032-Q1-K1-C7
ctgccgctctggtcttgcatctacttggtgttctataacagagctcgcatcgtgaccaatatgtatgtgatacatggcacgtcagacattacgatcataattgctgaataatctgtgcttgaagctcaagttgactaatttaaccaggacaaggatgttgctgaactgcatgtataaacacctaacgatagattctgacctatacctgcacacttgtctatagacctactggaatgactcaaagggtatgccattgtaaa

SEQ ID NO: 69932 - DNA, 144 bp, Zea mays
  Clone ID: LIB3078-032-Q1-K1-C8
aggatatccaatgcatgcgcttcttgcgattcgtcatgtaaaatcagggtgtctgtctataagctagcctccatggatgctcaaccttcgtcatgtaacaataatcagtgctactcttcattacataattttgatgctatatat

SEQ ID NO: 69933 - DNA, 467 bp, Zea mays
  Clone ID: LIB3078-032-Q1-K1-C9
cttttgtagggaaacatcgatgaacaaaccatttttcatgctgttgacattaaatttcagtgatggtggcagctgtttgagctcctcaattggatggcctgttgattttcagaagcgaaaagacagcttcgtcagagatagagctctagtcctacgggagttgtactctgctgcacagcgcgagtcttgcattgggcaacaagaaattctggaaagagagaacctaccaagagctgagacgtctattcatggaatcgtgacaaacatcgttaggtatgacactgaagatgaaaagttggctccacccaaaaaatgattgatgaatcacagccgcaagcacccttgcaaacggcacgtggaaggcactgattgccactcgtcattgccaaaagaacttgaatactttttgaaagacaagaagctgaactgctaaaagtgtaaaaccgtagaaggtagatagagaatgc

SEQ ID NO: 69934 - DNA, 336 bp, Zea mays
  Clone ID: LIB3078-032-Q1-K1-D1
cccacgcgtccgcccacgcgtccgcgccggcctcactggccggaagatcatcatcgacacctacggtggctggggagcccacggcgggggcgccttctccggcaaggacccgaccaaggtggaccgcagcggggcctacgtcgcgaggcaggctgccaagagcatcgtcgccgccggcctcgcccgccgcgccatcgtccaggtctcctacgccatcggcgtgcccgagcccctatcggtgttcgtggacacgtacggcaccggcgcgatccccgacaaggagatcctgaagatcgtgaaggagaacttcgacttcaggcccggcatgatcatcat

SEQ ID NO: 69935 - DNA, 280 bp, Zea mays
  Clone ID: LIB3078-032-Q1-K1-D10
tcaccagctagcagcagcagtttcctagtgagcttaccgccgctgctagtgcctgacaactgtcgtgtgctgtgctagctccgagaagcttagcgcgagccaaagccaagaggaagcttcggccggccgggtgatcgagatcgccggaatgggagccagcctgtcttgcttcggctcgggagctggcgggtactactacgccgacgagccggggtacgagcagccgcggcggtcgtccaggaaggtgcggtcgagcgacgaggacgggctgtggtacgtt

SEQ ID NO: 69936 - DNA, 211 bp, Zea mays
  Clone ID: LIB3078-032-Q1-K1-D12
cctgaatccggtcgaccacgcgtcgaaaaccgatcgctgcgtcagtcctttctttcgacccgtgcaccagggcacgtcaatgcacaatccggttggtcggcgatgcgagacatcaaccccacacacagcgagaaggagtatggacacacagcgagaggcccaactgagtcctgacttgcagtggcgtgccagcggttgcctgtgcttacgc

SEQ ID NO: 69937 - DNA, 242 bp, Zea mays
  Clone ID: LIB3078-032-Q1-K1-D2
cggacgcgtgggcggacgcgtgggctggtgtcgttgtggacattgaggtgggacttggccctgcgggcgagatgaggtacccatcgtatccccagagtcagggatgggtgttcccaggcgttggagaattcatatgctatgataagtacctgcaagcagactttaaagcagcagcagaagaggctgggcatcctgagtgggatttgcctgatgatgctgggacgtacaatgacactcctgag

SEQ ID NO: 69938 - DNA, 304 bp, Zea mays
  Clone ID: LIB3078-032-Q1-K1-D4
cccacgcgtccgcccacgcgtccgcccacgcgtccgtccatctagagctccctaactgcaccggcggccacaccaccgtaccccgacccctcgacaacaatggccaccgtcctaggcagcccccgcgcgccggccttcttcttctcgccgtcctccctccgtgccgcgccggcgcccaccgccgtggcgctgcctgcggccaaggtgggcatcatgggccgtagcgccagcagcaggggcaggctgcgcgcgcaggccacctacaacgtgaagctgatcacgcccggaggggaggtggagctgc

SEQ ID NO: 69939 - DNA, 369 bp, Zea mays
  Clone ID: LIB3078-032-Q1-K1-D5
cccacgcgtccggtattggatactgtacaaaacccaatgcaaaatccattatcaggttatgggtagattctgagattctggcacacaatccaatgcagaatttaagaggtgtttggttcataatgggattctagaatgaaattctgaaaatgaagtacgaaacaaacagggcttaagttggccaagtttgcaactgctttaggtggccatctgaagcataaattaggaagttccttaaagtgcatgtaaattttctaggtgaatacgatattacacaacaaaattaattcgcaaaatggtccagcaatgtgttgcaattgatggcattcacatttttttcttgttccttggcccatttagttgactaca

SEQ ID NO: 69940 - DNA, 371 bp, Zea mays
  Clone ID: LIB3078-032-Q1-K1-D6
ctcgtagcgaatcggaccggggggctagggttccggtgcgcctctgcaatcggacgcgaggcgaggctgggcatggagggaaccgctgcggcccggaagaggtcccggccggagacggcgaacggggctgccgccgccgggaagcgctccaaagacacggagtcatttcaaactggtctatcaagcaaatcgaagccttgcaccaagtttttcagtacgattgggtgcccgtttggcgagggatgtcattttctggacttttgtccctggtggttacccggcagttgcaaaaatgctgaatctaagtagctctgctgaatctgcgccatcaggaactaaggtggatcaggccgtttttaccggggccttta

SEQ ID NO: 69941 - DNA, 176 bp, Zea mays
  Clone ID: LIB3078-032-Q1-K1-D7
cccacgcgtccgcgcacgactgcgtgggactttgtgtgcagatacctggtgcagacccagatgggcaacgtgaatggacgactgtggacaagcacatgagcctggtcatatacccgacgatcaaggcggatactaaggccactacctgaaccggctcttctaccaatgctacaact

SEQ ID NO: 69942 - DNA, 284 bp, Zea mays
  unsure at all n locations
  Clone ID: LIB3078-032-Q1-K1-D8
cccacgcgtccggccaccaccattccttccccaactctgcaggctgctcgtcgccctccctcgacgccggacgcgccccgatccagatccaggggcgtaacatggcatcaaaacgtatcctcaaggaattaaaggacctgcaaaaggaccctncaacgtcatgcagtgcaagtcctgctggtgaagatatgttccactggcaggcaaccatcatgggtcctcctgataggccatatgctggaaggtgtttcttaggggacaattaatttccccccggactaccc

SEQ ID NO: 69943 - DNA, 330 bp, Zea mays
  Clone ID: LIB3078-032-Q1-K1-D9
cttacttccgcggactagttttttctgaagattctgcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaagaccctacagcacagactgagattgataactttatggttcaacaac

SEQ ID NO: 69944 - DNA, 67 bp, Zea mays
  Clone ID: LIB3078-032-Q1-K1-E1
ggttatatcatggagctctgcgtctctaccactggctgggttcgtgccaacggcgcgcccatattct

SEQ ID NO: 69945 - DNA, 291 bp, Zea mays
  Clone ID: LIB3078-032-Q1-K1-E10
ggcggaggtgccggtgcaggaggcggctatggtggaggagctggtggtggatacggtggaggtgcaggatgtggcgccggaggcggctacggcggaggagctggtggtggtgccggtggtggctacggcggaggcgctggtggaggctacggtggtggtgcaggtgctggctctggcggcggcggtggttatggtgctggtggcggaggtggaggtggcatcggcggcggtgtctgaatcagcgtctcacatgcatgcatggtggtgcaagctgcaagcagaagcaagtgc

SEQ ID NO: 69946 - DNA, 360 bp, Zea mays
  Clone ID: LIB3078-032-Q1-K1-E11
ctcgctgacagtaattgggtgcgaccgaggcgtcctggcaaagccgttgccttgctagacactgaagctcagcttatcatggtgaacgaggattggctcggaggtccatggatctccatatcagtcctgtttatggacggcgatggcggtacgaaacttggcggcggtgccatggttcagaaaggtacagtgtttggatccgacactagcatggtgctagagacacagaccgtcggagcatggagcgtggcatccaatctagcacaatgtggcacttgcagcggcctgttccggtggggatgttaaagaaatggcaacctgcaaggttaaccttccaacctttgccccttttgcaccggt

SEQ ID NO: 69947 - DNA, 391 bp, Zea mays
  unsure at all n locations
  Clone ID: LIB3078-032-Q1-K1-C6
ttcatcgacggcgacctctggctcgccggcacgtccatccccttcaccaccggcttgtgagcgcgcggccgtcgtgtgctacgtacgaggggtttcacggcaaagggaaggcaataaaccaaattggcggcggaagttcgtcgttcatacgttcgttcatttcaatcagagctaaaaaaagcaccgtatcgatccggtcgtgttactgtagttgattattttgtgcttggggacgcaggccaatatatttatttaatttaaccgtcccatatatatgtacacgtgcttgttatgattcggtgtattatttatatgtattgatacggtatcaatatataattaataatgatacgggtnctaataaaaaaaaaaaaaaaaaaaaagggccggc

SEQ ID NO: 69948 - DNA, 310 bp, Zea mays
  Clone ID: LIB3078-032-Q1-K1-E12
gctaatgaagctctaaaggatactacaaagatggacacggatgatgcaccaagtgatcatgttgctggaactgatgcgaatatgcatgagcatagaagtgctgacactactgaggctcctgctgaaaatggagcacaagattctgaggaaaaatctgttccaatggaaactgatgcaaaggttgagccatcgaaaaggaaaattaagaaaacttctgttccgatccatgagttggtctacggcgcattgtctgccactgacctgcagaaggctgtagagaaagagtatgagatggctctgcaggacagag

SEQ ID NO: 69949 - DNA, 360 bp, Zea mays
  unsure at all n locations
  Clone ID: LIB3078-032-Q1-K1-E2
gctacaccgttccctcagtggcaccgccgtggccttccagttttccaaggatctgaacatttgcgtgcggacggatcctgaagatggcctggagggcttcttcattgcattgtttgtcaggaaagcaggccctacttcagaagagcctagcgaagatgccacggtagaagtaagaaccaaacaagtgcgcgggaggcgaaatggggtcagggcgttcagctccttgaggctgtccaggatgatcctctggtgaccaaaggcgttctggatttaatttgatgtatcatngctatntttggtagtcaatgtggtaacacggtaggtttgaatctgttctgaaattttggactcatttttttc

SEQ ID NO: 69950 - DNA, 329 bp, Zea mays
  Clone ID: LIB3078-032-Q1-K1-E3
cgccgatgtgctcggcctcgtcaaaggcgaggctggcaaggtgcctgccgagccatgctgtagccgcatcaaaggccttgcggacttcgaggccgccgtctgcctctgcacggccatcaaggccaacgtgctcggcgtcgtcatcgatgtccccatcaagctcagcgccctcgtcaactactgtggcaagtgcgtgcccaagggctacttgtgcgcgtaagcagcttccggcggtcacacgctcgtagctgttcacgtacgagattacataatgcacgcaccctgcatggcacgaatgcatgcattgtgtctgctgatatatctctcct

SEQ ID NO: 69951 - DNA, 264 bp, Zea mays
  Clone ID: LIB3078-032-Q1-K1-E4
aaggaaaataacatctattttgctgggctccagaccgacggcttgactctgtgggttcctacgacgtggacgtgatatttctgctctccaggtcaattccttctatggtctcccccctccgggacaccaggtaacatatgcgcctcaggctggacatggtccttatggagggatctaccacccagcacattctgtggcaggagctactgttactccactgttccagccatttcacacaatggctggagctgttgaaatagttgg

SEQ ID NO: 69952 - DNA, 311 bp, Zea mays
  Clone ID: LIB3078-032-Q1-K1-E5
gttcccgatggaggcctgcgacctgcttggtggcgacgcgtgcaacgggcccatgttcccgggggccaagcccgcctcggcggcggcggcggcgagcaggagtgtggtcggggtggacagggactacctgtgctacgacgagccaaagacggtgttcccgggcgaggcgtgcgatgaccttggcggcgagttctgcgaggcgccgtaccaggacggcgtcttcaaggagctggcgcacgcctgaagaccctgatccatacatttctgtgcaccacgctatgtacgcatgtgtagcacatggtttacatcta

SEQ ID NO: 69953 - DNA, 270 bp, Zea mays
  Clone ID: LIB3078-032-Q1-K1-A4
gccacgcgtccggacacgcgtccgtccacgcgttcggccgtatgaggagctcagctatgtgcggtgtccaaaacctacaagttatagcatgggggagtgctcgtgtactcctgttcggttctttgtaattgtgtctatgcaaagatcgggaagtggatggtttgagaccttgatgaatagtcaccctaacattaggtccaatggcgaaatctttaacagagtgggttgcacagaaaatatctcgtttatcttacaaacacttgacacgct

SEQ ID NO: 69954 - DNA, 68 bp, Zea mays
  Clone ID: LIB3078-032-Q1-K1-A5
ccacgcgttcgtaaaagtaatttagggctctaacaaattgtggagaaacattttgaatcgtgatccat

SEQ ID NO: 69955 - DNA, 269 bp, Zea mays
  Clone ID: LIB3078-032-Q1-K1-A6
cccacgcgtccgcggagggcgggctggactactctggggaaccccaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggccttgccgacgacccggacaccgtcggcgagctcaaggggaaggagcttaagaacggtcgtcttgccatggtcttcat

SEQ ID NO: 69956 - DNA, 311 bp, Zea mays
  unsure at all n locations
  Clone ID: LIB3078-032-Q1-K1-A8
cagacgcatacgcacccaggagatacagcgagcgagcgaccaaagccatggctctccgcaccggggcatcgaagaaggtcctatccttcccgttcggcggcgcgggccggccgttggcggcggcggcgtctgcgaggggggtgacgacggtcacactccccgacctctcctacgacttcatcgcgctggaaccggccatctcgggggagatcatgcgcttgcaccaccaaaagcaccacgccacctacgtcgccaactacaacaaggcgctggagcagcttgacactgccgtctncaagggcgacgccttc

SEQ ID NO: 69957 - DNA, 366 bp, Zea mays
  unsure at all n locations
  Clone ID: LIB3078-032-Q1-K1-A9
ccccagccccagaccaacgacgagaaaggacaaactgcggcggacctacccgaagtcggaggcagggcaaaaggcccgatcccccctccccgccggttgccgcgctcgtgccacggtgcggtagccccgtcgacgccggcggacagcgtgcactatgggttgctcctcctccgtgccagctagaaatactggagggctgaacactatcagcaacgatagctctccagacgccagttcaaaggacttgcgtgctaagttggtattgctgggagactcangtgttgggaaaagttgcattgntcttcgttttgttcgtggtcagtttgatcctacttncaagtaactngtggcgcatcttttttatca

SEQ ID NO: 69958 - DNA, 344 bp, Zea mays
  unsure at all n locations
  Clone ID: LIB3078-032-Q1-K1-B1
gttgccgacgatgaggttacttcccatcggttcacaccggctagaatgtcacatgtttcttcgcgggatccagatgacatggatggcgtaagcgaaccgatcatcangagcaacagtgtcagtactactgggaatgagaacctgagaagcagaagcatcaattctgaggctgacattcagcttgcgatcaagtctctgcgggcatcaagcatgtcgcatgagatggtagaggtctcgacggttcctgatcggagagattaaggtgcatcctcaaggaagttcacaaggactgctagccagcaaaggagcgtgataatagaggatttagcacccttcccagagat

SEQ ID NO: 69959 - DNA, 183 bp, Zea mays
  Clone ID: LIB3078-032-Q1-K1-B10
aaaaaaagaaaaaaaaaaaaaaaaaaaaaaaattttaaaaaaaaaaaaaaaaaaaaaaaaaaaaaaggaagaaaaaaaaaaaaaaataagagaaaaaaaaaatataaaaaaaaaaaaaaaaaacttaaaaaaaaaaaaggcctccccctttaaaggtcccaattttacgtcccctgcctttca

SEQ ID NO: 69960 - DNA, 275 bp, Zea mays
  Clone ID: LIB3078-032-Q1-K1-B11
cccacgcgtccgggacaactgagaagagaggatgataggggagtgagcagccgtctggagatggtggcctttgaactatccgatctggaggatttgatttgcctcctttgtgtactttaaaaagggcagccaggatgatgatctgtattttaagacaatgctgtctgtttgggtttaggattttgctttgtcaaaaactagcacacttattgtactactgagcagcatattggttttcatccttgggttaaaaaaaaaaaatcaaataatttata

SEQ ID NO: 69961 - DNA, 325 bp, Zea mays
  unsure at all n locations
  Clone ID: LIB3078-032-Q1-K1-B12
cagggcttcctcgtcttcaacgctgttggcggaggaacaggctctggccttggttccctcctcctggagcgtctgtctgttgactacggcaagaagtctaagcttggtttcactgtgtacccatccccccaagtttcgacctcagtggttgagccatacaacagtgtcctgtccacccactccctccttgagcacactgatgtggctatcctgctggacaacgaggccatctatgacatctgccgncgttcccttgacattgagcgcccaacctacaccaacctcaacaggcttgtgtcccaagtcatctcattcctgactgcct

SEQ ID NO: 69962 - DNA, 261 bp, Zea mays
  Clone ID: LIB3078-032-Q1-K1-B2
gtgcatgcaggtgtggccggcctacggcaacaagaagttcgagacgctgtcgtacctgccgcggctgtcgacggacgacctgctgaagcaggtggactacctgctgcgcaacggctggataccctgcctcgagttcagcaaggtcggcttcgtgtaccgcgagaactccaccttcccgtgctactacgacggccgctactggaccatgtggaagctgcccatgttcggctgcaacgacgccacccaggtgtacaaggagct

SEQ ID NO: 69963 - DNA, 378 bp, Zea mays
  unsure at all n locations
  Clone ID: LIB3078-032-Q1-K1-B3
gccgcgccggcgcccaccgccgtggcgctgcctgcggccaaggtgggcatcatgggccgtagggcggagcagcaggggcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggtcctgctcctcctgcgccggcaaggtcgtctccggctccgtggaccagtccgaccagagctacctcgacgacggccagatcgccgncggctgggtgctcacctgccacgcctaccccacctctgacgtcgtcatcgagacgcacaaaggaggaggagc

SEQ ID NO: 69964 - DNA, 178 bp, Zea mays
  Clone ID: LIB3078-032-Q1-K1-B4
aatggactgaatggaggagcaatggtacaaattagcggaagcggatgctgtcacaagttgctagatctttctcccttagctgcttgacatttggttcttgccacagctttttgatgcttctcttggcagctggacttaatgttttgctattcttgtcgacatcacgagttgaattgtc

SEQ ID NO: 69965 - DNA, 223 bp, Zea mays
  Clone ID: LIB3078-032-Q1-K1-B7
cccacgcgtccggcaaaggcagcacactcagctatccagcaaaagagatcgagacgcaggagggatggccaccgtcagcgccgccgtggtgaccaccatcgttgcccgcgccgcgatcgccaggcccaatgctctagggctgcctgcgttgagggccaggagcgagagggtgcggtgcagctacgccaaggatgccaagaacgcggccccagtcaggaccaag

SEQ ID NO: 69966 - DNA, 308 bp, Zea mays
  Clone ID: LIB3078-032-Q1-K1-B8
gcgagaggaagggaggaggtgagccaccggaagcggagacgtgagtagtcgaccaacccgggggatccggctgcggcgcggcgtgctagatcgctaccgaccatggtggtggaggagatcgccgagggggtgaagaacctcaccgttaccggagatgcggcggcttcaggcggagaggggcagaagaggggcggcggcggcagcagcaaccgcatccaggtgtccaacaccaagaagcccctcttcttctacgtcaacctcgccaagaggtatatgcaacagcacgacgatgtagagctatccgctct

SEQ ID NO: 69967 - DNA, 76 bp, Zea mays
  Clone ID: LIB3078-032-Q1-K1-B9
aaaaaaaaaagcaaaaaaaataaaaaaaaaaaattattttaaaaaaaataaaaaataaagggcgagggctggtaat

SEQ ID NO: 69968 - DNA, 110 bp, Zea mays
  unsure at all n locations
  Clone ID: LIB3078-032-Q1-K1-C1
cccacgcgtcctcccacgcgtccgagaggctatataaaacaatattcttgactattgcaccaggggggattatcaccatcanctccgtcgtggacaccaccatcgttgcc

SEQ ID NO: 69969 - DNA, 285 bp, Zea mays
  Clone ID: LIB3078-032-Q1-K1-C10
cagccaccgccgtttcttcgtcttcctcgcagcgccggcgcgccatctcggtacgaaggcgacggcggcggcgacggcggcgttcaggatcgggatctcagcgacgacgtcagaggcttcccatcccgacccccgccagtcgcctcgcgccctcgactccggactccggtcctccgcacaccggccggtgaccctgcgtttgaacctgctatagaaatttataaaatggccgcggttgatgcgacaaccatagagatggatgcactgcatgttggacaaaatgat

SEQ ID NO: 69970 - DNA, 320 bp, Zea mays
  unsure at all n locations
  Clone ID: LIB3078-032-Q1-K1-A3
gacgcgtccgcccacgcgtccggccagaagagcaaagatcaacaccaggtccaggggcagcagcagtagcgtggcgaaggggtcaccaccaccagccttccagttccagtgcagggcgtcgactttcgcggcggacaccagccttcggctcgagctggacgagaaccccgaggcgatcatctcgggggcgtggcccgggaactgctccctnctcagctacgacgaccttcgcgcctacctcgagtcgcaggagacggcggcccaggcagacgatcagcgcggcgtggcgctcctgagcgagaccatgttcacacccgtgc

SEQ ID NO: 69971 - DNA, 313 bp, Zea mays
  Clone ID: LIB3078-032-Q1-K1-C11
cccacgcgtccgctccctccttccttccttccccgtcactgcgcagcgcgagtgcggcgacagggaggcacacactcacactccctcgaccgctctcggccccgtccgcgtcgccgcagggcgaggaggcaatggcggcgggcgggaatggcgccggcggggacaccagggcggccttcgcgcggatctacaagacgctcaaggaggagctgctcaccgacccggccttcgagttcaccgaggagtcacgccagtggatcgaccgcatggttgactacaatgtactcggaggcaagtgtaaccgtgggctctc

SEQ ID NO: 69972 - DNA, 297 bp, Zea mays
  Clone ID: LIB3078-032-Q1-K1-C12
cttttgggggtggaggtgagaagggtataattttcgtcactattcttttacagtctatgttggagtactgtacctactttactaaatagcaaaaagcaaacatatgaacaagggcggtgctacaactactgcgttgtgttggatgtaaagccttgatatattatctctttcccatgtagttgtggctataggcggcttcttttcagtgaacatattgtctgttccagcgttcttgctggatggatagtaaatggctgtaccatttggttgaattatcatggtttttgctttgatgtt

SEQ ID NO: 69973 - DNA, 335 bp, Zea mays
  unsure at all n locations
  Clone ID: LIB3078-032-Q1-K1-C2
cccacgcgtccgcccacgcgtccgcggacgcgtgggcgcggtgtacctcgtcggctgggtcgccgcggagggcggcggcgtcggcgtggcggcctacagcctggttgccggcctggtgttcctcagcgtcttcggcaaggtctaccggttcttggcgtgggtggaggcgaggcaatcgcagtggaaatccagcctctgccatagcgccggttgattcatgaaagctaattctctcagaaaatctgtataaagaaagaaaggaatcngtgctttagttcatctccttcttggggtacaatctacacggtgggtaaagaaaaggtgcggattttttt

SEQ ID NO: 69974 - DNA, 308 bp, Zea mays
  Clone ID: LIB3078-032-Q1-K1-C3
cccacgcgtccgcggacgcgtgggctgagggtgagagccgagaaggcgcggtgcggcgctcggcggtcgaggcggccgagccagcggcgggacggcaacaacggcgcgtcgtcgtcgcttctggccgtggccaccagcgcggtgaccacgtcgcccgcgctggcgctggtggacgagcggatgtcgacggagggcaccgggctcagcctggggctcagcaacaacctgctggggtggatcctgctgggcgtcttcggcctcatctggtccctctacaccgtctacaccttcacgctcgacgaggacga

SEQ ID NO: 69975 - DNA, 352 bp, Zea mays
  Clone ID: LIB3078-032-Q1-K1-C4
cccacgcgtccgcccacgcgtccgcccacgcgttcgcccacgcgtccgcccacgcgtccgtgtatgaggagttgaagaagcatgctactaaagcaattccttttgggtcaacacccaagaataatgatggcacatctgatgctgggacaaattggttaatgtttgagttgctgtggagagatttcttcaggttcatcacaaagaagtccagctctgtacagaagacatctgaagttgccactggctgaactccaaccccagggcttgcatgaacatacttagacaagctgattgccagctgcttttttggggggataaacctaatggccttttcaagggaggcttttttttt

SEQ ID NO: 69976 - DNA, 169 bp, Zea mays
  Clone ID: LIB3078-032-Q1-K1-C5
ctcacgcgttcgtcgccggcgaccctcaacctcactaaggcagaaggagcaccatgatggggggatgacacggactgtaggctctgacccgtgaactgatcactcgtccatttcgtactaaggggttcaacccagtaaccaagtacctgagcacctactagatctgtac

SEQ ID NO: 69977 - DNA, 378 bp, Zea mays
  unsure at all n locations
  Clone ID: LIB3078-031-Q1-K1-G7
gcttgagtagcgaagcgcgagagcaatggcgtcgctgtcgtgcgcctccacgctgccctggacccccgcctcctacccgcggccctcggcggggcgctgcctcacggcctctcgccgggctccgtcgctggtcatcgtcgcccaggggaaggtcaagaagtaccgccaggtcatattgacagacgacatagaagaggtggggaagaaaggggatacactgaaggtgcgagctggattctaccgcaacttcctncttcccaagggcaaggctacacttctgaccccagaagtcctcaaggaaatgcagctggagcaggagagaatagaagctgaaaagaagccggtaaaagaagacgcgcaacaacttgctcgagtttt

SEQ ID NO: 69978 - DNA, 404 bp, Zea mays
  unsure at all n locations
  Clone ID: LIB3078-031-Q1-K1-G8
cccacgcgtccgcccacgcgtccgcccacgcgtccgcgacgacgcgccgggggagacgtggcacatggtcttcagcaccgaaggcgagatcccgtatagagaggggcagtccatcggcatcatcgctgatggcgaagacaagaacggcaagccgcacaagctcaggctatactccatcgccagcagcgccctcggagatttcggcgactccaagacggtatcgctttgcgtgaagaggctagtctacaccaacgatcagggggagattgtcaaaggagtctgctcaaacttcctgtgtgacttgaaaccttgcgccgatgtgaagatcacagggccagtgggcaaggagatgctcatgcncaaagaccccaatgcaacagtcatcatgctcgcaacggggaccg

SEQ ID NO: 69979 - DNA, 413 bp, Zea mays
  Clone ID: LIB3078-031-Q1-K1-G9
gaattgcattctggttgatggataaggatatgtatgatttcatggctctggacaggccttaacgcctcgcatcgatcggggatagcattacataaaatgattaggcttgtcacaatgggtttaggaggtgaaggctatctaaatttcatgggaaatgagtttgggcatcctgaatggatagattttccaagaggtcctcaaagtcttccaaatggctccgtcattcctgggaataacaatagctttgataaatgccgccgtagatttgaccttggagatgcagattatcttagatatcgtggtatgcaagagtttgaccaggcaatgcagcaccttgagggaaaatatgaattcatgacatctgatcactcatatgtatcacggaagcatgaagaggataaggtgatcatctt

SEQ ID NO: 69980 - DNA, 271 bp, Zea mays
  Clone ID: LIB3078-031-Q1-K1-H1
tcgcatatagctaatgtaactcgaatccagaaacgactgtgtcggtgcccctaacagtgaaagggcatcacagaatcatggcggtgggcttgaccacaacgatgtctactgccgatcttcttatctcgctgatgagtatcatgatccatgttacagctcctgagaacaagcaggtgatactgatcgaccgaatagaagagctggcgacaacatgggattcactgatcattccagcagggatgtatctgtacttacgtcttaacatgggcaa

SEQ ID NO: 69981 - DNA, 376 bp, Zea mays
  unsure at all n locations
  Clone ID: LIB3078-031-Q1-K1-H10
ccgagaagtacgcctacagcacgcagcaggttcaggactgcatcgccgtcgcgctcactgccaaggccgccgccgtcgcgcaggccgccatgttcaagaaggccaactacgcctgcagctactagctaggcctcgcgcatcatcagcgtataacgtacgcacgcaatgttcgttatataattccatacgtatatgggtgtgcaaggtccagaccgaccagctgtatgtcttcatcgttgccttcgtttctgcgtcgtcctcccatgcatgtntatgcatgatgccgtgccgtctcgttgtcagctggttcagtagtgatgcttaactttctggtcgtgttgctaatgtangaaataagacgatgcgttgactgctt

SEQ ID NO: 69982 - DNA, 205 bp, Zea mays
  Clone ID: LIB3078-031-Q1-K1-H11
cgacgacctcgagattgagtgcgaggggaaggagaagttcaagtgcggctccaacgtttgctggaagtggtgaagcagctagcagcagcgtctgatgggaatggaggagatcatcacctgtcttgtcgaccctagatatgtccaaactgcagggaaattaaatcttcatgtgtaattgtgctcattctgtttcaatcatctcaac

SEQ ID NO: 69983 - DNA, 267 bp, Zea mays
  Clone ID: LIB3078-031-Q1-K1-H12
cggacgcgtgggcgacgagcgacgaagcgcgcacaaagagaagaacctcggagctgagagtgcacaagccatggcgtcgatgacaggcctctcgcaaggcgtcctgcccagcaagcgcgccgacagcagaaccaggacggccgtcgtcgtcgtcagggcgtccgcggagggcgacgccgttgcgcaagcgggccggcgcgccgtgatcgggcttgtggccactggcatcgtcggcggcgccttggctcaagccgcgcgcgccgagac

SEQ ID NO: 69984 - DNA, 331 bp, Zea mays
  unsure at all n locations
  Clone ID: LIB3078-031-Q1-K1-H2
gtgctccccaccgatggtctccccgacgatttcgactggagggaccacggcgccgtcgggcccgtcaagaaccagggttcgtgcgggtcgtgctggtcgttcagcgcgtctggagcgctgganggtgcgcactacctcgcaactggcaagctggaggtgctttcggagcagcagttcgtcgactgtgaccacgagtgtgattcatcggagcctgattcatgtgattcgggttgcaatggtgggctaatgacgacggcattcagttatctccagaaggcccgtggccttgagagtgagaaggattacccttacactgggagtgattgcaaat

SEQ ID NO: 69985 - DNA, 231 bp, Zea mays
  Clone ID: LIB3078-031-Q1-K1-H3
cgcatgcgtacgtggactacgtgatcggatcaataaaagacggagctagtgcccctaacagtgaaaggggattacagaagcatggcgattggcttaaccacaacgaggtttactgcggatcttgttatggtgctgatgagtctgatgatcaaagttgcaacttctgtgaagaagttcgtgatgcgtatcgaaagaaaaggtgttctgtcaacaacgtataattaattgatc

SEQ ID NO: 69986 - DNA, 351 bp, Zea mays
  Clone ID: LIB3078-031-Q1-K1-H4
cgcgtgcgcaaatcctaacgaggactcacgtttcgatattctgaagatccattcaaggaaaatgaactggatccggggtatcgatctgatggatatggcagacaagatgactggggcctaaggagctgagctcaatgacatctgtacagagcgttgaatgcatgctctccactagacaatggagcacgttacacatgaggacttctagatggctgatgcctacgcgatgaataaagacactgataagaacatgtgcctgctcaagctctcgaagtgaagctcatgctctgatgtaccgaccttcaactttcactgcctcttcctgaacggtgtaacggcctgctacggacc

SEQ ID NO: 69987 - DNA, 268 bp, Zea mays
  Clone ID: LIB3078-031-Q1-K1-H5
tcgcatcttggtaatgtaattgaatcaagaaaagacggagttggtgcccctaagagggaaagagtattacagaagcatggcggtaggcttgaccacaacgaggtttactgcggatcttgttatggtgctgaggagtctgatgatcagtgttgcaactcctgtgaagaagtttgtgatgcgtatcgaaagaaagggtgatctgtcaacaacgtagaattaattgatcagtgcaagaaggagggctatgtacaaaggttaagagatgaac

SEQ ID NO: 69988 - DNA, 388 bp, Zea mays
  Clone ID: LIB3078-031-Q1-K1-H6
aattgaccgacgcatccgcaaatcctaacgaggactcacgtttcgatattctgaagatccattcaaggaaaatgaacgtgatgcgtggtatcgatctgaaaaagatcgcagaaaagatgaatggggcctcaggagctgagctcaaggccgtctgtacagaggctggaatgtttgctctccgtgagagaagggtgcacgttacacaggaggacttcgagatggcagtggccaaggtgatgaagaaagacacggagaagaacatgtccctgcgcaagctctggaagtgaggctcatgccttgatgtacccaccgtcacctttcacggcctctccctgaacggtgtaacggcatgctacggaccttttgcgacgtgccttgcatgcctgtg

SEQ ID NO: 69989 - DNA, 324 bp, Zea mays
  Clone ID: LIB3078-031-Q1-K1-H7
agacagttcaacaccattcctgggttgatggagggaactgccaagcctgactatgcaacgtgcgtgaagatctccactgatgcttccatcaaggagatgattcctcctggtgctctggtcatgctcactcccctcattgttggaaccctcttcggtgttgagactctctctggtgttcttgctggtgccctggtttctggagtgcatattgccatctctgcttccaacaccggtggtgcttgggacaatgccaagaagtacattgaggctggtgccagcgagcatgccaggacccttggccccaagggatctgactgccacaag

SEQ ID NO: 69990 - DNA, 457 bp, Zea mays
  unsure at all n locations
  Clone ID: LIB3078-031-Q1-K1-H8
cggacgcgtggggcctttgccccttctgtctcccttcgtccgtagcagaccaggaacgcgcaatgcgctagcgtctccaagatggtgctgcaaaacgacattgacttactcaatccaccggcagagcttgagaagctaaagcacaagaagaagcggctagtccagtcccccaactccttcttcatggatgtcaagtgccagggctgtttcagcataaccactgtgttcagccactcccagactgtggttgtgtgcccaggctgccaaactgttctgtgccaacctaccggtgggaaagccaggctcaccgaggggtgctccttccgtcgcaagggcgattaggtcctgcttctcttaacgtgagaagagataaatttgggtgttttgcactttctcaggatatgtactcngtgaggatttggttaataatattgctggtagcgttgcctgacaatgc

SEQ ID NO: 69991 - DNA, 360 bp, Zea mays
  Clone ID: LIB3078-031-Q1-K1-H9
gctgaattaaaggaggctgagaaagagcatcagaaggagtcagaaaggatagagaaggagcttgctgaaatggaggaaatgaggaaaaagatcagtacaatgacagcagatgattactttgagaagtaccctgaactcaggaagaagtttgacgatgaaatccgtaacgataactggggatattgaagagattggagagaactcttatgatgccatttccatgtccgtgaagaaccaataattttcctgggccctgaattgggtggtttccatagcatgtgcacggggtttgggtggaaatgctacagaatcgactgtgtcaagctttcttgatttcgtagaaaccttgtttggttgaac

SEQ ID NO: 69992 - DNA, 287 bp, Zea mays
  Clone ID: LIB3078-032-Q1-K1-A10
cccacgcgtccgcccacgcgtccgctcctagctcctctactcgccagtcgccatgggcaagatgaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtct

SEQ ID NO: 69993 - DNA, 289 bp, Zea mays
  Clone ID: LIB3078-032-Q1-K1-A12
cccacgcgtccgcccacgcgtccgcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgcccggtgtggcag

SEQ ID NO: 69994 - DNA, 324 bp, Zea mays
  unsure at all n locations
  Clone ID: LIB3078-032-Q1-K1-A2
ctccatcctggacacgtgcttccagggccaggcggcgcggctgcgcgtgcccgaggtcaccatgggcttcgccggcggcgcggcgctcaagctggccgccaggaacctgctggtggacgtggacagcgccaccacgtgcctggccttcgcgcccgcccggagcgccgccatcatcgggaacacgcagcagcagacgttcagcgtcgtctacgacgtcaagaacagcaagatcgggttcgccgccggcggctgcagctgagaagcgacacctacatacacgcgcatgcacagaccgactcggtaactaanactaanacgagcagc

SEQ ID NO: 69995 - DNA, 293 bp, Zea mays
  Clone ID: LIB3078-039-Q1-K1-G11
cccacgcgtccggatttgtagagctttggcttaccttcacaactgcgtaggagtgtggcacagagatatagagccacaaaatattctggtgaacccacatacccatcagctgaagttgtgtgacttcggcagtgccaaagtcttggtacaaggggaaccaaatatttcatatattcgttctagatactacagagccccagagctcatatttggggctactgagtatacaacagctattgacgtgtggtctgctggttgtgtacttgctgagcttcttctaggtcagcctgatt

SEQ ID NO: 69996 - DNA, 214 bp, Zea mays
  Clone ID: LIB3078-039-Q1-K1-G12
tgggtgtcaagtcggtgattgcaaagagcttcgagcggatccaccggagcaacttggtggcggtggggatcattcctgtctgctttcaagcaagagaggatgccgattcactcggcctcaccagacgtgagcgctacaccatccaccttcctaccagcaccggcgagatcagtcctggtcaggacgtgaccgtcacgacccacgactgaagatc

SEQ ID NO: 69997 - DNA, 286 bp, Zea mays
  Clone ID: LIB3078-039-Q1-K1-G2
cggacgcgtgggccgacgctactcgactccttgtgagctgtccgcaagaatcttcacggaggggtctatagcatggagagcgtcgagggcgacagcaagtcggccagcaccgtccggctcctcaagtacaccgaggcggtgccgatgctgacgttcgccaaggagaagcttgagacggcggacgacgagaacaaggtggcgtcgtacagcgcggtggacggcatagctggcggatttctacaagaacttcaagatcacgctgaaggtgactcctgctaaggctgac

SEQ ID NO: 69998 - DNA, 443 bp, Zea mays
  Clone ID: LIB3078-039-Q1-K1-G3
atcttgcttcaccacctcttgtgttgcttatgcacttgccggaactgttgatattggttttgagaaagagcccattggatttggaaaggatggcaaggaagtctacttcagggatatatggccctcaacagaagaaattgcgcaggttgtccaatccagtgtgctgcctgacatgttcaagggcacctatgaggctatcacaaaaggcaacccaatgtggaaccagctaactgtcccagaagcgtcactctactcatgggattccaaatccacttacattcatgagcccccttactttaaggacatgaccatgtccccacctggcccctctacagtgaaagatgcctactgcttgctgaactttcgagacagcatcactacagatcacatttcacctgcaggaagcatacacaaagacagtcctgctgctaagtatttgatgg

SEQ ID NO: 69999 - DNA, 364 bp, Zea mays
  Clone ID: LIB3078-039-Q1-K1-G4
attcccggacccacgcgtccgatcgaaggtaaaacaccaactcgcaaatgttaagaaagccattgtaggcaaacctgggcacgcaaaaccagtatctccgacggcataaaactccagtcaccttagaacatgtacattattgtattgcttgtagtcttgtgagccatttatttcggtggtagtgtttgcgatgggctaggagaaggtcctcttcacaaccatagcattggaattctatgatgttgcacatgaaacactctctaccacctcgagagtatgctgaagatgtttgtaaatatgtctagtgtgtaaattcaagtttccctgaaaactttaagtagaatcaaggacatgtaattggtca

SEQ ID NO: 70000 - DNA, 438 bp, Zea mays
  Clone ID: LIB3078-039-Q1-K1-G5
ctggttctgatgtacgtggtgatcctgcatcagcactactagaagttcttgaccctgagcagaacaaagcattcaacgatcactatttgaatgtgccgttcgacctgtcaaaagtcatatttgttgcaactgccaataggatgcaacctataccccctcctctgttagacaggatggaaatcattgagctgccaggctacacacccgaagagaagttaaaaatagccatgaaacatctcataccaagggtattggagcagcatggcttgagtacgacaaatcttcagattcctgaggctatggtcaaactggtcatcgagaggtacacgagagaagctggtgtgcgcaatcttgagcggaacctagctgcattggctcgtgcagctgctgttaaggtcgcagagcaaggtaaaactcttagaactggcaaggaaatac

SEQ ID NO: 70001 - DNA, 414 bp, Zea mays
  Clone ID: LIB3078-039-Q1-K1-G6
cccacgcgtccgcccacgcgtccgcccacgcgtccggcaaggccaatcccgagcagtggtgcgaaacctcgagcgctcgcgccggtgaccataacaaagaggaagccgcggtagcactggtagcggcagcagtaaggggaagatgtcgtcggcgttcagcggcgatgagaccgcccctttcttcggcttccttggcgcctccgctgcgctcgtcttctcatgcatgggggcggcgtacgggacagccaagagtggcgttggcgtggcgtccatgggtgtcatgcgcccagagctcgtcatgaagtccatcgtgcccgtggtcatggctggtgtgctcggtatctacggcctcatcatcgccgtcatcatcagcactgggatcaaccccaaggccaaaccatactaacctcttga

SEQ ID NO: 70002 - DNA, 252 bp, Zea mays
  Clone ID: LIB3078-039-Q1-K1-G7
cccacgcgtccgcccacgcgtccgctttcttccacagcatgcaccaccatcacgtaggggggcgacactcctgtggttatgccgcacctgcccgttcacggccactccgtgccgcctgtcaccaagccgccgcccgtagacgttcctgagcacaaaccggcgccggtgcccgtgccggaccacaagcctccgtcgacaccgtctgtcgacgctcctgagcacataccggcacctgtgcccgagccagagcac

SEQ ID NO: 70003 - DNA, 365 bp, Zea mays
  Clone ID: LIB3078-039-Q1-K1-G8
ggctcggcagctaacgacctgcagccaaccatctaccagcgactcagcgagcgagagcagcacacacgcagctagctaggagcagcagcagcggcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactg

SEQ ID NO: 70004 - DNA, 207 bp, Zea mays
  Clone ID: LIB3078-039-Q1-K1-G9
attgttgttcttgttctgctggtgtctccgccgtttaatttgacctatgttatggagggagtgatatatgtgccgtcactcctagtatatagtagtgagtgactagttggtatgtgtagtactgtactatcttttctccatatgcatgttttgccagcgcgtaatgaatgtaatgtcagtactgctactacgtgctctgctacttcc

SEQ ID NO: 70005 - DNA, 340 bp, Zea mays
  Clone ID: LIB3078-039-Q1-K1-H1
tttgcacggaggcatccgtcaaatttctcgaagggcaaccaggcgaggcctagtgtagggtttaacgagtgagaggggggaaatgctgcgccacgccgcccgccgtctcgtctcccgcaccgccgcggctcccaccgcccgccgcgcgctcgtcacggcagacgtgcctgcggaggccgacgatgactccacgtttgtggaggcgtgtaagaaggtcgccctcaacatcgagcccccaacgacgcccctctttctcatgcatcctttcccgtctacgctctctaccatcctcactaagctcaccgtcaacttcttacttccctacatgttctatatctcc

SEQ ID NO: 70006 - DNA, 196 bp, Zea mays
  Clone ID: LIB3078-039-Q1-K1-H10
ccggcacaaggggctaatacttacgtgcaatggtcttggtataaggtactcagtatggtgaacgcgctcaagggcccacagtttgcactcatctgcagtcttggagaatctgtaatggaagcctttgatctgaaaatggtatagtgcatcagtgccatgtttgaaagccaaatattgaccacttgagttcatccta

SEQ ID NO: 70007 - DNA, 253 bp, Zea mays
  Clone ID: LIB3078-039-Q1-K1-H11
cccacgcgtccgcaagaagaccatcgccgactactgctctcccgaggagttcctctggcacgtcgactacctgctcggcaggcacgcctactgcggcaagaccgactccgagggcaggttcgagaccggcgccgtggccaccgccaacgtcctggagagctccacccccgtgatcgacggcaagcagtactacgccatgtacgagctcaccaggactgctgactgctactagtgcagcaagcaccagctcatc

SEQ ID NO: 70008 - DNA, 312 bp, Zea mays
  Clone ID: LIB3078-039-Q1-K1-H2
gcctggacccacgcgtccggcgtcgggagtgggtcgctcatcttcaggctggtgcaggcattgttgccgacagtagcgcggatgacgaacaacgtgaatgcgagaataaggctgctgcactagctcgggccatcgatcttgcagagtcagcttttgtagacaaagaatagtgtgctatggttatcgtttagttcttgttcatgtttcttttacccactttccgttaaaaaaagatgtcattagtgggtggagaaaagcaataagactgttctctagagaaccgaagaaatatggaaattgaggttatggctt

SEQ ID NO: 70009 - DNA, 308 bp, Zea mays
  Clone ID: LIB3078-039-Q1-K1-H3
ctcaagcactataatagaagtacttgttattcttacataagactcataacaagagtagaaattattacgaaaacgggggtaacgtgtgcttcgacaactttggtgacaaggtgaagaattggttgacctttaatgagccctatacatttacttcattttcctatggaaccactgtctcatgccccatgacgatgctcacctgtactagactgtaccatctcaactgataattcactcgtctaaccttacattgctgaccacaacattcttctagcccacgcttaggctgttgatctttactacaagta

SEQ ID NO: 70010 - DNA, 337 bp, Zea mays
  Clone ID: LIB3078-039-Q1-K1-H4
gcatcgccgtcgcgctcacttccaaggccgccgccgtcgcgtaggccgccatgttcgagaaggccaactacgcctgcagctactagctaggcctcgcgcatcatcagcgtataacgtacgcacgcaatgttcgttatataattccatacgtatatgggtgtgcaaggtccagaccgaccagctgtatgtcttcatcgttgccttcgtttctgcgtcgtcctcccatgcatgtttatgcatgatgccgtgccgtctcgttgtcagctggttcagtagtgatgcttactttcttgtcgttgttgctaatgtaagaaataagacgatgcgttgactgctt

SEQ ID NO: 70011 - DNA, 302 bp, Zea mays
  Clone ID: LIB3078-039-Q1-K1-G1
aaacaaactacctctgtcgtcaacctactaacttccatattcttcacactcagctgtgcaaaatttacttgactggctttttttggcttaaaatataactcagggagacgtgattttgggacgatcaaactgttgggattgcgcttggacattccgggcagcgtgcacccaagattgaccaagctgattcgactgtgctaggacaaagatcctgatgcgtgtcttacttcttcagagattactattgaactaccagattggctacaccatatcgaggcacccaatggatccagccgtcgttc

SEQ ID NO: 70012 - DNA, 409 bp, Zea mays
  Clone ID: LIB3078-039-Q1-K1-H5
cccacgcgtccgcccacgcgtccgggttctccagcggatcggcgtcggcatggtcctggccgtggtggccatggtcgccgcggcgctcgtcgagtcgcggcggctccgcgcggagcccgccctgctgagcatcttctggctcctgccgcagtacgtcctgctgggggtctccgacgtgttcaccgtggtggggatgcatgagttcttctactcgcaggtgccggcctccatgaggaccaccggcatcgggctctacctcagcgtcttcggcgtcggcggattcctcggcgcgtacctcatcaccctgctcgagatggccacggcgaggcccggcaacgcccgcagatggttctctgacgacccgcgggaggcgcggatagataacttttactgggtcttggctctcctc

SEQ ID NO: 70013 - DNA, 383 bp, Zea mays
  Clone ID: LIB3078-039-Q1-K1-H6
acgcgtccgctcaagcactagaagagaagtacggcggattcttagataagactcataagaggattggaaatgattacaaaaacttcgctaaggtgtgcttcgacaactttggtgacaaggtgaagaattggttgacctttaatgagccccagacatttacttcattttcctatggaaccggggtctttgccccaggacgatgctcaccgggactagactgtgccatcccaactgggaattcactcgtcgaaccttacattgctggccacaacattcttctagcccacgctgaagctgttgatctttacaacaagtattacaagggcgagaacggccgcataggtcttgcatttgatgtaatgggtcgtgtgccatacggaaca

SEQ ID NO: 70014 - DNA, 167 bp, Zea mays
  Clone ID: LIB3078-039-Q1-K1-E11
cccacgcgtccacccacgcgtccggtctacagctagggactcgcgcacatcttcgacgagtccggcgtcatctaggtcgccgaggttatctacaacagataaactggccattaccgtacgtttggtataattactatgagcacttttacggaagctgacaatgccat

SEQ ID NO: 70015 - DNA, 231 bp, Zea mays
  Clone ID: LIB3078-039-Q1-K1-E12
ctcgtcgccttcagcagccccaacccctgcctgcagatcaccgactttgcgctcttggccaacgacctcccgtccgccgtcgtggagaaagtcaccttcttggacgacgcgcatgtgaagaagctcaagagtgtgctcggcggcagctgttaacttgtttttcgagacaatacagttcatgctgggtatgcatcgtctccgtcggcgtcttggtccgtcatcatttaatgg

SEQ ID NO: 70016 - DNA, 336 bp, Zea mays
  Clone ID: LIB3078-039-Q1-K1-E2
aagaatgttgttgggtctgagagagtttagtttgatgatgaagggaaagacctcttaggtggttatgtggagatgagagatgacacacctgggtacggttcatcccacgctgaagatgattcacatggttttgttgttcacgattatcgtgttgagtccggtgaagattttgatgaaaaatcaggccactcttcatatcctgcacacagcaggagctgagatactggcgcctcatgcaaatgttggttgaagaagcatatcacatgctcgtataaccaagcataggaaacaaatgctatctggtctgttgaggttgcagctgcactagttggcatt

SEQ ID NO: 70017 - DNA, 266 bp, Zea mays
  unsure at all n locations
  Clone ID: LIB3078-039-Q1-K1-E3
ccttcctcgaccccaagggccgcggctgctccaccggctacgacaacgccgtcgggcgccccgccgggggcagaggtgacgaggaggagctccagaaggagaacatcaagaacgccgtctnctncaccggcaacatcacgttgagcgtcaccaagagcaacccggagaccggcgaggtcatcggcgtcttcgagagcgtgcagccgtccgacaccgacctcggggccaaggcgcccaaggatgtcaagatccaaggggtctggtac

SEQ ID NO: 70018 - DNA, 242 bp, Zea mays
  Clone ID: LIB3078-039-Q1-K1-E4
gattcccgtcgacccacctcggtgccgtacctcgccatgggcgttacctaccctgccatgttcccggggggacaccaagagtgcagcaatatcaactccaacagaactgtctacttcgggaggatccacaactaagtcacgtggcaatccgccaggcctgtcatggctcactcatgcaactgcctcatcagagatgttccgagtggcagcattcatgcagtcagagagcttctgcctgtaca

SEQ ID NO: 70019 - DNA, 431 bp, Zea mays
  Clone ID: LIB3078-039-Q1-K1-E5
agactacaaacttttgggtcgtgtcataccagcccaaagggtagaaacagtggcgcaggtcgatcctaaaccacgttatgttttcgttgggccgtgacgatcagtccgacccattacccatatatttgaacaatataaaatctaaatattacaactaaataaagtccatagcttactaaattaaagatattaaacaatactaacatcatttaaccacataaagtgcaaatattacaacaatgtaaagtatatagcttactaaattaaaaaattaaacaattactagttagatgcccgtgcgttgcaacggcaatacaaaatatttttacacaataattacatataaatgaacaccacatatataatccaacccaatatcttaaaaaaaaattggcaacaattaatacagaaataaactgatacatattaat

SEQ ID NO: 70020 - DNA, 363 bp, Zea mays
  Clone ID: LIB3078-039-Q1-K1-E6
caactagtaccccttcatgtccatggtctcctgcagaaaccagccattgttcaaggagggcaagggatgcggctcctgctacaagattcggtgcaggaaggacccgtcctgctccgggcggacggagacggtgatcatcaccgacatgaactactacccggtgtccaagtaccacttcgacctcagcggcacggcgttcggcaggctggccaagcccggcctcaacgacaagctccgccactcgggcatcatcgacatcgagttcaccagggtgccgtgcgagttccctggcctcaagatcgggttccacgtggaggagtactcgagccccgtctacttcgcggtgctggtggagtacgagga

SEQ ID NO: 70021 - DNA, 387 bp, Zea mays
  Clone ID: LIB3078-039-Q1-K1-E7
cccacgcgtccgcccacgcgtccgtccacgcgtccgcccacgcgtccgcccacgcgtgcgggtatatatgatggtccttcctgattcaccatttgctcaacctccccctgctcctgacatggaaagctacctggagcaggcgtgaagcgttgctgattgatatttcgtccgccgctcggtctctctattagtcatctgatctgagtgtggtacgttgctacctgccccccgcccacagcaagtgtacgttgaggtcaggggtgcatactgtgtgtgagtgagtgcgtgtgcgttgctgagtgtgtgtgatgcttacttggatttggagaacatgctggattgttagtagtgggtagtactgcaatgttatgcctgaacatggctgga

SEQ ID NO: 70022 - DNA, 279 bp, Zea mays
  Clone ID: LIB3078-039-Q1-K1-E8
ccgacgcgtccgcggacgcgtggttcgtgcaccaacatggcgtcagccacctcgcgggtcatgctggccgcgggcgtgcccactgccagtagcggcagcggccgtgtcagcttcgcctcggcgcccaaccggcttggcaggaggcttgtggtccgggccgatgaggagtccccggcagagccggcgcccacagcggaaggagagggcgccgtggccaccaagcccaaggccgagaagccgcctccaaacggtcccaataggggcgccaaggccaagatc

SEQ ID NO: 70023 - DNA, 231 bp, Zea mays
  Clone ID: LIB3078-039-Q1-K1-E9
acagacacgcaccttacagacacacgcgtacaccttccgcagccatggcatcagtaacgttccgggcgttcgcgccgagcgagggataatcacctgacggcaggacaactattcctcgtacgaccgtaccgagctcaccaagcctatgtacgtcttcgtccggggcaaggtctacgacgtcaccttcggccgtggcttctacggccccggcggcgcctacgccgtcttcgc

SEQ ID NO: 70024 - DNA, 394 bp, Zea mays
  Clone ID: LIB3078-039-Q1-K1-F1
cgatatcaaaacaaaggttgagttatctcatcccaatgctgaactgagattactggaggtcttttatcacaagatatacaaggtgtttgcaccaaatgaaaagattgaaaacattaatgatcagtactggacactgcgtgcggaggaggttccagatgaggaaaaaaaccttggtccctttgatcgattgattcatgtatatcattttacaaaagatactcaaaaccaaacgcaagttcagaactttggagaacctttttttatggttattcgtgaggatgagaccctatcttctatcaaagagcgtatacagagaaagcttaaggttccagatgaggatttctcaaagtggaagtttgcatacatttcacttggtcgtccagactattttgaa

SEQ ID NO: 70025 - DNA, 181 bp, Zea mays
  Clone ID: LIB3078-039-Q1-K1-F10
gtttcattgattcttgaagagatcgagcttcttttgcaccacaaggtcgaggatgtgtggcagctgcggatcaagctgcggctgctgctcaagctgcaagtgcggcaagaagtaccctgacctggaggagacgagcaccgacgcgcaagccaccgtcgtcctcggcgttgccccggagaag

SEQ ID NO: 70026 - DNA, 215 bp, Zea mays
  Clone ID: LIB3078-039-Q1-K1-F12
cgagctccgagcctccgatggactcttcctctccatccccatcgtcagcgcccagtggatcccgtgccgcctccaatgccacccagcggtggagcatccttcgccgcgcgctgcttgctcgttcctcctgcgcgcgcgccctatggggaatttctagtgaccaccagattaaagatggtaccaataacatttcaagaaaggcttcacgtggtttt

SEQ ID NO: 70027 - DNA, 330 bp, Zea mays
  Clone ID: LIB3078-039-Q1-K1-F2
cccacgcgtccggagaacatggggagcctcgacgcagatttccacgacatggcgagcgaggccttggacgcccacgacaacttcggcatcgagatagctatgcgggagttcagggacttgttcgaggggatccagtccatgacctactgctgcggtaacttcggtgatgacaagggtgccagggtcattgtcaaagccttcccacacataaaatgcactgtgctggcccctcccaagatcattgccaccaaaccggccgatggagcgatgataaactatgtcgaaggtgacatgttcagtttcattccacctgctcaaactgtcttgcgc

SEQ ID NO: 70028 - DNA, 432 bp, Zea mays
  Clone ID: LIB3078-039-Q1-K1-F3
cggacgcgtgggcggacgcgtgggccgtcgctggcggagcagatggagaaggccgcagtgtttgacttcaacctgacgctcccggcgatcgcgaccgagttcctgctgctcatggtggcgctggacaagctctacttcacgccgctaggcaagttcatggatgagcgggacgccaagatccgcggtgagctcggcgatgtcaagggcgcctccgaggaggtgaagcagctggaggaccaggcggcggccatcatgaaggcggcgcgcgccgagatcgcggcggcgcttaacaagatgaagaaggagaccaccgcggagctggaggccaagctggacgaggggcgcagccgtgtggaggccgagctcgtagaggcgctcgccaacctcgaggcgcataaagaggaagctgttaaggcgctcgacgcccagatc

SEQ ID NO: 70029 - DNA, 313 bp, Zea mays
  Clone ID: LIB3078-039-Q1-K1-F4
cccacgcgtccgcccacgcgtccgaaacttgtgaattaccattcatccgtggccgctgggtggaaataatgatacttctgctcaagaggatgaacaacacactattcgaagtatacttgatcagggcaagacaacaactacaataggaaaagtaaataatgataacctcagcaggcttctcacagagtacttgggaatggataatatgcttgctcttgtttgcaagacttatgatggtgttaagggtcttgagaaatatgacaaggatgacatcattgataagactagtggcattcatggacttggtcgctct

SEQ ID NO: 70030 - DNA, 304 bp, Zea mays
  Clone ID: LIB3078-039-Q1-K1-E10
cccacgcgtccgctccgcatcacctacctttcctagtgacgatgcaatggaatcatgagattaccaattcatttgctcggaattgttcaattaatggcactccaagtttagtttctgcaatgaaaggaacacgtgtgaagaagggaatcacgacaaagttgagcgtttcttgggcccctgatgtatacgaccctcctattacttctgactcgcacacggtgaaagggcaccatacgagttcaactaagggtaactacaaatacaagacctccaagagcatcagtacaactggatggaaaagggc

SEQ ID NO: 70031 - DNA, 437 bp, Zea mays
  Clone ID: LIB3078-039-Q1-K1-F7
gacaagctgtgggcggcgctgcgcgactccacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaaggcggacggcgagggcggcgccgtcgtcagctgggccatggagttcgacaaggccaacgaccaggtgcccgacccggacgtcatcaaggagaccgtcaccaagacgttccacgacctcgacgactaccttctcaagaactagatggagcgacaactgga

SEQ ID NO: 70032 - DNA, 184 bp, Zea mays
  Clone ID: LIB3078-039-Q1-K1-F8
cagactcctgggcagacacgtgtacgtttccgtcctactaggcaggaatgccacggggacgtcgttaattggcggatcagcatcatgtaccatcatgcgtgggaggtggctatgagctacgcgagcccacagtatgagaaggtgcaatgcttgaagatggataaatagcatcgcgaattctgtt

SEQ ID NO: 70033 - DNA, 154 bp, Zea mays
  Clone ID: LIB3078-039-Q1-K1-F9
atctgaatctccctagcaatctctagcatcagattctagtgccaaacaaagctctagcggccttgttactgtcccaatagcccgtacgaaacatacagcgacaaaatctaatggccgccaggatccaaggaagcaactggccaccaaggccgca

SEQ ID NO: 70034 - DNA, 405 bp, Zea mays
  Clone ID: LIB3078-039-Q1-K1-C2
cagctgttgaaacagattgccaccatctatgtccatatctcaaggggcgacaaggaagctgtcttcccagctgcaatctcgaaagatggcagagcatacaacgatcagttgtttgctagtgcagctaatattctgtggaagattgggggtgatcccaaaatcatacaggagtttatgcagcttgctggtagggcaaaagctgctgcttctgaagctatggatgctgaggcaatccttggggacattccagacgaattcctggatccaattcagtacactctgatgaaagatcctgtgacactgccatcatcgaaggtcacagtggatcggcccgtaattatcaggcatctgctgagtgattctacggatccatttaaccgctcccaactcactcaagacatgctg

SEQ ID NO: 70035 - DNA, 435 bp, Zea mays
  unsure at all n locations
  Clone ID: LIB3078-039-Q1-K1-C3
cccacgcgtccgtggttgtgatatacttgggacctgaaggctggtacaatatttgtgaggttggggtatttgaggtggacttgagcacaaaccctttcagattcactgagaccaacagcttggatggcgactgcattttcatcagcccctgcagcagcaattcattctgtgcatgtccgtatgacggagtcgaagatgatcttatctacttcattggtagcctcaaccactcaagaaatgcgtcccctttggataagtttgtgtacaacatgagggatggtacattggcgccatttgctttggaaataacagacgacgaccttcgggcaccagatggcagccggatgaatccaacatggctacttccttctgaatgaacagctgctatagatcaattctggtaattgcgctgctacctngatgtgatgtgccatg

SEQ ID NO: 70036 - DNA, 273 bp, Zea mays
  Clone ID: LIB3078-039-Q1-K1-C5
gcccgtggtacggccccgaccgcgtgctgtacctgggcccactgtccggcgagggcgggagctacctgacgggcgagttcccgggcgactacggctgggacaccgcggggctgtcggcggacccggagacgttcgccaagaaccgggagctggaggtgatccactcccgctgggccatgctgggcgcgctcggctgcgtctttccggagcttctcgcccgcaacggcgtcaagttcggcgaggccgtgtggttcaaggccggctcctaaatct

SEQ ID NO: 70037 - DNA, 398 bp, Zea mays
  Clone ID: LIB3078-039-Q1-K1-C6
gggttttgctgctctccgaccccgagctccgaaggccgcagcatcaggcgcgccgccgctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatggtcctacgtggcat

SEQ ID NO: 70038 - DNA, 441 bp, Zea mays
  Clone ID: LIB3078-039-Q1-K1-C7
cccacgcgtccgctgacatagtcaccatggcaaagggaattggcaatggcctaccattgggggcagttgtgacaactcctgagattgcaagtgtgttagctcaaaaaatccaatttaacacatttggtggaaatccagtttgttctgctggtgggttagctgtgcttaaggttcttgacaaggagaaacgccaggcacattgtgctgatgttggatctcacttgttggagcgtctaaaatcgcttcaggagaagcacgaaatcataggtgatgttagaggaaggggactgatgcttggggtggaactcgttacggacagaaaggagaagacccctgccaagtcagaaaccattgaactgtttgagaagctcagagatctcggggtactagttggaaagggcggtctgcatggtaacgtcttcagaataaaaccaccgatgt

SEQ ID NO: 70039 - DNA, 430 bp, Zea mays
  Clone ID: LIB3078-039-Q1-K1-C8
caactcttgagcaggggaaacgagagatccttggagtcagcaatggagtctaccgcggtaatgaccgcgagactaccactgctgacctctggctcccgttccaaacccctcccctttgcttccttcaccacggcggcttgccgtctcgcctccgccccctgctccggcagcggcagcgtcgtcctgctgtcgcgccggagccgcgattatgctggcgttggttccttggtctccgccgcggcggctcctggggatacggcggacgccggatccgagtccatcctgctcagcgtccaggggatgatgtgcgacgggtgcgccgcgagcgtgaagcggatcctggagagccaacccgaggttacttctgctaccgttgattttaaggaagcaagcgcagtcctgtggacaacagatgaggcccaggggacac

SEQ ID NO: 70040 - DNA, 357 bp, Zea mays
  Clone ID: LIB3078-039-Q1-K1-C9
ctgtaacagtccaaattaaggagagtacgttgttacccacaggcaagccttgttggcgatcaggaatgagccatccaacaactaatgaagtgagcacttcagcgcaagctactacttggatcgactcgggggcgtgtgccgaggagcaagaacctactccttgggtggacatcggggtctcagactaccagcctttcctggatgtgatcgacgacatgtgcggacttgagtggaggctgcatagactgaaggagaacatgctctcatctagcatagactgccaaaccgtcgccagtgagagtgacaaaagaaaccagaccgtggtgctagtgccaaccggccagctcaaagaaaagc

SEQ ID NO: 70041 - DNA, 245 bp, Zea mays
  Clone ID: LIB3078-039-Q1-K1-D1
caccactccgcgctagctgaggacggttcagcggcacagaggtgcgacgtacgacgagtacgactcatgcgccacacatggcatcccagctctccgccgccgtgccccggttccacggcctccggggctacgccgcgcccaggtccgcggtggcagcgctgccgtccgtgagggtgggcaggaagaggtcgtcgtcgcacggcatccgctgcgactacatctgctccgtcaccaacctgatcatg

SEQ ID NO: 70042 - DNA, 258 bp, Zea mays
  Clone ID: LIB3078-039-Q1-K1-D11
cgccgagctctggaacggccgcttcgccatgctcggcctcgtcgcgctcgccttcacggattgcgtcaccggcgcaccgttcatcaacgcgtataggcggttcagtccaagccagtgcttatatattttggaagttggaactgtgtatgctagtcagctatagcggcaccatgcccgtagtacgagcctagctacagttggacgagctactttttattgggatttactagtcttgggccatttacttctcttcttatt

SEQ ID NO: 70043 - DNA, 276 bp, Zea mays
  Clone ID: LIB3078-039-Q1-K1-D12
caaccgctgcgtaaacgaatccatcgccatggcgtctcgtctcgttgcggcggcgggctcctgggcctcctccctctcctcagcgtcccccctcgctcgcctaatctctcgccgcggccttgccggtgccgcagacggccatgggtctgctaaggtgcccttgtggaaagatccgctgagcccgagcaagtggaaggaagagcactttgttctagcaagcctctcaatgtggggggttatttcttatggtggttacaagctttttagtggaaagaa

SEQ ID NO: 70044 - DNA, 373 bp, Zea mays
  Clone ID: LIB3078-039-Q1-K1-D2
caagaaccgggagctggaggtcatccactcccgctgggccatgctgggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgaggggtaccgcgtcgccggcggcccgctcggagaggtcgtcgacccgctctaccccggcggcagcttctacccgctcggcctcgccgacgaccctgaggccttcgcggagctcaaggtgaaagaactcaagaac

SEQ ID NO: 70045 - DNA, 194 bp, Zea mays
  Clone ID: LIB3078-039-Q1-K1-D3
cccacgcgtccgcctacgcgtccgcttttcgctagctgaggacggtacagcggcacaggagtgctacgtacgacgacggcgacgcaagcgccacacatggcatcccagctctccgccgtcgtgccccggttccactgcctacggagctacgcctcgcccaggtccgcagccgcagcgctaatctacaccatggt

SEQ ID NO: 70046 - DNA, 426 bp, Zea mays
  Clone ID: LIB3078-039-Q1-K1-D4
cccacgcgtccgcccacgcgtccgggcgagcggagggaagggactcaacgcgactggggagggcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgccccttcggcgacaaccaccactagatcgccggcaggatccgtgactcgctggagccaactttaccaagcactggtgctgttgatgtttttacagttttgagctcataaggtcagccatgaccatattgtaatctgtgaccaggtagacttgcccactggtccgtccaactattgtcttgggaccctgtgttaatccttgctatatggaactgacagggctcatg

SEQ ID NO: 70047 - DNA, 434 bp, Zea mays
  Clone ID: LIB3078-039-Q1-K1-D6
gtgaagattgaatacaacaagggatattctccattggccgctttgttgaggttttctgcgaaggcaatgtttaccaccgcaattaggcaagcaaatcagaatcgtctgcacaggattgatgagataagtcgtgaaacatgggatctcaaaaagtccttcgatgggaaagcggtattactgcaaggagtcccacgaaatgccctcgcagacgacatagagcggtttttgtgtggcacgaactttgaacctccaccgtttgaaacctttctaagagctggtgtcccagagcccataagaatgatgctggttaaattccacacgaagactgatgcgatgaatgccttcatcaccaaaaacaggagtttctgtctgaacagtcaagttagcatgcgtgttctccagtaactgagtagccagtcgaatctcgtgatgtt

SEQ ID NO: 70048 - DNA, 248 bp, Zea mays
  Clone ID: LIB3078-039-Q1-K1-D7
ccgacgcgtccgcccacgcgtccgtccacgcgttcgcccacgcgtccgcggacgcgtgggcttctgcctgcgcaagttcttcagctcgcaggcactgggcgggcaccagaacgcgcacaagcgggagcgcagcgccgccaagcgctcctaccacgcgcaccgcatgatcgtgggccagccgctgcacgcgcacgccgcgctcatgcactcgctctgggtcagaccggtcttttcgccgatccacaaag

SEQ ID NO: 70049 - DNA, 416 bp, Zea mays
  Clone ID: LIB3078-039-Q1-K1-D8
cccacgcgtccgcgccgttcgaggccacgttccgggaggtgcgcgtggacgggtgcgcgtgggcgggcaacgccacggacggcgacgccgcggaggcgcgccggtgcagcgagtcctcgtggggcaaggagggccgctactggtggaaggagaaggagatgtcggagctgagcgtgcaccagagccaccagctcgtgtgggcgcgcgcgcaccacctcgtctacgactactgcgtcgacaccgaccgcttccccgtgcagccgcccgagtgcgccggccgctgagctcctgaccgacctacgtcgatccgtgcatggcatggcaatggatctcgtcgggcggtgtggaaatggaactgcttgtttctctcgctggaccgtgggggtttgtgttcgtgcgtctgcagcaatggtgtc

SEQ ID NO: 70050 - DNA, 382 bp, Zea mays
  Clone ID: LIB3078-039-Q1-K1-D9
ccggccgaaggcgagggcaggcggtgtgtcgcgatggcgttcgtcgacgcgcgcttgagagagagtgcctcctgcatccgcgtcatccccgacttcatcaaaccagggatcatgtaccaggacatcacgacactgctgctcgaccccaaagcgttccgtgacaccatcgacgtcttcgttgagcggtacaaggaccaaaggatcaccgtagttgctggtgtggaagctagagggttcatttttggtcctcctatcgctctagccatcagtgcgaaatttgtacctttgaggaagcctaaaaaatttccaggcgaggaaatctccgaaaaatattctcttgaatacggaactgacaagataaatatgcattttggagctttac

SEQ ID NO: 70051 - DNA, 366 bp, Zea mays
  Clone ID: LIB3078-039-Q1-K1-E1
gcggcctcccgccctcgccgggcgaggtgctgaccctgttctacaacccggcggcgacgaagatggccccgaacgaggtgttcggcgtggcgttcaacggcggcttcaaccagcccatcatgtgcggcggagagccgaggcagatgacgctgcaggagcggggcaaagccgacccgcccatctacaccatcaggatacgcgtgccgcagcacgccgtaagcttgatcttctccttcaccaacggggccgagtgggacgggccgtacacgctcaagttcagggtccccaagccatggcagaacaagccgctgagcttcttcaacgagggcctggcggacgagctcaacagggagggcgcctgtgacc

SEQ ID NO: 70052 - DNA, 290 bp, Zea mays
  Clone ID: LIB3078-039-Q1-K1-C12
cttcagcgagggctggctcgactacttcttcaacccgagccttgtccactctcagaggatccgggctatctggtcttgccatgaggtgctcatgggcgccatcaagggttaccgcgtctcctatattcttgtcgactagtacattcatcttactatgcgctcttctcaggacttgaatggtagacttactgtttatttttaaggagaagaatgaattgatgctgttgggctgacaagggaattgttccaatcatttttactagtcatttttttcaaaattgccctttttt

SEQ ID NO: 70053 - DNA, 395 bp, Zea mays
  unsure at all n locations
  Clone ID: LIB3078-054-Q1-K1-H12
gacccacgcgtccggcgtgaagaggaccatcagagtgccggcgatcagctcgaaggtcgccgacatcccttcggacgagtactcgtggaggaagtacggccagaagcccatcaagggctccccttacccacggngctactacaagtgcagcactgtgcggngatgcccggcgaggaagcacgtggagcgggccaccgacgacccggccatgctggtggtgacgtacgagggcgagcaccgncacacgccgggcgcggtccaggggccgagccccctggcgaccgcgtcgccggtgcccgtcgccgtcttcgncggcaacgggctcgttgtctagtctactaaaagctaggattagcttctcgtcttctttggtttttttttggttgagctgatgt

SEQ ID NO: 70054 - DNA, 359 bp, Zea mays
  Clone ID: LIB3078-054-Q1-K1-H2
cggacgcgtgggcgccgccagggactctctggtatctcgccagggccaggaacgcgcgcctcagggccgccgtctccgacaaggacggcgcgctgcagagcctccgacaggagtacaagtgcgtcagggtcagtgaggctgcagcacccccgcgtcgtccgccaccaccacgacggcgtgcagaacccccgcgtcgtccgccaagaccgcccccgcgccgggctacggcctcaatcagcgccttccgaatggcagcagcatgaagggaacgccgcggtcggcgtcacagcggtggacgccggacaagccacggacgccgagcaaccggcggacgtactctatccgcgagccgggcaaac

SEQ ID NO: 70055 - DNA, 347 bp, Zea mays
  Clone ID: LIB3078-054-Q1-K1-H3
cccacgcgtgcgcggacgcgtgggcgcttctgttatccgtgtcattgctcatacccagattaggaagatgaagggtttgaagcacaacacggctcacctgatggagattcaggtcaatggcggtaccattgctgacaaggtggactacggctataaatcttctgagaaagaggtgcctgctgatgctgtcttccagaaggatgagacgattgacatcattggtgtgaccaaaggcaaaggctatgaaggtgtggtcactcgttggggcgtcacccgccttgcccgcaaaacccacaggggtctacgcacggttgcttgtatcggcgcatggcatccggatagggtct

SEQ ID NO: 70056 - DNA, 406 bp, Zea mays
  Clone ID: LIB3078-054-Q1-K1-H5
cccacgcgtccgcccacgcgttcgcggacgcgtgggcactgactttcagtcaaggagacttggaattgggtatggccagaaaaagaatgatgagcagtccaagcagtttgttcatatgctgaactctaccttgactgccactgagaggaccctctgttgtattttggagaatttccaaaaggaggacggcgtcgaggtgccaaaggcactgcaaccttatatgggtggaatagagtttcttcctttcaagcaacctttggatgtcaaacaagcttctgactccaaatcaaacaagtccaaatcaaagggaaatgctgcttgagctggatgaggaacactatgttaatttttgggcctaccagtacacaatacccatagcatgactatggcgttgcaggtttttcgt

SEQ ID NO: 70057 - DNA, 388 bp, Zea mays
  Clone ID: LIB3078-054-Q1-K1-H6
gggtatcgtgcggcggtggatggcaacgatctcgtgatgaacctgggattctcccaccctgttcggatggccattcctgaaggcctggcggtcaaggtggaggagaacacaaggatcaccgtgagcggctatgacaagagcgcgatcggtcagtttgctgctaccataaagaagtggaggccacctgagccatacaagggaaagggtatcagatatatggatgaagttgtccgaaggaaggaaggaaaagccgggaagaagaaatagaaagtgttttttttttgcctttcccttacttcatttcatttttcccactgtaatgatcttcgtctgctaaggctgaacctaagaaaaatattgttctgtgctgatcatggcatatagatgt

SEQ ID NO: 70058 - DNA, 380 bp, Zea mays
  Clone ID: LIB3078-054-Q1-K1-H7
ccgactcgttcgccttcgcattccatctctcttgggctgtacctttgattcggggagggtgataatagggtcaggcctgaaagccagtgattaacagtgcaagaaaacacatcatatcactgaactgctagctatgactaggagctgcagagcgacccatctgtggtattaccatagaatattcaaagcgacgtgagccatacagtgcaaaaggtactagatctatatatgaatggaatcgaatgaatgactgaaaagccacctttaaaagttagacagacttctgactccaaattaaacttactcaattcaattggaactactgctatgatctgcatgatgatacactatgacacatatagagcctacgagttcacatt

SEQ ID NO: 70059 - DNA, 446 bp, Zea mays
  Clone ID: LIB3078-054-Q1-K1-H8
acgcgacgcgtgcgccgtgaccggcaccccaagattggggatggcgtgctgattggagcaggggccaccattcttggtaacgtgaaaattggtgccggggctaagattggagccggatccgtggtgctgatagatgtgccggcgaggagcacggcggttgggaaccctgccaggctgattggtgggaagaaggccgagggtgcgaatgaggaggacatgccaggggagtccatggatcacacgtgcttcatacgtcaatggtcggactacaccatttgagagcggttatccaaggtctattgctcttcttttgtatcactagtaatggtgatgtaccaaataccgagtacttgctctttgttgtgtgctatggtttgtgtattgtacttagaagcctagtggtgtttatgatcattgtcagctgagtgtgccatgcctgaatactg

SEQ ID NO: 70060 - DNA, 436 bp, Zea mays
  Clone ID: LIB3078-054-Q1-K1-H9
gggtttcgtctcgtgtataaggcgttcggagctcgcaaatcctttcctctctcgcgttcgaggctaggtagccgtcaccatgagccgctcggggcagcctccggatctcaagaagtacatggacaagaagcttcagattaagatgaatgcaaaccgtgttgttatcggcacacttcgtggattcgaccagttcatgaatctggtggtggacaacattgtggaggtcaatggaaatgacaaaacagatattggaatggtggttatcaggggaaacagtgttgtaatgatcgaggcactggagccagttgcgaggtcacagtgaatcattgttctttagcactagcagcgtgaaaactgatgtaaaagatatcagtggaccctgttgtatttgactaatgcttttgcacagcaacataacttcggaggtggaatgtct

SEQ ID NO: 70061 - DNA, 331 bp, Zea mays
  Clone ID: LIB3078-055-Q1-K1-A1
gagaggtcatcgattgctgaactgacatcggccaactgctacagaactgagcatctggggagaccagagaactgtgcactacatcaaatggcggaacacatctacattgctggactattccttacagatgccgcctgattctatccagctagtctctgaacatgctgcaacgtatatcatggtgttcctgatgaacctctctgctaccttcatttgtgagttcttccgtgatgcccaagaaaaggttctactgtatgctgactacatcttccactaccaaactgaagcagagatctttgccaaagtccgatgcatggcagactgacaatat

SEQ ID NO: 70062 - DNA, 444 bp, Zea mays
  Clone ID: LIB3078-055-Q1-K1-A10
attttggatccttactagaaatatgttaagctattacttttgctggccagaatatgggtgtccagtgttccgttgctattattttgggggtctgaattcccagccaatttgccaactttgttgctgatggtttgtcttgccattgcaggagcataccagagctctaaaggaaattcttcagagaatgatcccaacaatacaacagtaagtggattcttctttctaaaaaaagatagacttaggaattcctgttaccttatctttcattattttgcaataggtctttgtaggtgggttagattccaatgtaaatgaggagtatctaaggcaaatttttactccgtatggagaaatttcctatgtgaagattcctgtaggcaagcattgtggatttgttcaatttaccagcaggttcatataaatgcttattaaagctctttaatt

SEQ ID NO: 70063 - DNA, 190 bp, Zea mays
  Clone ID: LIB3078-055-Q1-K1-A11
acgcacgcgtacgccggcatctataccttcctcttcttcgttttgcaaaccttccccgaggatcaccaaaacgacaatttcacacggctggcggggcttatactgcgcttccccaccagctacaccctgctgaacaatgatgagctggacaacacgaaagatattgcgccagacaacttccggctagact

SEQ ID NO: 70064 - DNA, 441 bp, Zea mays
  unsure at all n locations
  Clone ID: LIB3078-055-Q1-K1-A12
gaaaatcttcctggtgatccctcctaccagaatcttaagaagatattttcagctgttgggagtttgatttcaatccgaacttgctatcctcagactccaaatggcactggtcctgcaactaatagatcttccaagttagatatgctttttgctaacaagctgcatgctttcgtggagtacgaaactcctgaggatgctgcgaaggctattttggagctcaatgatgagaaaaactggagaaatgggcttagagttcggttgctgaatacttgcacggtggaagggggcangcaaaggaaaaaacggaatgaatgaaactgatggaaatagtgaggaggatgtctncactttgaaccattctaacgagaaacagtttgaaccaatcctctcaactgttagatgtacttgccgaacacttgtttgatgagaattcaacaggga

SEQ ID NO: 70065 - DNA, 435 bp, Zea mays
  unsure at all n locations
  Clone ID: LIB3078-055-Q1-K1-A2
cgtgaacttcctccagtgcctgcagctgagcaaatcgttaaaactggctgtgcaatcagaagggctgagggatgataccacctgtattgttgttgatataatagtagaaaaaaacaactcttccatgccacttgctaaaaggcaaccaggaattggtgtcttcaaaaatatgttcggcaagaaaaaatcatcggattcatcatcccattcccattcagatagagaatatatggatccagataacgtggaggaaatatttgaggatgggtgtgcgcttctttctagacggctggattctgaataccctgttcgaaatatgttcaaactgttcatatgtgccatttgtcaagtagagttaaagccaaaccaaggtatatctgtacatgaagattcatcacaacctgngagcttgcgtcgctgggatggtccattcct

SEQ ID NO: 70066 - DNA, 115 bp, Zea mays
  Clone ID: LIB3078-055-Q1-K1-A3
acgcgcaactcgtgtgctaataactacagatggttgggcttcaagacctgaccttcaaccgtgttgacctggtcttaaataataacctcccaattaatcttaaccttaacttcca

SEQ ID NO: 70067 - DNA, 84 bp, Zea mays
  Clone ID: LIB3078-055-Q1-K1-A4
cttgtcgaactcacactaagcttagataagtgctgggtttgtgggaacatcgtttgtgcaatataaatgagatggtgcacctac

SEQ ID NO: 70068 - DNA, 298 bp, Zea mays
  Clone ID: LIB3078-055-Q1-K1-A5
acggcgcggatcgacacgcccacggggacggccgtgctcgcgctcgtcatactggggctctccaacgtcgcgtccaacgtgccgacggtcctgctgctgggcgcgcgcgtggcggcgtcggcggcggccatctcccccgcggcggagaccaacgcctggctcatcctggcatggacgagcacggaggccgacaacctctcgctgctgggctccgacgccaacctgatcgtgtgctagcaggcgcgccgctcccagcagtacggctacacgctctacttcttcagccacctgcagtttc

SEQ ID NO: 70069 - DNA, 447 bp, Zea mays
  Clone ID: LIB3078-055-Q1-K1-A6
cccacgcgtccgcccacgcgtccgctcagcagcgatcgcagcaccgcggcgagataatgagcagcctgtcctccggcatctctgcctcgccatctgcagcgcccagcaccgctcggcgccgccatgacgcagcgccgcagcagctgagggtgaaggcggcggcgcggccacagctgctgcacgccggccgccggcgttcgagtgtcgggaggaggccgggcggcggcgcggtggtggtgagggccgggcctgggccgctgtcggagatcgagccggacctggaggaggacgccatcgacgtgtaccgcaccaacggcatcagcccggaggacttcgagtacgggaagtatgacggacaccacacctatttcgaaggccaagacaagaagggcttctgagaggatgtctccgagtggtaccaagaagctgagcctcctcagggctttc

SEQ ID NO: 70070 - DNA, 450 bp, Zea mays
  Clone ID: LIB3078-054-Q1-K1-H11
caaagaatatggtatggataagctcatccagattgcggcaacccaacttagcgaccagcttcctgaatcaagggaggctgctcgcaacctggcactggaactgcaagcattctatgagaagtctcaggcctcaacttctgacgaacacgaggtcgaggcctctgcctcgccagatgctgaatcatgggaggctttctgccagtccaagctctccgcattaagtgcccaagccattcttcgtgtgacctctactactacaaaagagtgcgtcacctctgccccaaaagaagggttggctgtgggttgctagcacaagccacaggggagatattgcgatttttcaccctgttcgctgttttgctgtacatgcttttggtttgtcctgcggtgcacccagtcgtgaaaaggttaatcattggttcaggagttcaggtgtgaccacggtgttaa

SEQ ID NO: 70071 - DNA, 434 bp, Zea mays
  Clone ID: LIB3078-054-Q1-K1-F7
cccactcgtccgcccacgcgttcggcgacggcggctcgcacgtctttgagtatctcatggctcttctgaacggcaagaagcctttgttttagctgtttcagaagccctgctatctaggttcgagtgtcagttgagctgaacctactatgattgaaacgagcaaataatgaggcccgtttggtttcatgaacaaacgaataatgtttaccttgtagacatttcacggataatgtataacgttttgaaatttggtccgcagctacatcatagaaatggaattggtctgctcgcaagacacgttccgagcagtactatgaaacaaatgttcgggttcttcgtagacatttgtgtccaaagtccaaacagatccagaagccagaggtgccattagtaccatttgttcaaacaggccctgatcctttttttttaaaatt

SEQ ID NO: 70072 - DNA, 422 bp, Zea mays
  Clone ID: LIB3078-054-Q1-K1-F8
cccacgcgtccgcagtcatgcacactaacgaacgaactcttgctccgatcacgatctagctgaggtcgacgatggcggctgtgctgaacagcatgaagacgccgcaggtggtggccgtgctggtggtggtggcgctgctggcttcgtccgcgtcggcggcgatcacctgcgggcaggtggggtcgtcgatggcgccgtgcatgccgtacgcgacggcgagggccagcgcgctccccgcgtcgtgctgcatcggcgtcaagagcctcatcagcgcggcgcggaccagcgcggaccgccaggcggcgtgccgatgcctcaagagcctcgccaacagcgtcaagagcgttaacatgggcaccgtcgccaccatccgcggcaagtgcggcgtctgcgtcggattccccatcagcatgtgcaccgac

SEQ ID NO: 70073 - DNA, 445 bp, Zea mays
  Clone ID: LIB3078-054-Q1-K1-F9
cccacgcgtccgacgaggcaaagatctcggacttcgggctcgccaagctgctgcagcaggaccaggacctgcacaccaccaccagggtgctgggcacgttcggctacttcgaccccgaatacgcgctgacagggaagctgacgctgcagagcgacgtgtacgcgttcggcgtggtgctgctggagctgctgacggggcggcgggccatcgacctgagccaggggccgcaggagcagaacctcatcgtcggcatccaccaggcggtgggcgaccgcaagaagctgcgcaaggtggtggaccgggacatgcccaggggctcctacacgctggagtcggtgtccatgttcgccgcgctcgccgcgcgctgcgtctgctttgacagcgccggcccgccgcccatgcaggactgcgtcaaggagctccagttcatcatgtacgctaacat

SEQ ID NO: 70074 - DNA, 369 bp, Zea mays
  Clone ID: LIB3078-054-Q1-K1-G1
gcggggctgaccccgtgcaaggagtccaaggcgttcgcgaagcgcgagaagaactcgggcaagaagctcaccgcgtcgctgaagaagtacgcgcccgacagcgcccccgcgctcgccatcaacgccaccatcgagaagaccaagcgccggttcgagaactacggcaagttcgggctgctgtgcggcgccgacggcctgccgcacctcatcgtcagcggcgaccagcggcactggggcgagttcgtcaccccgggcctgctcttcctctacatcgccggctggatcgggtgggtcggcaagagctacctcatcgccatcagcggcgagaagaagcccgccatgagggagatcatcatcgacgtcgagctc

SEQ ID NO: 70075 - DNA, 441 bp, Zea mays
  Clone ID: LIB3078-054-Q1-K1-G10
cggacgcgtgggcggactcgtgggcggtttcgtgggccaggacatgcggagagctcgagggtggtacggtatgacgctgactaaccaatggtgctgcgacgtctgacggaataacagacaggtgacgtgcttgccgactcagacgacgtgcgccaacaggaacgagtacctattatgggacgctttccaccccacagaggcggtcaacatacttgtcggtcggagggcgtacagcgcgtcgctgtcatccgacgtccaccccatggatctgcgcacgctagccaggatctagctgtatggatcatgtaaactcgctaagagaagcacagcttacagagtcttgctttgcacagtgctttgtatcccctcgtgattgtattgcttaccactcgctaatggacgtatggtccctacatctaaactatttatataaacatgata

SEQ ID NO: 70076 - DNA, 456 bp, Zea mays
  Clone ID: LIB3078-054-Q1-K1-G11
gggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtggctactt

SEQ ID NO: 70077 - DNA, 470 bp, Zea mays
  Clone ID: LIB3078-054-Q1-K1-G12
gggctctcgtggtgatgttaccatcttaccaactctggtaattaacaatagacaatacagaggtaagcttgacaaaggagcagttcttaaagcactttgtgctggttttaaggaaactactgagccagccgtttgcttgagtgaagatatacaaacaaatgagtgcctagagaacaatggtggctgttggcaagataaggctgcgaacatcactgcatgcaaggatactttccgtggaagagtttgcgagtgtccaattgtgaaaggagtaaaatttgttggtgatggctatagtcattgtgaagcttccggatctgggcgatgtgaaattaacaatggaggatgctggaaagataccaagaatggtcggacatactctgcctgtaatgatgatggctgcaaatgcccagatggattcaagggtgacggtaggcacaaatgtgaagatattgatgagtgtaaggaaagga

SEQ ID NO: 70078 - DNA, 408 bp, Zea mays
  Clone ID: LIB3078-054-Q1-K1-G2
gcgagggcgggctggactacctcggcaaccccagcctgatccacgcgcagagcatccgtggccatctgggcctgccaggtcgtgctcatgggtgccgtcgagggctaccgcattgccggcgggccgctcggcgaggtcgtcgacccgctgtaccctggcggcagcttcgaccccctcggcctggccgacgaccccgaggccttcgccgagctcaaggtgaaggagctcaagaacggccgcctcgccatgttttccatgttcggcttcttcgtccaggccatcgtcaccggcaagggcccgctcgagaacctcgctgaccacatcgctgacccagtcaacaacaacgcatgggcctacgccaccaacttcgtccccggcaactaagctcaacggctatgctatgcaact

SEQ ID NO: 70079 - DNA, 445 bp, Zea mays
  Clone ID: LIB3078-054-Q1-K1-G4
tcgcccacgcgtccggaccacagccagtcatccacatcactagctatctgtgcaaaggcagtggcgtccaaggttgacctggtggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgccttctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaatgcggatggcgagggcggcgccgtcgtcagctgggccatggagttcgacaagccaacgacca

SEQ ID NO: 70080 - DNA, 319 bp, Zea mays
  Clone ID: LIB3078-054-Q1-K1-G5
aattccggtcgagcacgcgttcgccagcgttcgtcaagcgttcggtgaataacatgcttgatgggaggaacgagctggtaaagtataggcttccaccaaagatggaaaagaaggtgttcaatgaccaaaggtacgtcccatacaccagaaatgtgctccatgacattgaccagtaggccaaggaacaggcattgctgtaccacagtgagaggctggcaattgcttatggtctgattagcaccccagcaaggacttcacttcgcatcattaagaacctgacgatatgtggggactggcacaatgccataaggatcatgtc

SEQ ID NO: 70081 - DNA, 437 bp, Zea mays
  unsure at all n locations
  Clone ID: LIB3078-054-Q1-K1-G6
gtgacccccatccggtgcctcatcgcaggcctgctagactgcaaccctataatgtccaagagaatatgtatagacgattcctcggttacggttcttgagcattcgctgaagacaggatggcagataaaaaggctgaatgatactgcacatctcaggcttctctagctgatcagtgtgtcactgtaaagaaactatctgatagcattctgcaaatcagatgctgaaaccacttgctgcacgcatgtactatgcggccatcacaagtgtggtctcgtcactgtatttcaattgtacctatcgaatgtttctactcaatgtagaagggttggcctgtactggcgttgtgtagtatttgttgttatttttatcaagattatttctcaaattgtagttttccatcagtgtctagttactntttcttggtgggtagttagtgg

SEQ ID NO: 70082 - DNA, 399 bp, Zea mays
  Clone ID: LIB3078-054-Q1-K1-G7
cccacgcgtacggagtgcgcgtccgcgtttctgtgctactcgatcaataagcacttgggagatcactttcacaaggcacccttgccggcgccggagtaccacccggtgcctgaccacagcaagccgacggtgccggagtaccatccggagcctgagctcatctagccgacgactgagtacctgcctagaacgcctgaataccactcttgcacttcagagtactggcagcactagccaactgcgatctatcatcctcccgctgagcactgagttcgatcatcaacgaacgccgtagctataaaaactgcatgcttatgttagttattaattcatgactgcacgtgttactagtgcgcctgatgcatggagaataaaatggtgtgaaatataactgggagc

SEQ ID NO: 70083 - DNA, 460 bp, Zea mays
  Clone ID: LIB3078-054-Q1-K1-G9
cggacgcgtgggcggacgcgtgggcggacgcgtgggcgcccgcccgccgaccagccgccgccgcaccgccaccgcgcgacctcccttcttcgccgcaaaccgctctgggcgcttgaagatggcggtgccgctgttgactcagaagatcgtgaagaagcgggtcaagcagttcaagaggccccacctcgaccgctacaagtgcctcaagccaagctggcgcaggcccaagggtatcgactcccgtgtcaggcggaagttcaagggatgcaccttgatgcctaacattggatatggctctgacaagaagaccaggcactacctccccaacaagtttaagaagtttgtcgtgcacaatgtttctgagctggagttgcttatgatgcacaacaggacatactgcgctgaaatcgcacacaacgtgtccactaagaagcgcaaggaaatcgtggagccgaggccc

SEQ ID NO: 70084 - DNA, 339 bp, Zea mays
  Clone ID: LIB3078-054-Q1-K1-H1
tctgaacctgatctggtcctaacaacctcggtggctagttgacatatgcgcgggttaagcgctagatatgtcgagcgattgaagatactcatatgagtataatacgattcggatacgcgtaccttcgtggctatgaatacttggtcactgccgtacacttatcactccacggaagatgaagggatgatgaaaagaccgctagtataggccacgtgcttgaactatggtagcaagagctctagacgcaggtgactgtacttaacctggtaagccgaattggatcgtcaaggtacactcatagtaagctattatgcaatacatagtctatgattcttgata

SEQ ID NO: 70085 - DNA, 283 bp, Zea mays
  Clone ID: LIB3078-054-Q1-K1-E3
acgggatcatgacatgggggaggaaggctgtctatttggccagtctcacctgattggcgcgggcagggtgatttatactttgtgcagagagagaagatatggagtcgacaggaaagattttgatggagcgctatgaggtgtagaggctactggggaaaggcacatttggcaaggtgcactacccagagaatcttgagtccaacgagagtgttgtcattaagatgatggacaaggacaaagtgctcaaggccgtgctttctgagcagataaggcgggagatcac

SEQ ID NO: 70086 - DNA, 414 bp, Zea mays
  Clone ID: LIB3078-054-Q1-K1-E4
gcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcaaaggtctatgactgcaacaacatggtgg

SEQ ID NO: 70087 - DNA, 386 bp, Zea mays
  Clone ID: LIB3078-054-Q1-K1-E5
cgcattgaggggtatgaagttcatggactggttgtggacaagagaagagaaagagatagctattgtcagtcacagtggtttcttgtttcacaccttaagcatgtacagcaaggagtgccatccaaccataagagacgaagttagcaagcactttgcaaactgcgagctacggtcgatggtgttggttgacagaagcatgcttgggtcatattcctcaagattcaactatgctggcaagaatccaaccggactagatgtgccaagtgatattgcagataagaagcaggttgacgaagctcagaagaactaaggcaaccttgaaagcataccatatatgacttggattatcaagaaattctgacctttgcgaagcttgtttgctttga

SEQ ID NO: 70088 - DNA, 439 bp, Zea mays
  Clone ID: LIB3078-054-Q1-K1-E6
cccacgcgtccgcagacatcgtggcataaggcccaagcagatctgctaaaagcggaaaaggaccagattgcaaatttaactgacattttcgggataccagagacccagcttaagttcataatcgaagcttggtcacagattatagaatgcaggcgagtgttgaaatggacatatgcttatggctactatctggatgataagatcaagagtgaattttttgagtatctgcaaggtgaggctgagtctggtttggaacgcctgcatcagtgcgctgagaaagacttgcaaaattttttgccgtctgtgaaatctgacagcactgaaacaacgacacctacagtggctgaatttggtgaattccgcgtgaagcttgctggacttacaagcgtgactcggaattactttgagaaccttgttcaagctttggaagctgggttgg

SEQ ID NO: 70089 - DNA, 243 bp, Zea mays
  unsure at all n locations
  Clone ID: LIB3078-054-Q1-K1-E7
cgccactgtccagtgcgcgcgtcaagcttgcttagctagccgccatggcctgcctaggcgccgtctccgtgaagcccgtggccatcaagggtctcgccggcagctccatctccggaaggaaactcgccgtcgccaggccgtctgcccgctccatccgcaggccccgcgcagccgccgtggtggccaagtacggcgacaagagcgtctactttgacctcgacgacatnggcaacaccaccggac

SEQ ID NO: 70090 - DNA, 425 bp, Zea mays
  Clone ID: LIB3078-054-Q1-K1-E8
cccacgcgtccgctcacgccttcgggcttcgacccgtacaccgcctgcgatctcaaggtgaaggatctcaagaacgggcggcttgccatgttctccatgttcggcttattcgtgcaagccatcttgaccggcaagggccctatcgagaacctattcgaccacgtcgccgaccccgtctgcaacaactcctgggcatacgccacgaactttgtgccctgcaactaactgactgagcaacgccacacatgtgcactaccatcagacccatgcattcgtccgtccgtccgttcgtccgtagagtgaacagtacggtcttggctgtactctatatgatcagatcgttggcgtatagtatgctcaccagccggcgtttgctcatgatctacgtgagtgcttatgaatcaatcgtaatggttgccttctgt

SEQ ID NO: 70091 - DNA, 453 bp, Zea mays
  unsure at all n locations
  Clone ID: LIB3078-054-Q1-K1-E9
ggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaggtcgactacctgctcggcaggcaggcctacggcggcaagaccgactccgagggcgggttcgagaccggcgccgtggccaccgccaacgtcctggagagctccacccccgtgatcgacggcaagcagtactacgccgtgtccgtgctcaccaggacggcggacggcgacgagggcggcaagcaccagctcatcgcggccaccgtctccgacggcaagctctacatctgcaaggcgcangccggcgacaagaggtggttcaagggcgccaaggaaggg

SEQ ID NO: 70092 - DNA, 436 bp, Zea mays
  unsure at all n locations
  Clone ID: LIB3078-054-Q1-K1-F1
cccacgcgtccggaaaagtttacctcatattggtatcaaggttgatcgatcacaaatggcagttgcttctagaactaggtaaaaaaacgaaaatatgaatgttgtagctgacttgatgcatggttatttgttaggattactaagagatagtaacgaacctcacaatcattacggcagctcagtacctatctccaaataaaaacttttgttgatgcggcaaacatggacaagtaggtcctttaatcaatatttgtttggcgaatttgtggtgtacatgcccatatgataaatggactgtagaaggattgaatattcaaaagtgcacatgtctctgatgtgcttataggttatgtcattgaaactggaagtgtangtagccaatttctacgataccacaggatgtactgncctatcttctatgagcacacccagtgct

SEQ ID NO: 70093 - DNA, 464 bp, Zea mays
  unsure at all n locations
  Clone ID: LIB3078-054-Q1-K1-F10
cagcgtcgtcgggctcaagcccgccgcggcagtgccgcaggccgccgccgcctcatggccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcggcagctgccagttcccctacaacttcactgggtgccaggacctcgccaagcagaagaaagtccccttcatcagcgacgacctcgagattgagtgcgaggtgaaggagaagttcaagtgcggctccaacgttntctggaagtggtgaagcagctagcagcagcgtctgatgggaatggaggagatcatca

SEQ ID NO: 70094 - DNA, 448 bp, Zea mays
  Clone ID: LIB3078-054-Q1-K1-F11
gtgaaggatacatcagacaagcttaaacaagctagcgaggcggatcatcgcgttgaagggagcgctaccaaaaagattgctgatgcaaagctagctaaagatttccaagcagtcctaaaagaattccagaaagctcaacgattagcagtagagagagaagctgcatatgcaccttttattactcaagcgggcctgccacagagctacaactcaagtgaagtgaacaatggtgctgataagttggcagagcagcgcacgcagcttctagaatctagaaggcaggagttggtcttcttggacaatgaaatagtgttcaatgaggccatcattgaggagagggatcagggaatacaagagattcaacaccaaatcactgaagtaaatgaaatcttcaaagatcttgctgtgctagtccatgatcaaggagcaatgatagatgacattgatt

SEQ ID NO: 70095 - DNA, 413 bp, Zea mays
  Clone ID: LIB3078-054-Q1-K1-F12
cctattcacatgcagttctctgacgacgcagaagaaactttctccagagcaattagcagcttgctgaaggcacaatatgtgaagaagggagactacgtcactcttgttcagagcggagtgacttcaatctggagagaggaatccactcaccacatccaagtgaggagagctcaggtctgatgtgctggtgggaatcagtcgccggagaagttttgatagcgccgctagaagtgttatcatcatcatcaccattatatgcgagtaattttaatgtttttaccaggagattgctacgtcgagttgtatgttgtgtcgaattcacgtgtagactctggacctttaactctgtattcgttcattttcacttgtttcacactggagtgctataagttcacgcttactgcctttgcttt

SEQ ID NO: 70096 - DNA, 400 bp, Zea mays
  unsure at all n locations
  Clone ID: LIB3078-054-Q1-K1-F2
aacacacacaactgtagccgtcgtcgtcgttggcgtgcgtgttgctctgctttcggagcccgtgcgcgagcggaaccaaagtaccagaccatggagggcctgctgccgttcctgtaccgggccatcctccacctcgccagcggcgggcagtcgcccatcggcaaccccttcttccgcgacgactcgccgccggagtcgccgctggcggcgcactactacgtccgcctcgccgtcggcgccgacgtgccggccttcctctcctccgcggcgcgcggctactacgaccgcgggtgagagcccggccggaccaggaacgacgctgggcctgtgcgtgcgagcaggaagaatcctcgtgtgctccttcagatgcgtgttcagagtgctgggtctnctcccctct

SEQ ID NO: 70097 - DNA, 438 bp, Zea mays
  Clone ID: LIB3078-054-Q1-K1-F3
ggccaagtcaaatgtggttattaacctcataggacgagagtatgaaacaaggaactacgagcttcgaagaagtaaaccaacttatgcctgaacagcttgcaacaattgctaaggagcatgggggtatcataagatttattcaggtttcttgcctaggggcgtcaccgtcttctgaatctagaatgttgaggacaaaagctgcaagagagcaatcagtcttcaaagaattccctgaggctacaatcatgaggcctgctaccatgattggcacagaagatcgaattctgaacagatgggcacaatttgcaaagaattggggtttcctcccgcttgttggtggtggatctactaagattcagcctgtgtatgtaatcgatgttgctgctgctattgtgaactccctcaaggatgacggcactagcatgggaaagatatatg

SEQ ID NO: 70098 - DNA, 440 bp, Zea mays
  unsure at all n locations
  Clone ID: LIB3078-054-Q1-K1-F4
gtccctgccggctccgggaacgccggcggcgggacctacgcgaaggacaggctgggcgacgacgtcacggtggatgcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaacggcgctgagaacaagttcatctgcccctgccacggatcccagtacaacaaccagggcaaggtggtccgtggaccggcgcctctgtcgctggccctggttcacgccgacgtcgacgacggcaaggtcctcttcgtcccgtgggtggagaccgacttcaggaccggcgaggacccatggtggaaggcatgangatgatccggaaccagccgtgc

SEQ ID NO: 70099 - DNA, 415 bp, Zea mays
  Clone ID: LIB3078-054-Q1-K1-F5
cccacgcgtccgcggacgcgtggggttctctttgatgagattgagaaggcacatccagatgttttcaacatgatgcttcagatcttagaagatgggcggttaactgatagcaaggggcgcactgttgatttcaagaacacactattgatcatgacatctaatgtcgggagcagtgtcattgagaagggaggtcgcaagattgggttcgaccttgattatgatgagaaagacacaagctataacaggatcaagagccttgtgactgaggagttgaagcagtacttccggccagagttcttgaacagattggatgagatgattgtattccggcagctgactaaattggaggtgaaagagattgcagacattatgctgaaagaagtgtttgacaggctgaaggccaaagacattaatc

SEQ ID NO: 70100 - DNA, 451 bp, Zea mays
  Clone ID: LIB3078-054-Q1-K1-E12
gcgccggcggcgttgcctggcgagccccgcgctccctgtcgccgctccgccgtgccggcggcgccatcatcccggtcccggtgagcgagtgactagctagtaggctggccggcgtgcatggtgtgtccgagcatccgtcgacacgcggttctctcggctgcccgcgcgccgccggttgtagatatcgctaggcgcgtacgtacgtagcgagcgtgaccagtgttcttggggggtgttagtgagtgagcctgcccgtgctttgcgcctgcgcgcgcggacatgggatcggagcttggtagacgacgacggtatatagtaggtagcatcgccatgtgtacgtactgcgtggttcctggtacagtagcatagcatgctctgtttctgtatcctgctgtgctcttcttcttggtggtgtgtgtatgtatatataaatatatgtttacgatgagtt

SEQ ID NO: 70101 - DNA, 380 bp, Zea mays
  Clone ID: LIB3078-055-Q1-K1-E1
gccacacgtcctgccgagataactatatcggctgtgctctgacagcttagacctgcgggctgattcaatcaagatgaaaccagatatctgacagaccgcatacagaatggtgccacagaagtcgtggaagcaaaagctgaatcacgctccgtgactgtttcaatggctgaagctgctactaaaggcgctgacgcatgcttgcgagctatgcaaagcgaacctggaagctatgaatgctcatatgctgcatgcaatgcagcagatctgccgatctaatcaacgaatgtcaagcttggacgctgttgacccgaggatattctaccgattggccataacaatgatatcgtaagagctagtctggtagcgacagaggaggaact

SEQ ID NO: 70102 - DNA, 328 bp, Zea mays
  Clone ID: LIB3078-055-Q1-K1-E10
gaggtcggtggccccggccggcttcagccgccacggcggcggcctccagcagcacgtcgggcaggagaagttcgaggagggcgacacggtcttacgcgccggcgccaaccaccatcaccaccatggtcaccacggcggccacggcttcgtggtgcgcgagaccagggtcgaagaggacatcaacacctgcaccggcgaggtccacgagcgcaaggagagctatctcgccagcgctaactgatccgaccggctgtcggcatacacgcccgttcgtgcttgcctgcgtgccttatgcatgtctctggttgactggttgtgcaaggtcatc

SEQ ID NO: 70103 - DNA, 415 bp, Zea mays
  Clone ID: LIB3078-055-Q1-K1-E11
cccacgcgtccggcgtcaagaggctccaggacatcggcgtgatcagcgccgtgccgggggtgaaggcgctcgacatgaacaccgtcgaggacgagatcgtgcgcctgacgcgcgaggtcgttcccggcatgatcgtcaccggaatggaggtctccgagattgactgcgcccccaggatgggcccgacgtttggcgccatgatgatctgcggccagaaggcggcgcacctggcgctcaaggccctgggcaggcccaacgccgtggacgggaccatgtcgccgacgttgcgcgaggagttgatgattgcgtacaatgacgactaggtcgttgacgcctgagtgcggcaagcatagaagatgatcgacgccagcagcgtcttatcttaattgcccttgtgttcaatgatgaatcgatc

SEQ ID NO: 70104 - DNA, 241 bp, Zea mays
  Clone ID: LIB3078-055-Q1-K1-E12
ctcatcgataaggtcagcagaagctatgataagtttttcttcggagatgctgctagagagaaatgtgattactttctgggggggattttgctgattggtatattgaagctagcaaaacacggctttaccactcgagtgacaagatcgctgctgctacagcccagagtgttctggtgtatgtgtttgaaaacatactgaagttattgcatcccttcatgccattcgtcactgaagaaattat

SEQ ID NO: 70105 - DNA, 446 bp, Zea mays
  Clone ID: LIB3078-055-Q1-K1-E3
gccatggcgtctcatgatcatcaccactcccactcccacgacgaccaccaccaccattcccacggtgacggcggtggccatgcggctgggggatcgtgggtaggggaggacggacgcgtgtggcactcccacgacggcctcgcgccccactcccacgagcccatctactcccccggcgacttcaccaagcgcgcgccgccgctcgcctcgcgcgacttcgctgaccgcgccttcaccgtcggcattggcggccccgtaggcaccgggaaaactgccctcatgctagcattgtgcagatttctacgcgacaagtatagtcttgcagctgtcacaaatgatatattcacaaaagaagatggagaattcttaattaaacatggagcgctccctgaagaacgtatacgtgcagtggaaactggaggctgccctcatgcggctattcgcga

SEQ ID NO: 70106 - DNA, 340 bp, Zea mays
  Clone ID: LIB3078-055-Q1-K1-E6
atccggaatgagcccgctcggccaaatggaccggacctgagcgctctcgttcgctcggacgcgagcagtgcatgcttgagccaccgccgccgcgaggagctccgcccgtccgccgtcatccgtcaaatcagggagcttcacagcgatggatctgaacagaagtgggaaatggcagaaaagacccggcagctaggtattgtgcacgtcattgtgtccgtccgtcgtcggatctggtcgcactggagacgtagtgtctgatcaggcagcacagcagccacccgtcgatagatactagttgacgatagggttgtacggcaggggcagctgcgtgttggacgac

SEQ ID NO: 70107 - DNA, 438 bp, Zea mays
  Clone ID: LIB3078-055-Q1-K1-E7
catgactggtgcaacaggcacacttggttatatggctccagaggttcttgatggtaagccatacaacaggaagtgtgatgtttatagttttggcatttgtttatgggaaatctattgctgtgacatgccttacccagacctaagttttgccgatgtctcatctgccgttgttcaccagaatttgcgcccagacattcctcgctgctgcccaagcgcatttgcgaatgttatgcggaaatgctgggatgcaaaccctgataaacgccctgatatggatgaagtggtgcagcttttagaggctctggacacgagcaaaggcggtggcatgatacctgatggccaatcatcaggatgcttatgcttcacaaaggctcgtggtccatagatacttttcatggtactcccttcccttggcaacactttccccgtgtaaatgac

SEQ ID NO: 70108 - DNA, 302 bp, Zea mays
  Clone ID: LIB3078-055-Q1-K1-E8
cccacgcgtcccgacattctctcttgattcaccggacacagaggatcctggagataggacatacaccaatattcggcacagcgatatcagatgcacttcgagcttacaaatcaacctctctgccatgcctctaatatacctattgttacaccgtgactcatctgatcggctacaccactattatcgccgatacatgatcaaactactcccattctcacttgcatatgctgcgcttctatgctgtcatgcacaccctgataaactcactctcctctctcaaatacatcacatgccacactctc

SEQ ID NO: 70109 - DNA, 162 bp, Zea mays
  Clone ID: LIB3078-055-Q1-K1-E9
gtttcagtttgcttatagccccgaagactcttttctcccgtagtgtcggaatgccagggtctgtccctgtgggtgtgttgcgtaactgggatccgagtataccctgctgtgttcgtcgttacattgaatggatctgaatgaaagtgggttagattggagctt

SEQ ID NO: 70110 - DNA, 283 bp, Zea mays
  Clone ID: LIB3078-055-Q1-K1-F1
cggacgcgtgggcggacgcgtgggcttttttacaatgtactcatcagttctatactcgcagcgaaaatctatagtgggaactcctgcatacattgctcatgaggctcttctgaagaaggaatacaatggaaaggttttatgcgtagcgtcgttaattattctacacttgacatactgcctttgattaatgtgcctgctattattctccacttgaacaacatgttaagctgtcacaccatgttatacactcacgatttctacctatgcataacacggcactatg

SEQ ID NO: 70111 - DNA, 402 bp, Zea mays
  Clone ID: LIB3078-055-Q1-K1-F11
acgggaagcggcacctcatggatccagtggatcgcgccgcgatgcagcgacagaaacgaatgagcaaggaccgctagtctgctgcccgggcacgggagaggaagcaggcttatatcgccgagctagaatcgctggtaacgcacctcgatgaggagaatgccgagttgttgagagaacacgaagagcggtaccagaagcggcttatagagctcttggaacggatgacgccactcattctgaggaaaaaaccatcaggagatcttagatgaacgaactcattgcagtggtagattggagccaagctcagtcgccgtctctttacagttataacatagaatttgcccctgtatgtcattgttctatttatatatgcgcgaactaagttgtattatctcagctgaa

SEQ ID NO: 70112 - DNA, 430 bp, Zea mays
  Clone ID: LIB3078-055-Q1-K1-F12
cccacgcgtccggagcacctcgtccgcaacccgtttggtcaggttccagctctgcaggagggagacttgtacctcttcgaatcacgagcaatctgcaagtacgctgctcgcaaaaacaagccagagctgttgagggaaggaaacctcgaggaggcagcaatggtggatgtttggatcgaggtggaggctaaccagtacaccgctgcactgaaccccattctcttccaggtcctcatcagtccgatgcttgggggatccaccgaccagaaagttgtggatgagaaccttgagaagctgaagaaagtgctagaggtgtacgaggcacgcctgaccaagtgcaagtaccttgctggagacttcctcagcctcgccgacctgaaccatgtgtctgtcactctcttgctgttcgctacgccctacgcatctgtgc

SEQ ID NO: 70113 - DNA, 454 bp, Zea mays
  unsure at all n locations
  Clone ID: LIB3078-055-Q1-K1-F2
gtcggtggagatatcgtcgcctttgtcgtccaggtacacgagcgtcgaggacctcgggccaccggagaaggctgcagagaaggtcctcggtcagtacctgacggagttcatgtccaccaggctgggcgttcggcgtgaatccaacgtcctatcggcgtcatccaaggtcgctgacgatggcaagctctactacgaggttgaggtgaacataaaatcctatgcgagcaacaacgagctggcggtgatgccacaggacagggtgcagagcttggagtgggaccgccgatacctgtcagtgctcggcgtcgagaacaagcggctctacgagctccggctgcagacgcccgagcaggtgttcatgcaggaagaggaggacctcanaagagtcatggactccttcagggtcatcaaggcggcgtagtttgtcgatagtagagtgcacatgttttggttt

SEQ ID NO: 70114 - DNA, 427 bp, Zea mays
  Clone ID: LIB3078-055-Q1-K1-F3
cccacgcgtccgcgcagctgaggcggcggaaggggagggtgccgtggccaccaagccgaagggcgagaagccgccgccgatcgggcccaagaggggcgccaaggtgaagatccttaggagggagtcctactggtacaacgggatcggcaacgtcgtcaccgtcgatcaggatcccaacacccgctacccggtggttgtgcggttcaacaaggtgaactacgccggcgtgtccaccaacaactacgccttggacgaggtcttagaggtgaaatgagtggggccggccggctcaagggctccgcgctagctaccgtgtgattgatttgtagtagttgtgaaatgaggctgtgaagctgcatgctgtgctggctagcgtcacaacatcgatcctatgtgtaatagcataatccacataatcatatcatgt

SEQ ID NO: 70115 - DNA, 455 bp, Zea mays
  Clone ID: LIB3078-055-Q1-K1-F4
cccacgcgtccgaagatgtggatggcttccatcctctcaacattggcaagcttgcagggaaaggcagagagccactgttcgtaccatgtacgccaaaggggtgcatggagctcttgtcaaggagcggagtcactgttaaaggtaagcgggcagttgtggttggtcgcagcaacatcgtcgggctacctgtatccctgctccttctgaaggcagatgcgaccgtatctgttgtgcactcgcggacccctgatcctgaaagcattgtacgcgaagccgacatagtcatcgcggcagctgggcaggctatgatgatcaaaggtgactggatcaagccaggtgctgcggtcatcgatgtcgggacgaactccgtcgacgaccctacccggaagtccgggtaccggctcgtctgcgatgtggatatcgcagcggcgagcaatgtttgctggtacctgact

SEQ ID NO: 70116 - DNA, 445 bp, Zea mays
  Clone ID: LIB3078-055-Q1-K1-D9
cccacgcgtccgcagcgttggctgatcctctcaaggtcatgatatcaggagctgcggcgtccggcaagggcacacagtgcgagctcatcaagaccaaatatcaattggcgcacatctccgccggagatttgttgcgggcggagatcgctgctggctctgagaatgggaagcgggccaaggaattcatggagaagggtcagctcgtgcctgatgagattgtcgttaatatggtgaaggaacgccttcgtcaaccagacgctcaagaaaatggttggcttttggacgggtacccaagaagctattcacaggccatggccttggaaactcttgaaatccggcctgatactttcattctgttagatgttccagatgaactccttgttgaaagggtggttggaaagcggcttgatcctgtaacagggaaaatatatcatttgaagtattc

SEQ ID NO: 70117 - DNA, 423 bp, Zea mays
  Clone ID: LIB3078-055-Q1-K1-C3
ggcgtcaagttcggcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtc

SEQ ID NO: 70118 - DNA, 190 bp, Zea mays
  Clone ID: LIB3078-055-Q1-K1-C4
gcaagcgtcccgagcacagaatgagcttccgtttagttcacagtgacatgttcaaaaggtctggaaggatcttccattgagcttaggacaggcaggaagtcttggggcctatgtagtgtacaatttatgtgtgtcatatcccgtgctcgttgccagtttgtattggaccatatataaaccatataatatg

SEQ ID NO: 70119 - DNA, 432 bp, Zea mays
  Clone ID: LIB3078-055-Q1-K1-C5
cccacgcgtccggatccacagatgtttgagggagttacgcatgtgatatgtggtactggaactacagcatttccgtctaagcgctgggatggagataacactccagaacgtgtagattgggatggcatcagaaatcttgtcagtgccttgccacagacagtcaagagactggttcttgtgtcatccattggtgttacaaaatacaatgagataccatggagcatcatgaatctctatggtgtgcttaagtacaagacgatgggagaagactttgtctgcaattcagggataccattcacgattattagggctggaagattgacagacgggccctacactgcgtatgatcttaatacacttgttaaagctacagctggagagcgacgagcagtagtcataggcaaaggtgacaagctcgtgggggaagttagc

SEQ ID NO: 70120 - DNA, 338 bp, Zea mays
  unsure at all n locations
  Clone ID: LIB3078-055-Q1-K1-C6
ggcaattctatggagcaatgactgcccacactagtagatgcatgaggaggatggcgcggtatgatatccaatgcgcatgcgattaatgagatgctctgatgcattcaatgcgacctgttgatatctgcctctgcgacgtacactctgaaaattttacgtaacgaccgttgctggtgtctctacaggcattgaacctactcatacatcgaacggtcgacacgaattcgtacttactttatgtgacgctcacattcgtgtgaaggctactcagtatatgttctatctactgctntaaatgcgttcacctgttcactgttaagcatcatcgctggaaatat

SEQ ID NO: 70121 - DNA, 396 bp, Zea mays
  Clone ID: LIB3078-055-Q1-K1-C7
tgaatgagctcaagctcaaggagatcaagaacggcaggctcgccatgctcggcgatccgcggttacttcatccaggggctcgtcaccggcgttggcccgttccagaacctgctcgaccacctcgccgaccccgtcaacaacaacgtgctcaccagcctcaagttccactagaacgttggtgcatcagcatacctgctgccgccgccgccagttgtttgctgtggaaagctagatgcatgcgtgttgtaaaggaacctgaagcgttgcatcggtcatgattcatgcatggccagcctgctgcctgtaacaacaaactagtattgatcttattgagaccggaaactgtattgcacatggtaaatcaatgtacaattcctccctagatgcggacaaaat

SEQ ID NO: 70122 - DNA, 441 bp, Zea mays
  unsure at all n locations
  Clone ID: LIB3078-055-Q1-K1-C8
ggctgggcgctcgctgacggtgatcgcaggcgcctccggcggctccgaacgagatctcagcgcctccgcagtctccgtggaggccctggactccgtcgcctccgattctgacttagagacgaaggagcccagtgtgtcgacgatgctgacgagcttcgagaactcgttcgacaagtatggggctctgagcacaccgctgtaccagaccgccacctttaagcagccttcagctacagattatggaacttatgattacactagaagtggtaaccctactcgtgatgttctccagagcctcatggctaagcttgagaaagcagatcaagcattctgcttcaccagcgggatggcggcgttagctgcagtaacacacctncttcaggctggacaagaaatagttgctggtgaggacatatatggtggttctgatcgtctactctc

SEQ ID NO: 70123 - DNA, 369 bp, Zea mays
  Clone ID: LIB3078-055-Q1-K1-C9
cccacgcgtccgcggacgcgtgggccaacatcgtgctctacgccgagacgcgcgtggtggggttctaccgcctgctggacttcgccatggaccccgacggcatcagggggatggcatactaccgcaagtccgctactaccgccgcttgattcgtctcgtctgtcttgtactcattcatcaatgaaggaagtcgatcgaattccctaaagccccccatgtttgtatgatgtagatatgacatggtttatttttatcactcatctcatagttgctcgtttattatctttcattttatattccgcgaaaacgatctagctagaacatgtacttatatttcgcgcaaatcaagcaatataaaaacctcacttc

SEQ ID NO: 70124 - DNA, 400 bp, Zea mays
  Clone ID: LIB3078-055-Q1-K1-D1
caacagcccagccgctgtcgccctcgttccgtagtacggcgccgccagatcgtcagggaccatgatcatctccaagaagaaccgccgcgagatctgcaaatacctcttccatgagggggtcttgtacgccaagaaggactacaacctggccaagcaccccaagcttgatgtgcccaacttggaggtgattaagctcatgcagagcttcaagtcgaaggagtatgtgagggaaaccttctcatggcagtactactactggtacctcaccaacgatggcattgagcacctccgcagcttcctgaacctgccatcaaaggttgtgcctaataccctcaagaagtcttccaagcccccgtatcgccccttcggctctggcccacctggtgaccgcccccagggc

SEQ ID NO: 70125 - DNA, 322 bp, Zea mays
  Clone ID: LIB3078-055-Q1-K1-D10
agacatcgtataaccataataatattgaactcatgcatttatactagtgacaatgaatcgtgcacggcattttaacgctggaattggtctacatcgtactaaagatttagaaataaccatagaaattgcttgctgttgcaccaaagtgctgtgaactatccattgtcgctttatgcatacattgttggtttacaaatgaaacatagaactctcatcatgtgcatacattattagttactatggtgaccacaatgtcgaaatggtactcaacttgtttatgactgccgcttataggcaactaatatgacattactagcaatga

SEQ ID NO: 70126 - DNA, 453 bp, Zea mays
  Clone ID: LIB3078-055-Q1-K1-D11
gcactactaggtttgggtgctgggaccttatcacatctgatgctaaagttttggccttggttacaacttattggctgggagatcgaccctatgataattgaattgtcaagggattattttggtatgtctgatttagagaaggccacagaatcaggtggttcacttttggtgcgcattggtgacgcactttctccatcagctacagttgaaggaggatttgctggaattgttgtagatttgttttgtgatggaaaggtcatacctcagctacaagaagccaaaacttggttgcaaattgcaaaaaggctaatgccagacggtcgaatcatggtaaattgtggtggatcagacactgaagaatctctctcatcgccttgggttcaaaaccctacagttaaagcactgtgttccgcatttcctggacaggtaagctggaagagactatcggagaaa

SEQ ID NO: 70127 - DNA, 201 bp, Zea mays
  Clone ID: LIB3078-055-Q1-K1-D4
attcccgctgcacctacgcgtacgcctactcgtactcccactcttacaccgtatcacttccgcgatctgtcgcttttcttggtgcagtgctcatcgctcgatcgctcagaacaaaaaatactagattttcgcatagaatctttcgccttccaaaacaccgtacacagtttgtcccctacccgaactctctgacgaacccct

SEQ ID NO: 70128 - DNA, 448 bp, Zea mays
  Clone ID: LIB3078-055-Q1-K1-D5
ggaggcctatgcccatgaagagcgccttcgattccgtcggagagatttcatcggcacgtgcgtcggcaccgctattggtttggaaatgatcgacggctctacgagtttctctggagtggctactgcagctgatctcattgagcgtagacaaaggtcggagttccaatcaaaaatcaaagacaccctttacgtagccataaaggctaagccagagctcgttccatcgttgttgaccatggcactgaatgatgccatgacatacgacaagaccacaaaaactggaggcgcaaatggatctatcaggctagaaacaagcagacctgagaacagtgggctctcttccgcgttggatttgctgactgaagccaaaaaggagatcgattgcttttccaagggaggtcccatttcgttggcagatctgatccagtttgcagcacaatcagcactg

SEQ ID NO: 70129 - DNA, 404 bp, Zea mays
  Clone ID: LIB3078-055-Q1-K1-D6
cccacgcgtgcgtccacgcgttcgcacacacatgacacagccccactcacccggcatggaggccctgttcgtcagctgaggccatggtttccctcaagccgtataagaggctcgcctcgggagtgctaaaatgtggcaaggggaaagtgtcgattgaccccaacgaggtctacgagatctcgatggctaactcgcgtaagaacattcgtacgctggtgaaggatggattcataattaagaagccgcataatatccactcaaggtcccgggcaaggagggcccatgaggccaagcagaatgcgaggcactctggttacggtaagcgcaggggtaccagagatgctaggcttcccaccaagatcctttggatgcgcacgatgcgtgtcctcatgcgtctgctgcgc

SEQ ID NO: 70130 - DNA, 343 bp, Zea mays
  unsure at all n locations
  Clone ID: LIB3078-055-Q1-K1-D8
gtcactgcaagcctaagcctgatcccaaaccgctgatatgttgtgtctgttggcactgcaagccggagaagaaggaagagaagaaggaagaaaagaaggacgaaaagaagccggcgccggccaaaacggagtacaagtttgtgccctacccgtacccgctgccgaaccccgcgatgtgcccgagctggccgtggcagtgcccgcctcagcagcagtgccagtgctgccagaagccttcggcttcgncggccaagtcgccgncgaagccgncgncgtgcacctgttcgagccacgccgtctgtgtctgcggcaagacaccgccggcggtctggccaccgatgcc

SEQ ID NO: 70131 - DNA, 446 bp, Zea mays
  unsure at all n locations
  Clone ID: LIB3078-055-Q1-K1-C2
aaggagattaatctccaggtcacggagaagttccgagatagagttgttgacgaaggtgataacccgagctatggtgccagacctttgcggcgtgctatcatgaggcttctggaggatagtctggcagagaagatgctggctggtgaggtgaaagaaggtgactctgccatcgttgatgtggattcagatggcaaggtgatagtcctgaatggtggtagcggtgttgctgagccactggaacctgctctcagtacctaaccgaggtcaaaatcatcattggtccgaaatatggccttctttacaagtcagctgggtttctcgtgatggtaaaaactagactgacattacttggccgcccattagttgctntatctttcgtttattttcttttttgttggaagtgaggcagtagggttgctatggaaatgaatagatggagaagcatt

SEQ ID NO: 70132 - DNA, 193 bp, Zea mays
  Clone ID: LIB3078-055-Q1-K1-B1
aaggaccggatgctttacattgagaagtgtgccaattctagagctgtaaccattttcgtccgtggtggaaacaaaatgatgattgaggagaccaagcgcagtattcatgatgctctttgcgtggcagggaatctgatccggattaactggatggtgtccgggggcggttaacccaaaatttttggttaaatgg

SEQ ID NO: 70133 - DNA, 435 bp, Zea mays
  Clone ID: LIB3078-055-Q1-K1-B10
cccacgcgtacggtgtatatcaatccttgcagttattgctctaattgcctgcatctgggtgccggaaactttgcataaacacaatggggatgccgatgataattcagttgaaaccgtagaagaatctcttgctggcaccgacactgaagaaaatggaggtggcggatgtctaaaattatttacaaactggccgttgatgtcagctattactttatattgtatcttctctcttcaggatgtggcttatgcagagacattctctctttgggctgtcagtgacagatcgtttggtggattaagctttactaccacagatgtgggcaatgtccttgcgatgtcaggtctcttactttgtctatatcaaatgatgatctatccgttccttgccaaaacggtggaccacatcacattaatccgtgcagtggcgttattgac

SEQ ID NO: 70134 - DNA, 216 bp, Zea mays
  Clone ID: LIB3078-055-Q1-K1-B11
ataggcttcgctagacaaagacctgctaatgatggtctggggtgaatgaagaggtagatggaaacagaacagaaggctggttgtttgtagtgaaacactgaatatggtgttgagctattcatattcattggttcaattttctccatagcattctagaatagagtatttgatggttggtgaaacttcgctcgcaaaaaaaaaaagttgtttggatcc

SEQ ID NO: 70135 - DNA, 442 bp, Zea mays
  Clone ID: LIB3078-055-Q1-K1-B12
aggtatcttgcggaatttaagactggtcctgagaggaaggaatctgctgagagcacgatgatgggctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctcctgagggacaacttgaccctttggacctctgacctcacggaggatggtgctgatgagggcaaagaagccccgaaaggtgaggctggtgacggacagtaagggacagtaatcttgggagagcgcatattgttcgagcccattgttttagatgctctatgct

SEQ ID NO: 70136 - DNA, 446 bp, Zea mays
  Clone ID: LIB3078-055-Q1-K1-B2
cccacgcgtccgagcacttcttgaagaccccaacgagtctgttcaattaactgctgtgcaatgcttgttaaatgtccttaatttgtcagaacaagatgctgttggtccaatcttaataaatctcttagtaaggctgcgaaatcttcaggtctcaatgaatacgaaaatgaggttcaatgcgtttgcagcttatggtgctttaagtgcatatggtgtcggtttgcagctcactgcttttattgagcagatacatgctacccttactcgtctgatcctccatcttcacgatgatgacctaagtgttcgtcttgcctgtcggaacacattgcagctccttgcgacattgatggaagtcgagggcttgtctgtgctgctcagcaagcagtattctgcttctgatcgccgatctgactatgaggacttcattagagacttaacaagacaac

SEQ ID NO: 70137 - DNA, 297 bp, Zea mays
  Clone ID: LIB3078-055-Q1-K1-B3
ctcgacgcagatttccacgacatggcgagcgaggccttggacgcccacgacaacttgggcatggagatagctatgcgggagttcagggacttgttcgaggggatccagtccatgacctactgctgcggtaacttcggtgatgacaagggtgccagggccattgtcaaagccttcccacacataaaatgcactgtgctggcccctcccaagatcattgccaccaaaccggccgatggagcgatgataaactatgtcgaaggtgacatgttcagtttcattccacctgctcaaactgtc

SEQ ID NO: 70138 - DNA, 450 bp, Zea mays
  Clone ID: LIB3078-055-Q1-K1-B4
acgtacgcgttcgtaacctgatgcacgcacagagcatcctgcccatgtgagcgtgccagcatgtggtaacggactgaggagacggctaccgcagtctgcggaggacagcttcaccaaggacttgacaaggtgtaactcggcggcgccttcgacctgctgggcactagagacgaccgggacactggcggcgagctcaaggtgaaggagctcaagaacggacgtattgccatgttctccatgataggcttcttcacgcaggccatcgtcaccggcaagggccccatctagaacctcttcgaccacgtagccgactcccgtcgccaacaacgcctgggcatacgccacgaacttcgtacccggcaactaactgactgagcaacgccgtacatgtgtactaccatcagatccatccattcgttcgttcgtccgtcgagtgaacagtgtggtctt

SEQ ID NO: 70139 - DNA, 421 bp, Zea mays
  Clone ID: LIB3078-055-Q1-K1-B5
cccacgcgtccgagatgctggtcttattgggctactcagatggacgacaacggttgcgtagaacgatatcagacagttgaaaatggacttcatctttttccccccgtaaggctgatgtttcaccacagttaggattctgcacgatctgttatgatgatcttgatatctgtaccatctcagcatcgatttcttgaaactcctaacggagaagctaacggaatacgaatgggtgtacaggtttcagattttgaattatatgattacggtgtcagggccatggcatattggtatgcatataacgactacatcatagagtaaccagatggtttacatgatctgattaccgcaataagcagagcattacatttgggagcaatgtagatcatgttacctaggactatgaaagttctgtcttgagata

SEQ ID NO: 70140 - DNA, 234 bp, Zea mays
  Clone ID: LIB3078-055-Q1-K1-B6
cccacacgttcgaaatgactatacctttgagctactcagctcgaccaatacggttccgtgtaacaatcatccaagtatgatacagaccatcctaacttacactacaactggcatactgaaacccacatataatatgacatacgatctacaacatataatatacaaacatattcttactacatccagattaagatcgaaacaacaacgctgatcctatcatcttcctataacacc

SEQ ID NO: 70141 - DNA, 343 bp, Zea mays
  Clone ID: LIB3078-055-Q1-K1-B7
tcacgaacatactatcgatttctcggacgcccacgacaacttcggcatcgtgataactatgcgggagttcagggacttgctacacgggatccactccatcacctactgctgcagtaacttctatgattacaaaggatccagggccattgtcaaaacctttccacacataaaatgcactgtgcttgcccctaccaacatcattgccaccaaaccggtcgatggagcgatgataaactatgtcgaatgtgacatgttcagtttcattccacctgctcaaactgtcgtgctaaaacttgtgctgcaccacctgaccgatgaagagtgcgtcaagctcctggctcaa

SEQ ID NO: 70142 - DNA, 440 bp, Zea mays
  Clone ID: LIB3078-055-Q1-K1-B8
ggcgaaacctggtgcacgcacagagcatcctgtccatctgggcgtgccaggtggtggtcaggggcttcgtcgagggctaccgcgtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtccccggcaactaactgactgagcaacgccgtacatgtgtactaccatcagatccatccattcgttcgtccgtccgtctagtgaacagtgtggtcttc

SEQ ID NO: 70143 - DNA, 391 bp, Zea mays
  Clone ID: LIB3078-055-Q1-K1-B9
acgcgtccgcgcacgcgtccgctcacgcgttcggccacacgtccgtgtaggagtgcgaatacgcttagttcaggccgctggcttggttgtatgtgcctttgatcagcagctagaatctggtgaacgagaagtagcttgagaccgacaacggagatctggccgacaggatatggccggacttaaggagccgatcgaagccaagtaacggctcttcgacggaaatgacattggacacaccaattacgatccatacagcacagtctgctcactcagatgagtaatgactagatctacggccacatgctcatcaatgctggcatgatattggagaataatcagacactggtagagctccgagttccagtcggagacgaccgagtaggctgcatta

SEQ ID NO: 70144 - DNA, 318 bp, Zea mays
  Clone ID: LIB3078-055-Q1-K1-C1
ctcactcattcgcccacgcgtacggattcagttttcacttgcctcatacttcgacagggacttgctgactcgcacggaccgcgaggactactcgcagcactggatcaatgacatgaattacagctaccactgtcaactatatatgaacgctaccctgccatcctcctcgtcaactaacccattggagaagctctcaaccatttccttgtccaatgacactctgatcctatgaccctgcataatgaacactacgtttacgactctctactgggcacagatatcaataacggtcgtcttgacctgctcttcattatcaga

SEQ ID NO: 70145 - DNA, 409 bp, Zea mays
  Clone ID: LIB3078-055-Q1-K1-C10
gggagattgactgacagcaagggaaggacggtggacttcaagaacacactcctgatcatgacctcaaatgtagggagcagtgtcatcgagaagggtggaaggaagatcggatttgaccttgactctgatgagaaggacagtagctacagcaggatcaagagcctggtcatcgaggagatgaagcagtatttccgacctgagttcctcaaccgtctcgatgagatgatcgtgttcaggcagcttaccaagctcgaggtcaaggagatagcggacatcatgctccaggaggtctttgacaggctgaaggccaaggacatcaatcttcaagtgaccgagaagttcaaggagcgggtggtggacgaaggctacaaccctagctatggtgcacgcccgctgaggcgagccatca

SEQ ID NO: 70146 - DNA, 445 bp, Zea mays
  Clone ID: LIB3078-055-Q1-K1-C11
cccacgcgtccgcccacgcgtccgcggacgcgtgggtgtttatatctgcctgcgcaattgctcccagcagttgaggagtgcctctttggtccttttcgcatggcttggcaagattacactagagacttatatctctcagatccatatttggcttaggtctagcatgccaaatggacagccaaaatggcttctttgtttcataccagattatcctatgcttaacttcatgcttactacggcgatctatcttcttctatcataccgtgtgtttgagatcacgaatgtcttgaagtcggcttttatccccagtagggataatagccgtctgtaccaaaatttcgttgctgggatcgccatctcagtgtgcctgtatctctgctcacttattcttctgaagattcctgttgtatagggatgaacatacaccaagcaatcttgatagtag

SEQ ID NO: 70147 - DNA, 420 bp, Zea mays
  Clone ID: LIB3078-055-Q1-K1-C12
cccacgcgtccggccgcagccgctgcttttcgttcgtcttcatcctacgcgagggcgaagcccagaaaccctctccctcccgtactccggcctacacatccaggggcgatgacgctgggtagctccggcgccggatcgagcgtcgtcgttccccgaaacttcaggctattagaggagctcgagcgtggagagaagggcattggtgatggaacagtgagctatggaatggatgatgccgatgacatctacatgcggtcatggactggtaccatcattggccctcacaatactgtacatgagggtcgcatctaccagctgaagttgttttgtgacaaggactatccggagaagccaccatctgtcagattccactcaagaatcaacatgacatgcgttaatcacgagacaagaatgggtgat

SEQ ID NO: 70148 - DNA, 432 bp, Zea mays
  Clone ID: LIB3078-055-Q1-K1-A8
gttcgaggagggcacccgcgaccgcccctacggccactgcctcgtcgccggggtggccaagtaccccaagaaggtggtccgcagggactcggccaagaagacggcgaagaagtcgcgcgtcaagtgcttcatcaagctcgtcaacttcacccacctcatgcccacccgctacaccctcgacgtcgacttcaaggacgtggccaccggcgggcccgacgcgctctccacccgcgacaagaaggtcgccgcctgcaaggccgccaaggcgcgcctcgaggagaggttcaagaccggcaagaacaggtggttctttaccaagctccgcttctagatggtcggcgtcccgaatggtgcccgtcggtttcttgtatgggacacactccaagccatgtctcttttcgtattgccatgaatacttcttcgtgtttagtc

SEQ ID NO: 70149 - DNA, 412 bp, Zea mays
  Clone ID: LIB3078-047-Q1-K1-B10
ccactatgggaggcttggagtcaccatgctagcttctactgatgaggtaaaagctgcgtacgagaagatgtgtgaagaactaaatagcaaagaactagaagaagaggagcttaacaaggaacatgagctcctaaaggaatcatttactatactatcaaccgaggaagaacgaagattatatgattggagcttgtcaagaagtggacagcctgagcgatatgtctggccatttgaagttgatccattggagttggcaccagatcctccaaaggaaccagaagatgagttcccaaccaagctcgttggctacttcttactggcgtggttcatactctctgttggcctctcggtggccctcaacaaatgaagattttctccccaaaagaacatgaattgtaatccaataatctct

SEQ ID NO: 70150 - DNA, 397 bp, Zea mays
  Clone ID: LIB3078-047-Q1-K1-B11
gtccacagcaaccagcacacatttccctttggcggatcgaaggaaggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtccgcgaattccatatgcaggacgaggatgtaggccggccatacaagaagttcctgtaagcggcgtccagggctgcaggagacgtcgatccctcgaccggggctgcgaggaggggagtttccattcagtttgtgtcggtattgttttagtctgaatctgatggagcagtttggaatgctgaact

SEQ ID NO: 70151 - DNA, 377 bp, Zea mays
  Clone ID: LIB3078-047-Q1-K1-B12
cctcgtttcgccgcctccgccgactccgactgcctacctcagctgccgtcgccatgggcagaaggcctgctagatgctatcgccagatcaagaacaagccgtaccctaagtccaggtactgccgtggtgtccctgaccccaagatcaggatctacgatgtcgggatgaagaggaagggtgttgatgagttcccctactgtgtgcaccttgtctcttgggagaaggagaatgtctccagtgaggcgctcgaggctgcccgcattgcctgcaacaagtacatgaccaagtctgcaagaaaggatgccttccaccttaaggtccgggttcacccgttccatgtcctccgtatcaacaagatgctttcctgtgccggggct

SEQ ID NO: 70152 - DNA, 311 bp, Zea mays
  Clone ID: LIB3078-047-Q1-K1-B2
gcgggacctactagcgacaaaccgctcttctaaacaaaaacctctcagctaatatggcggaatcttatacatcgatcacaggcctctcccatggcgtcctgccaagaacgctcaccctcagcagaaccagcacagccgtgaccagaagaacgccgcccgcatatggcaacgccagtccccactccggccgacgaaccgctatcggcctcttgctcactgtcataacaagctggaccatgtcctagccctcacgcgccgaaaccgtctagaccatcaagattgaaacactcgtcttcaacgttcgcatgacc

SEQ ID NO: 70153 - DNA, 325 bp, Zea mays
  Clone ID: LIB3078-047-Q1-K1-B5
cgcaatattgggaggctgggagtcaccaggctagcttctactgatgaggtaaaacgggggtcctaaaagatgtgtgaggaactaaatagcaaagaactagaaaaggaggagcttaccagggaacatgagctcctaaaggaatcatttactttcctttcacccgaggaagaccgaagattttatgattggagcttgccagaaatggaacagcctgaccaatatgtctggccatttgaagttgatccattggagttggcacacatacctccaagggacccagaatatgagttcccaaccaagctcgttggctacttcttactggcgt

SEQ ID NO: 70154 - DNA, 89 bp, Zea mays
  Clone ID: LIB3078-047-Q1-K1-B6
ggggctgtacatgagaccaaaggctaacaccttgtccgttcctatcggattacacctggaattgttccagctaaggccttattcggcac

SEQ ID NO: 70155 - DNA, 389 bp, Zea mays
  Clone ID: LIB3078-047-Q1-K1-B7
cccacgcgtccgcggacgcgtgggtgctgaactgaagctggtcggtgagtatgggctgaggtgcaagcgtgagctttggagggtccagtatgcactgagcaggatccgtaatgctgcaaggcacttgctcacccttgacgagaagaacccccgtcgtatctttgagggtgaggcgcttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcagggttggcaggcaaattgtcaacgtcccatcattca

SEQ ID NO: 70156 - DNA, 318 bp, Zea mays
  Clone ID: LIB3078-047-Q1-K1-B8
ggaccgacgagcgacgaagcgcgcacaaagagaagaacctcggagctgagatgggacaagccatggcgtcgatgacaggcctctcgcagggcgtcctgcccagcatgcgcgccgacagcagaaccaggacggccgtcgtcgtcgtcagggcgtccgcggagggcgacgccgttgcgcatgcgggccgccgcgccgtgatcgggcttgtggccactggcatcgtcggcggcgccttgtcgcatgcggcgcgcgccgagaccgtcaagaccatcaagattggagccccgccgccgccctccggtggactccccgggactc

SEQ ID NO: 70157 - DNA, 389 bp, Zea mays
  Clone ID: LIB3078-047-Q1-K1-B9
cccacgcgtacgcggacgcgtgggctgagagagacgaagagagcggaagcgggagagcagcggcgcaaaggaaagggagccatgctcgcgtcgccggcgctcgccggcgcccactccttcgcggcgtccgtgtatggaagcctcctagtcccctcgcctaccgtccccgcgccggcacgtcgcgcggcgctgtccgtcgtcgccaaggtcaaggtggccacgccccaggacgaccgcatcgtccgccacgtccgccttcgcaagaaggtaagtggcaccactgagaggccgaggttgagtgttttccgctcaaacaaacatctgtacgctcaagtcatcgacgacacaaagcaatgtactgtggcttcagcttcaaccatgcacaaatc

SEQ ID NO: 70158 - DNA, 301 bp, Zea mays
  unsure at all n locations
  Clone ID: LIB3078-047-Q1-K1-C1
gtcaaaagcgcggccatgtttgtagctgtagcgtctacatgtcgtcgtcgtcgtggtcggcgtcgatgcgtggcctcgatgganaagctggcgttgctctggtgatatgatgagagcagagcagctcccctgtgtgaagacaataagagggaggagcctactcatcagcctacttccatcttgcttattaggctgctcaaactgagttgtcgttagctcttttttttatttctccttcctttaaagtttgatctcgatcctctgtaaatttaagctgcagaagaaccaaatacatgtctcg

SEQ ID NO: 70159 - DNA, 415 bp, Zea mays
  Clone ID: LIB3078-047-Q1-K1-C11
cgcccgtgcgtccctctcacgcagtgcgtccctctcacatcgcgccgccactccggtcgcgccgccaccttccctctccctctcaccgatccacggcgacgagctactgccgctctgccgctactgccgtctcatacgtacgaagacgagcgagggcagctactgccgctctgcgtacgccgccccgtcatcccaccgacctcacgtgttccgatgcaacgcagctgttcaagaacaggcaaaacagacacctctccaacaccccagatctcctgttcaagaacttgctccaggctagagataaaagcactaaggacgaggtttcagttgtcaaaaagagtccaaaatgaggaagttcccatggcagaggaagctctggcggtaaacattaaccaaaccaatttaatcagttgga

SEQ ID NO: 70160 - DNA, 353 bp, Zea mays
  Clone ID: LIB3078-047-Q1-K1-C12
gtcatgaacgccatcttcagcttcggcaacagctgggcctttgtccacatcgcggcgtacgggcgagggttcgtgcaggcgtctcggagcacgtggagccagttcgaggcgctgccggggatggcggcgctggtggactcggacatcaccagctccgtgtgcttcctgacgggcgtgacgagcggcgcgctgtgcgtggcgctggcggggtcctgggcgttcgcgacgcaccggcactacacggccaccgtgtcgctgctggccttctacgtcgggtacctgatgacccgcatcggcatggcgcttgcccaggcgtgcgtcggctgctactacgtctgctacgccgagaaccc

SEQ ID NO: 70161 - DNA, 425 bp, Zea mays
  Clone ID: LIB3078-047-Q1-K1-C2
accggtaatgcccgggtcggcccaagccgtccggccgttcgcgctcccgccggcgccaacccgcggcggctgctgctgctggaggacacgcgggcccgcgatccgcgcggcggcggcgcgcctcaaggtctccgcctccgccgcctcgtcggacgtgccggacttcctctcgtccaattggcttgaaacccgcaagagaaagcccttcggtcccaggttgaattttagtgcagaagaagcagtcgaataccagcttgagtccttaaagtacaatgatctgccccgcccagattatgggatagaggtcatgtaccggtttgcaagctttgaccccttcgagaggtcaacttactttggacgacagtttgatctatgacagttcgagcgcttccggcgtctgtttcaccactcaacctacagagtgc

SEQ ID NO: 70162 - DNA, 376 bp, Zea mays
  Clone ID: LIB3078-047-Q1-K1-C3
gcccgtaaaacccgggtcggcccaagccttccggttacggcggtcgccccgaaggtggctgttgcggctacggaggcggtggcggctgcgggggtcgtcccgagggtggcggtggctgctacggcggcggtggcggcggcggctggagggactgatgtgtgggcccatcctggcttcggccgagttatcttatctatctatagtatcgtgttaccgttcgcttctgtcaccgtgttagtgtccgttctacctttggattaagtgttggtaccctgttgttcgctttggttgctcccgctatgaaacgagacgagagaagaatgagcaaggtttttgttcgcagctatttttgtccaatgatatttatatattgttc

SEQ ID NO: 70163 - DNA, 363 bp, Zea mays
  Clone ID: LIB3078-047-Q1-K1-C4
gggggcgcaataggcacttttgtggctgacaagcgcttgaggacattgccgacgagtgagatgctaccgaggaatgaagtccttggtggatacatctttgtctgcaacaacgataccatgcatgatgatctcaagaggcagctttttggtttgccagcaagatatcgtgattcagtccgagcaatcactcctggcttgcctcttttcctctataactacacaacccaccagcttcatggggtatttgaggcttgcagttttggtgggtccaatatcgatcctactgcatgggaggataagaagtgtaaaagtgaatctagattcccagcgcaggtgaggatctgcattaggaagctgtgcaag

SEQ ID NO: 70164 - DNA, 434 bp, Zea mays
  unsure at all n locations
  Clone ID: LIB3078-047-Q1-K1-C5
ttcttcctttttgttccttcccttttttataacccncccgggcttaacccggagccagtcgtctggctagggtggggccgccgccgccatgcctggccgcatctcaggaaggtctgccccacgcccagctccccgtgctgcttcactgaggaacccgccacatccagcacgccaggctcctcctccagctcctgttcgagatggtggtggctccatgtttggaggaattgggtccaccattgctcaaggtatggcgtttggcacgggtagtgccatggcacacagggctgttgactctgtattaggtccccggaccatccagcatgagactcttgccacagaagctcctgctgctgcccctgctgctccagcgatgaatgctgatgctngcagcttccattctaaggctttccaagattgtctcaacaactatg

SEQ ID NO: 70165 - DNA, 401 bp, Zea mays
  Clone ID: LIB3078-047-Q1-K1-C6
agccttcccccaagccttccgttcgttgcagtggccttaacgaacaagagcctagtctctcggcgcgcgacgctacgggtctgctcgtcgaggcgctcgatccgtagcctggtcgttaaggctgcaactgtcgtcaccccaaagtacacttcactgaagcctctgggagatagggtgcttgtgaaagctggtgccgcagaggagaagacagttggtggcattttgcttccatctacttgccaaactaaaccacaaagaagggaaggtgttgctggtggaacaagaaagaccattctggacaagaaaatagctgtggatatagagactggagcacaagtagtatactcaaagtatgctgggactgaggttgaattcaatgactcaaagcatcttattctcaa

SEQ ID NO: 70166 - DNA, 384 bp, Zea mays
  Clone ID: LIB3078-047-Q1-K1-A9
cggacgcgtgggtgctgacaagcacactgacttggctgaaaaatatggtgtgtctggtttccctacattgaagttcttccctaagggaaacaaagccggtgaagattatgatggtggccgggacttggatgactttgtcaagttcattaatgagaagtgtggcaccagccgggatccaaagggccacctgaatcaagaggctgggcttgtgccaagcttgaatcctcttgtgaaggagtttctcaatgctgctgatgacaagcggaaggaagtcctctctaaaatagaagaggatgttgctaagctcagcggttctgcagccaagcatggaaagatatatgtgacagctgcaaagaagatcatagacaagggctctgactacac

SEQ ID NO: 70167 - DNA, 407 bp, Zea mays
  Clone ID: LIB3078-046-Q1-K1-H2
tccacgcgtccgcaggggcctgatcagagaggttgctgggtttgctccttatgagaagcgtatgactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaagaagaaatagagagcatttcaagttcatggagcctgccagagattatgttccagtgtctgattttccatacatgtagaacctaatagacatgtcaaagtattatgtatcgaaccagctcatgggattttgctccttacaatgcatccagggtttatgtatcgaaccagtttatgggatcttgctcctattccaatgc

SEQ ID NO: 70168 - DNA, 312 bp, Zea mays
  Clone ID: LIB3078-046-Q1-K1-H3
tcctcctggttgacatatatagtactaggatcattatttactgtacagacaacaatcacccaaagggatgaattctataaccatacgaatgcaagcattcagctacacacttacctcaaggcacctgtctcctacactcatcacaatcccaactcttacgcaccaccattccacagccaccactaacctgctaacttttccgcgacatctaacaacaatcatgcatctgtccggctcgaacacgaacacgaacttgaaacctgacagcaccacttaaccctacagaacagctatcacctccgtcatctacaa

SEQ ID NO: 70169 - DNA, 386 bp, Zea mays
  Clone ID: LIB3078-046-Q1-K1-H4
gcttcggcaagaccgagaaggagatgaatgagctcaagctcaaggagatcaagaacggcgggcgcgccatgctcgccatcctcggttacttcatccaggggctcgtcaccggcgtcggcccgttccagaacctgctcgaccacctcgccgaccccgtcaacaacaacgtgctcaccagcctcaagttccactagaacgtggtgcatcagcatacctgctgctgccgccgccgccgccagttgtttgctgtggaaagctagatgcatgcgtgttgtaaaggaacctgaagcgttgcatcggtcatgattcatgcatggccagcctgctgcctgtaacaacaaactagtattgatcttattgagaccggaaactgtattgcacatggt

SEQ ID NO: 70170 - DNA, 435 bp, Zea mays
  Clone ID: LIB3078-046-Q1-K1-H5
gggtacgtgaccaagtgctccggcgagggcatctacttcgcggcgaagagcggacggatgtgcgcctaggccatcgtggcgggctccgccaacgggacgcggatggtggaggagagcgacctgcgcaagtacctggccgagttcgaccgcctctactggcccacttacaaggtgctggacatcctgcagaaggtgttctaccgctccaacgcggcgcgcgaggccttcgtggagatgtgcgccgacgactacgtgcagaagatgaccttcgacagctacctctacaagcgcgtcgtgccgggcaacccgctcgacgacatcaagctcgacgtcaacaccatcggcagcctcgtcagggccaccgcactgcgcctggagatggagaaggtcaccttgtgagccgacgaccgcgacgtcattgccgtcgaaatggtg

SEQ ID NO: 70171 - DNA, 344 bp, Zea mays
  Clone ID: LIB3078-046-Q1-K1-H6
atgcgtccacgcgtacgcaggggcctgatcagagtggttgctgggtttgctccttatgagaagcgtgtggctgatcttctgaaggtgggcaaggacaagcgtgccctgaagcttgctaagagaaagcttggaactcacaagagggcaaagaagaagagagaggagatggcaggcgttctcaggaagatgaggtccgctggtacgcacacttacaagaacaaatagagagcatttcaagttcatggagcctgccagagattatgttccagtgtctgattttacatacatgtagaacctaatatacatgtcaaagtcttatgtatccaaccagctcatgggatttt

SEQ ID NO: 70172 - DNA, 458 bp, Zea mays
  Clone ID: LIB3078-046-Q1-K1-H7
gaaaaagataaagagaaggaggatcataaagataagaaagacaaggatcacaaagagaagagagaaaagaataaagagaaggaaggcagccagctacacaaggagctcaaggcgggtgtcgccgacatggtgcacacgctcagctcttcggcaccgtcatccgggggcggccacgagcgtgctggctctgcggcggcgggaacaacaatcatcacgctggccggcgagaacaagggcacgtccatgaaggtagacagcagcgccgtagcctacggcacggcggacgcggcgggcagcaaggagcgccgcggccacaagctcgacggcagcgtcatcgtgagcgggaaggagcaagctggggccggcaaagggctgacagctttcgtcaacagcaacgtgcaggtcatcaacaactcgctgctgctgcagagctcctgccacggcggcgacctgggggt

SEQ ID NO: 70173 - DNA, 293 bp, Zea mays
  Clone ID: LIB3078-046-Q1-K1-H9
cccactcgtccgcccactcgttcggactacttcgtgcaatggtcgactgcaaaagcgcgggtgcagagctacaatgatgaacagtgcgcgcagagtcagagccacctgtcagaggcgcaccggacactgaacagtgcctgtccggtgcggcaccggactgtcaggtgtcactagaagacaaagcctccaacggtcagaagctcccgaaccctaacggttgggtgatgtggctggcgcaccggactgtccggtgcgcccatcgacagcagcctgccccaacggtcctttggtgg

SEQ ID NO: 70174 - DNA, 316 bp, Zea mays
  Clone ID: LIB3078-047-Q1-K1-A1
cgcacgcgtccgcccacgcgtccgattgccagcaacccatccatactttcagctgtggatgcaaaaagagaagagagaatggcggagccaaacccagagttgagtggtcttattactcaaacaaagaagaaaaatatagtgccaaagttcaccgaaatcttccccgtggaggacacggcctacccttacagcgccttcatcacctccgtccggaaagaagtgatcaaatactgcaccaaccatacaggcatcgtccagcccgtgctgccgctggagaagaatgtccccgagctctggttctacaccgagctcaaaa

SEQ ID NO: 70175 - DNA, 407 bp, Zea mays
  unsure at all n locations
  Clone ID: LIB3078-047-Q1-K1-A10
cccacgcgtccggtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaatggcgccgccaaggccgatgccaagctggcggtgaagagcaagggggcggagaagcccgccaagggcaggaaaggggaaggccggcaaggaccccaacaagcctaagagggctcccagcgctttcttcgtgttcatggaggaatntcgcagggaagtcaaggagaagaaacctaagacaagtctgtcgctgcggtggggaaaagctgctggcgacagg

SEQ ID NO: 70176 - DNA, 352 bp, Zea mays
  Clone ID: LIB3078-047-Q1-K1-A11
ctcggacgctccctccgggtcggccggctccgacgacgccgcgcccacgggcgccgccggcgccagggccgtcggctggagcttctctggcctcgccgccgtccttggctgcctgttgtgagagtgagaccgtgcgtcatttctagggacggaggacggacggacgacaagctagttgaagatgagaatgccatgccatgcccgggcatgggcgccctctttcatctttgcctgagattgtagtgggcgtgtcccttcccgtcttctctcggctgttatttaaactcttcatctgctagttcttatttgactatggggttgtagatggctatggatcattatgcctgcgtgt

SEQ ID NO: 70177 - DNA, 200 bp, Zea mays
  Clone ID: LIB3078-047-Q1-K1-A12
cccacgcgtccggcttttagcatggcgtctctggcgttcggcagcaccgtagcgggggccgtggcggcgacctcagggaggactcggccggcgcgccggtccgtgctggtcgtgccgcccgctgccagcatgggcggcccggcgccggccaaggaggagaagggcctccgcgagaccatcttcggcttcatcttcaaaaa

SEQ ID NO: 70178 - DNA, 305 bp, Zea mays
  Clone ID: LIB3078-047-Q1-K1-A3
atccgccatggctaccgctacgctactgagtctcctccttcgccatgcccgccgcgcggcggggggccttctccccttcctgcgcctcattgagcttcgccacgtcgcagctagccggcctctccctctccgccggcgttgcaactgctacctccgtggccctccttcccaagaggcagctgctccagcccattgtcgcgcggcgtgtgtgcccgttcacggacaagaagacgaaccgggcgaacaaggtgtcgttttccaaccacaagacgaagaagcagcagttcgtgaacctgcagttcaag

SEQ ID NO: 70179 - DNA, 410 bp, Zea mays
  Clone ID: LIB3078-047-Q1-K1-A4
cccacgcgtccgcccacgcgtccgcggactcgtggggaggccgggccgggcgccggcggggggcggttggaggacccctaccggacgctgcgtctgcgccggggggccacccgcggcgaggtcaagaaggccttccgccgcctcgcgctcatgtaccatccggacgttcgcaaggagagggagagggagatggaatgcgacggcgacagcggcgtccaattccagaagattaacgtggcgtatcagaggctgatgagcagcatgagggaggccgacgagcggctggagtactggcgcctcaagtacggcctcgccggacgaggatctggacaggtacaggcgccgcctcaacgaggaagacgccgacgactggttcgacatgtgaagaggaagcgaatgaactgaaagca

SEQ ID NO: 70180 - DNA, 451 bp, Zea mays
  unsure at all n locations
  Clone ID: LIB3078-047-Q1-K1-A5
cggttcgtaattaccggggcggaccaagccttccggaaggctttggaagaggcagaagctttgataaagctggcgcgacgtccggagccagctggagacccttctaaatatactgccgctgatgtttggattaccgatcaaaagttgcgcctctgtgatatatgtggagcatntctgagtgtatatgacaatgatcgacgtctngctgaccattttggaaggaaactgcatctaagctacatgctgattcgtgacaaacagaaagaacttcaggagcagatgaacaaaatgaggacaggcataactgaagatgataggcgatctagagagcagagcaaggatcgtaacgggccgccgtccaaggatagagattcagaaaggagagacagggttgagtctcgagatggaagaagagattatgatagggaacgcgataggcgtcacgataggg

SEQ ID NO: 70181 - DNA, 448 bp, Zea mays
  Clone ID: LIB3078-047-Q1-K1-A6
cggtccggtaagaccggggcgggccaagccttccggcccgctgtccctcctcctttgccgccgttgccgtcactgcctatgatcatgcatggtgggtcaaggaaatcgccgcaaccgatcctccagagcatctcaactctctcctcaatgtgcttcaagcacgaggtgaaaagattgtttctcctggagcaaaaagagggttgattccatgtgttgttcccttatcagaaagtccagcaggtgatttgacatctctccttagatggccaaccgctccaactgggatggaaatgcctgttgtggaagttcgtaaacatgggctgtggtttttggctaagaatgtgaaacagtatatccacagaatacttgttgaggctgacttaactggtgatgatttatgggctgctgtgggcgaagctggtaaaaacctttacgctaaaggagaatt

SEQ ID NO: 70182 - DNA, 377 bp, Zea mays
  unsure at all n locations
  Clone ID: LIB3078-047-Q1-K1-A7
cgacccacgcgtncgggccctgcgcctcctcctctgccttttctgccgtcactgcctatgatcatgcatgctttgttaaagaaatcgccgcaacccatcctccagagcatctcaactctctcctcaatgtgcttcaagcacaaggtgaaaagattgtttctcctggagcaaaaagagggttgattccatgtgttgatcccttatcagaaagcccagcacgtgattagacatctctacttagatggccaaccgctccaactgggatggaaatgcctgctgtggaaataaataaacacgggctgtggtttttggctaagaatgtgaaacagcttatccacataatactctgctatgcttacttaaccggtgatgattta

SEQ ID NO: 70183 - DNA, 350 bp, Zea mays
  Clone ID: LIB3078-047-Q1-K1-A8
cggacgcgtggggccagtaaatctgtagccgacacgaatacgacaccttcagaggaggcagctgctactcctagcgcggtgaacggggctcaggcctctctagagaacctcttgagtagagccaaagtgatcagtgcggatttctcgtgggagaagttcagcacacagtttgccgacgtgacgacccctctaacctcatcactagagaaggaacccaacatggcacagatagccactgtgcgaggccaggaaaaagcgaagaagctggcaccgcggattgctgttgtgaagccagcagcgcataaagcgaagcagccggatcccaaaccagaagtgagagcactgtttgg

SEQ ID NO: 70184 - DNA, 365 bp, Zea mays
  Clone ID: LIB3078-046-Q1-K1-H11
catactcttctcgcgcaaggacacgtgcccggagtgcgactgcgccgggttcatccggggggcgggcgcgacgctgcgggcgaacgcggcgaggaaggacgaggcccagatcgtctgccctaactgcaacggcctcggcaagctcggacagatcgacaagtagctaaataatcccaagctcatatacatgtgcatatatgcatggaccaaccaaactgctcctttgtataagctctaaattaaatctcgtctccaacagtgtctgaatgtatatgctgagtgagggttaattgggccggaaatatacccggtggcttggcaaaaaccgatgtggggcattaccatggtggccgtgggggtggtgg

SEQ ID NO: 70185 - DNA, 114 bp, Zea mays
  Clone ID: LIB3078-046-Q1-K1-F8
ctgactcgtggggttacagggaaactccttatgttaacgagaccagtggaggtcacggtgttcatcgataacgaaggcatgacatatcacacagctcatttctggacagccttt

SEQ ID NO: 70186 - DNA, 450 bp, Zea mays
  Clone ID: LIB3078-046-Q1-K1-F9
tccacgcgtgcgcccacgcgttcgcccacgcgtgcggaccatgcaagtggagacaactggaaagaatgaagcactaacagccaagatgcaggaacacacagacctacagcatgagaaagatgagttggaacaacagttgctggaagtgaggaaggaactggatggtgcctaccacaccatagcaaatcaggaagaacaggcttctgtgagggagataaagtgggacgcttttaggaagtactcggaggatcgtctggaagctgagcagcagcgtgctgaggagctggaactacaagtagcagctcttaaacaacagctccaagaagctgagatccattataagcaaaaggaagaacatgtttctctaagggaggttcaatgggaagcggatcaaaatcattccctggatgagcttaacgctcagcgtcagtatgccacggacttggagaa

SEQ ID NO: 70187 - DNA, 444 bp, Zea mays
  unsure at all n locations
  Clone ID: LIB3078-046-Q1-K1-G1
cggacgcgtgggcggacgcgtggggtggcggcgcgcgcggagctgagcccgtcgctggtgatcagcctgagcacgggcgtgtcgctcttcctgggccgcttcgtcttcttcaacttccagcgggagaacgtggcgaagcaggtgcccgagcagaacggcaagacgcacttcgacgccggcgacgagcgcgccaaggagttctcgggcctgctcaagtccaacgaccccgtgggcttcaacctcgtcgacgtcctcgcctggggctcgctcggccacatcgtcgcctactacatcctcgccacctccagcaacggatacgaccccaacttcttctgagcggccggctgcgggcatgttcttgagcctgnctgtattctactncgtgtgtgtngagccatatatctgatgctcaaggattggttaatttgaacaagtggtgcaact

SEQ ID NO: 70188 - DNA, 422 bp, Zea mays
  Clone ID: LIB3078-046-Q1-K1-G10
cccacgcgtccgacctggggttcctgacttaggctaggaagtacaccttctgcaagcccaagttcatcttctacgccacctacctgtccgagaagatcgggtactggaggtacatcaccatcttcaggcacctcaaggcgaacccggagtaccaggtgtaccccatcttcaagtatttcgagaactggtgccaggacgagaacaggcacggcgacttcttctctgccctgctcaaggctcagccgcagttcctcaatgactggaaggccaagctctggtcacggttcttctgcctgtcggtgtatgtgaccatgtacctgaatgactgccaacgcactgcattctatgagggaattggtctggacaccaaagaattcgacatgcatgtgatcattgagaccaaccgtacaacggcgaggatc

SEQ ID NO: 70189 - DNA, 167 bp, Zea mays
  Clone ID: LIB3078-046-Q1-K1-G11
gacccactcgtccgcccacgcgtccgcatgtgaatcgcactgttagttaatgcttggtgctgtcagtcttgttgggagtctgactcgtaaagctcattatcatcggaagtgtttgtcggaggagtgctggcactaactatttatcttcagttggttgtcgtgttgcc

SEQ ID NO: 70190 - DNA, 455 bp, Zea mays
  Clone ID: LIB3078-046-Q1-K1-G12
cccacgcgtccggttattgggaagatattggtacaattgaggcattttatagtgcaaacttgggaataaccaagaagccaataccagatttcagcttctatgaccgttctgctccaatctatacacaacctcgacatctgccaccttcaaaggttcttgatgctgatgtgacagacagtgttattggtgagggatgtgttattaaaaactgcaagatacaccattctgtagttggactccgttcttgcatatctgaaggtgctatcatagaggacactttactaatgggtgcggactactatgagactgaagctgacaagaaactccttgccgaaaatggtggcattcccattggtattgggaagaattcacacatcagaaaagcaatcattgacaagaatgctcgaatgggagataatgtgaagatactcaacgctgacaatgttcaagaagct

SEQ ID NO: 70191 - DNA, 459 bp, Zea mays
  Clone ID: LIB3078-046-Q1-K1-G2
gtgatacatgtccgcatgaaacgtcatgcaatgagtgagatgccaaaatcagatgatgacgggtcaaaatggtgtaaagacatttttgtggcaaaggatgccttactggacaaacatttggcaacaggcactttcgatgaggagattagacctatcggccgcccagtgaaatcattgctggtgaccctgttttggtcgtgcctgctgttgtttggtgccatcgagttcttcaagtggacgcagctcctatcgacatggagaggagtggcattcactgccgcagggatggcgctcgtgacaggggtcatgcacgtcttcatcatgttctcccaggctgagcggtcgagctcagccaaggcggcacggaaccgggtcaagaaggaatgaaaacggatggtggagatgtgattctgggctctatttatggctagctttcaaaatgactcgattcatattaat

SEQ ID NO: 70192 - DNA, 383 bp, Zea mays
  Clone ID: LIB3078-046-Q1-K1-G3
cacgcacacgctcaccctcatcacaacatggtggaatgcccccggctaccatgtctatgcgcggaccgtctccaccaccatctggttaaacacacgcaaaggaaagtaccgtgtggtcaatgtgcaagctgtaactgtagaccaaggatgctggttcctttcatatatctccctgtaacttgtccacgctaggtgaagatgaaattttggagttcacctgacagatacaaacgcgagattaacatgtatttttcttctgttgaagatcaatgtatttttgcggttgcgtacccattttttgtgttccctaatgccccgatacgtttacaacgatcactatgcacatgttctggtgccactgaactattgaaggtggatatttc

SEQ ID NO: 70193 - DNA, 446 bp, Zea mays
  unsure at all n locations
  Clone ID: LIB3078-046-Q1-K1-G4
gctgcgctgtgtcccttccatacacgacgaggaccaccatcggcgccccttccttggcgggatggacagcatctgcgccgtgttctctagaggcagtcacggccgtggatccctactacccccactgccaccccgaggacgcttccaagcagctgaccttcactgagttctttgacaacgctcctcagcgcttctattttgcgcggacgagactcaatgcttcctcctccgtgccgccactactccgcccgttccctagcgacgatagcgggttagggtttctgtacctggagccaccacctnctctgtcgtgtcctctgccgcctccaccttatggttggtgctcaggccttcgggacttctgtcggcatcgcgcacccaccagcatgtcaatgactctgtctacatgtcaacatggtctaattcgtgaggcangtgtgtggatc

SEQ ID NO: 70194 - DNA, 456 bp, Zea mays
  Clone ID: LIB3078-046-Q1-K1-G5
ggccgaactatgaagatatattgaactcgtttgagagatggagacgcaaagagcccgtcggtgatagtgcacccaataaggttaagctgatgtgctcctactgcaaacatcatactgagtctgaagttccagatccttattatggaggccctcagggatttgaaaaggtgctggacttattggaagatgcttgcgagtcgctgcttgatagtatcgtcgcatacaatgcaagcatttctgggtgacatcgatgtaaatctccacatacagacatctattttcagacgcaccgaaggctgtagcatccatgcacaacccgagtaattcggtttctaatgcaacattgatcatgtcgtcattacccaggtcttggtctggcatgcatataccaccatccttatacctggttatgtgataagtcataagtgacgaaaaaactggttatcatcacttttt

SEQ ID NO: 70195 - DNA, 393 bp, Zea mays
  Clone ID: LIB3078-046-Q1-K1-G6
ccgggtcgtcgaacgcgtcctgcgatgcaattgctaatcaggggaaatgcgtttctgatgaaatcatcatcaatctattgtgcggaaggcttaagaaaggacatgaccagggagaatgatgatttattcttgatggatttccccgcacagtctaacaagcagaaattcttgatggtgttacagacattgatatggtggttaatctgaatctaatagaagatgctatagtagagaagtgccttggcagaatgatatgcggcctatgtggtatgaactttaatatgacctgcattgacgttcagggtgataatggactgccaccaatttacatcgcgtcattgtaggctccaaacaactgcatgtgcaagcttattacccgagctgatgataccg

SEQ ID NO: 70196 - DNA, 373 bp, Zea mays
  Clone ID: LIB3078-046-Q1-K1-G7
gccacgcgtccgcccactcgtacgctctcgcgtgcggctgggcgaccaccgagaccagggcgggcattatcgcacttgctgaggatacactgacgaaccttgggtgtgctactgcgccagtgctagctctgacatgtactcctcattcactgaccaagtcattgtccaacttggactgtggaaggagtagagctctgacaagtatgagacgaacgtgtatgtactcccaatgcacattgatgagaatgacgctgctcttcaattgggcaagcttgatgccattctgaccaacctcaccaagtctcatgacgactacatcagcgtgcctatcgagggtacctacaagctctgcccactaccgagactaggcaca

SEQ ID NO: 70197 - DNA, 343 bp, Zea mays
  Clone ID: LIB3078-046-Q1-K1-G8
gacaatatacatggagactcatcagcttgttctccagatcgcttggctcaaggatatggttgaatgctatccattcctgaagcatgggctggtgctgcgcaacccttacatcaccacccttaacgtcttacaggcctacactctaaaacggataagggacctcaactttaatgtgacacttcagccgcctttgttcacggacttacccgactagatcgagcgcatctgactgctcaagctgcacccagcgatgcttgtcacgatcgcactgtaagacactctcatactcaccatgacaggtattgtcttctgcatgcagaacacttcataggatgcttcttct

SEQ ID NO: 70198 - DNA, 309 bp, Zea mays
  Clone ID: LIB3078-046-Q1-K1-G9
gcgacgcctgcgttgactcgttagccggatgctacctgtggcacctagcacgagcctgcagagacatcatacacactaccatgagcaagcgactacatagtacgcatgtcaacctgcatggcgagtacgaacatccgaggacacgcgttgaatgtagacgcccagtcacttgcgcttgtaaatatggctaggctcgtacatacgtagctagcggaaccagggtactcagaagatgacacgcactgaacctagcccagctatgtgaactggcacacgcacatcgcgactcgagcttgaacacgacaacga

SEQ ID NO: 70199 - DNA, 454 bp, Zea mays
  Clone ID: LIB3078-046-Q1-K1-H1
tttggttgacaggtattgtcctggattctggagacggtgtcagccacactgtcccaatcgatgaaggctatgccctcccgcatgccattcttcgtctcgatcttgctggtagggacctcactgattccctcatgaagatcctgactgagaggggttactctttcacaaccactgctgagcgggaaattgtccgtgacatcaaggaaaagcttgcatatgtcgcgctcgactacgaacaagaactcgagaccgccaagagcagctcatcagttgagaagagctatgaactgcctgatggacaagtgatcacaataggcgcagagcgcttcagatgcccggaggttctcttccagccatccttcattggtatggaagctccaggaatccacgagacgacctacaactccatcatgaagtgtgacgttgatatcaggaaggacctgtatggcaacat

SEQ ID NO: 70200 - DNA, 352 bp, Zea mays
  Clone ID: LIB3078-046-Q1-K1-H10
cggacgcgtgggcggtgttcccgggcgaggcgtgcgatgaccttggcggcgggttctgggaggcgccgtaccaggacggcgtctccaaggagctggcgcacgcctgaagaccctgatccatccatttctgtccaccacgctatgtacgtatgtgtagcagatggtttacatctacgtgttagagcccggagagctggagaagctagctagcgtgcttacagaataacagcagccaagcaaagccaagggtgtgtatataataggcatgccttgggttgtgtcagctgcgactgtatgtatagtttaaaccaagatgaaatggtactgatggtgatattccgtgttttacgat

SEQ ID NO: 70201 - DNA, 449 bp, Zea mays
  Clone ID: LIB3078-046-Q1-K1-F7
gctcggaatacgacgcgaggggtgcacttactcgcggagctgatcccatgcttactgatgggcctgaacacagtcatgcagatcttactgcaccgtttcgcattcttgaactccaaacatacgaacatggcgaagcaagtgcccaagcacaactggaagactcacttacacgccagcaactagcgcgccaaggagttctagggcctgctaaagtacaacgaccccgagggcttcaacctcgtcgacgtcctcgactggggctcgctcggccacatcgtcgcctactacatgctcgccacctgcagcaacggatacgaccccaacttcttctgagcggccggctgcgggcatgttcttgagcctgcctgtattctactccgtgtgtgttgagccatatatctgatgctcaaagattggttaatttgaacaagtggtgcaactgcacgtgt

SEQ ID NO: 70202 - DNA, 420 bp, Zea mays
  Clone ID: LIB3078-048-Q1-K1-D3
cggacgcgtgggcggacgcgtgggcggacgcgtggggtcgagggctaccgcatcgggggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgagggaggcgccgtcggtgacctttaggtgtccggatgcatgtgagcgcacgctggttttcggtttgtaccatgatgtaaactatggttcaatcgaca

SEQ ID NO: 70203 - DNA, 403 bp, Zea mays
  Clone ID: LIB3078-048-Q1-K1-D4
ccaagatcttcattggcgggctctccaaggatacaagcatgagtacattcaaagaacgttttgggaagtatggggatataattgatgctgtcataatgaaggaccgctacacacaaaagcccagaggctttggctttattacttttgctgatcccactgttgttgacagagtgattgaggatgaacatgttatcaatggaaaaccggttgaaattaagagaacgatccctaagggagctgctcctttgaaagatttcaagacgaagaagatttttgttggtggattaccctcagctctaaaagaagatgaattcaaggaattcttttccaagtttgggaaggttgtggagcatgaaatcatccgtgaccatgcaaccaaccggtcacgtggatttggtttata

SEQ ID NO: 70204 - DNA, 381 bp, Zea mays
  Clone ID: LIB3078-048-Q1-K1-D5
aacagcttttggatgccatgtgtgactgcctaaagcccattctgtacacagaagggggctgcgttattcgcgaaggagatccggtgaacgagatgctctttgtcatgaggggaaacctaatgagcgtgacgacgaatggtggaagaaccggcttctttaactccgatgttctgaaggccggagatttctgcggcgaagagctcctcacctgggctcttgaccccacgtcaacatccagcctccccagctcaacaaggacggtgaagacgatgtctgaagtggaagcctttgccttgagggctgaagacttgaagttcgtggccacccagttccgacgactccacagcaaacagcttcagcacactttcaggttctactcgc

SEQ ID NO: 70205 - DNA, 352 bp, Zea mays
  Clone ID: LIB3078-048-Q1-K1-D7
gataccattgcgataaaacctaggcctgagctcatagcataatccacacacgcaggggctatgttgttcgttgggacgcacgagtacctgacccgcaagatcattataggcgaagtccatggaacctcattccactggtggaccttaccggcatacttgtaccagctgctgttcgggaagacgcctttcaagggatccagcaaccgagccacgctgatcaatgtcattggccatcagctgctcttacctgattaaccgggcgtcagattctatgcgacggatctgatcactggtatgcttgtgaaggatccccaacaacggttggcctacaagccatgatccacatggatca

SEQ ID NO: 70206 - DNA, 399 bp, Zea mays
  Clone ID: LIB3078-048-Q1-K1-D8
aaagcaaggaaaggattcattttggtacccctacattaaggaacttgaccgacatcgaggaagggggcagctagctgttgaatcaccacttctatggactgaaagtgaactggactaccttagtggaagccccttgaaggatgaagttgttgctagagatgaggcaataaggagagagtataatgagcttgacacattgtggtttatggcaggttcactatttcagcaatatccttttgacatacctactgaggcttttccgtttgaaatattcaagcaggcttttgttgcagtacagtcttgtgttgttcatttgcagaaagttagtcttgctcgaaggttcgcactagttcccttggggccgccactattgacttacaagagcaacttgcaagcgat

SEQ ID NO: 70207 - DNA, 399 bp, Zea mays
  Clone ID: LIB3078-048-Q1-K1-D9
cgcactctttcgtggacgcgtgggcttcttcagatcgatcccattgatcgatgtggggctgcttgtcgaaaagattgatgatccaagcatggccaactataaggatttactgcatgttgtccggttactggatgatgcttgcaaggaggcctgattcttctatgtgaaaggccatggtattgatgagtcactgatgagggaagtcaggaatgtaacccgagaattctttcaccttacttatgaggaaaaattgacaattaagatgacacctcaaagcggatatagagggtatcaatggataggggaaaatattaccaagggtaagcctgatatgcatgaatcaatcgattgttatactcctattacacctggcacatatggagatcttgctaaaccaat

SEQ ID NO: 70208 - DNA, 411 bp, Zea mays
  Clone ID: LIB3078-048-Q1-K1-E1
caaatttccggcggcgatggcggcggctgtggcgaggtcagggttccggcgcatgtgctgcgtctctgccttcgcgccgccgaaggcgcccgccgcgcgccccaaggccgacccatcccccaacctcttcgtctccggcttaagcaagcgtaccacaagtgaaggacttagagaagcctttgcggagtttggtgaagttttgcatgctcgagttgtgaccgatcgtgtcagtgggttttctaagggatttggctttgtaaggtatgctacgaccgaagaggcagccaagggaatagagggaaaggatggaaagttccttgatggatgggttatttttgcggaatacgctaaacccagaccaccaccggagggaacagggatgaattcgcagccccagcagtcatggggagc

SEQ ID NO: 70209 - DNA, 388 bp, Zea mays
  Clone ID: LIB3078-048-Q1-K1-E10
ggctatctatctagcgagagagagagaggaaagctagctagctagcatggattgcgggaacaagaaggcagcaagcggtgtgtcggcgctgctgattgtgcagctgctgttagctacgacgactgcgactgaccgtctactgcaggctgatacctgcaccgtgattggcctgcacatcatcgcgagggagtttggccatgcagtgagaggcatcctgtcgggtgaaacctgtgtcttcctaccatgctatacggcagccatggatcgccaatgcattggccaaatcttgatgatgtgatatctgaactagcgctatttgtaatctgtgatgggagaaacacaatgactgtactgtggtgttcaactcattgcatgtgcatcgtgatct

SEQ ID NO: 70210 - DNA, 403 bp, Zea mays
  Clone ID: LIB3078-048-Q1-K1-E12
agaataccagaatcgaatactttcttatggtattgctggagctgtggtctttgggggtgtgatgatcatcttaggaacagctagcatccagaaatttgaggcggtgaacttgctgttggctgtgatcctgttattcacttcttacaagctatttgctgaagaagaacaagaatctgatctatccgataacttcattgtgaaaacatgccaaaagttcattccagtcactgaatattatgacgactatcggtttttcacatatcaagacggtttatggaaagctacaccattgctcttgactttggcagtgattgagctaagtgatattgcttttgctattgactcaataccagcagtttccggcgttacaagggatccacttattatactatcatcaaatatt

SEQ ID NO: 70211 - DNA, 215 bp, Zea mays
  Clone ID: LIB3078-048-Q1-K1-E2
tgtcagttcagcggcggttgaactggctctgatgaagcttccgaagtctgaagcactgtcagctaggatgcttctgattggtgctggtaaaatgggaaagctagtgatcaaacatctggttgccaaaaggtgcaagaagggtggtgtggtgaaccgcttcgtggaaagggtggatgctattcgtgaggagatgaaagatattgagatcgtgtaca

SEQ ID NO: 70212 - DNA, 216 bp, Zea mays
  Clone ID: LIB3078-048-Q1-K1-E4
gccacgcgtgtgcgtacgcgtgcgactaggcgtccggtcagcgtgattgccaacgagggcaatccctacgagcccatgatcaacaacgcatgctgcacgaccaactgcatcgcgccattcgtcaaggtgcatagaccagacgttcagcatcatcaacggcaccatgaccagccagtactcctacaccagcgacgagaggctgatggacgcgagcca

SEQ ID NO: 70213 - DNA, 318 bp, Zea mays
  Clone ID: LIB3078-048-Q1-K1-E5
cccacgcgtccgggaaggcggtgacgaggaggatgatgatgaggaggtggatgggggggagaatgaggcggcaggggttgtggagatctccgacgaagacgacgacgacggtgacggggaggcggacgacgacgactacgatgacggggatgacgacgacgacgacgacgaggactcagacgacgaggaagaggtcgacggtgaagacgatcaggaggaggagctgggaaccgagtatctggttcagcctcttgggcgggctgaagacgaagagcactcgagcgactttgaaccggaagaaaacggtgagggtgccga

SEQ ID NO: 70214 - DNA, 386 bp, Zea mays
  Clone ID: LIB3078-048-Q1-K1-E6
ctcctggagagctcctcctcccggatgccatccccgtgacgctcccagccgccgggtgcgacgccatccccacgagcgccttctccgacgccgtctccgctccgccgcattctccgacgccgtctccgctccgccgtcttctccgacgtcgtcaccttcccctcgacaaggttgcttagaagcagtgtgcagtgatgcgaggcatggatgcgagagtgcaaagtggaagcaacacatgaagtcgacatggagaaggaaaatgcaatgacagtccacatgaaacttgtgaaaaaagaattaaatcccaaagttcctaatgaagagacttgtattacaggtttatgttatatcgtctatctatctgtgtgaatggagatgaccttgct

SEQ ID NO: 70215 - DNA, 411 bp, Zea mays
  unsure at all n locations
  Clone ID: LIB3078-048-Q1-K1-E7
cgaattctttgcgtcgcacgcgtagcgttttgttattcctgcgcgtgctgccgcagagctccatgttcagttcgcctccgtcgcgttgtcgtgcgcgcgaaactgtttgcagtcgatatcaagtccgtgacacgcgcgccggacacggtaaagcgttgcgtgggcttgtatccgagtccgcccgaccgtgacctcgctttgcttctcgtgtcgctactcgccaagtcctttccccagtccgcgccataaaattcactcggacacgatctcgtcgtcgttccgtgcgtcatcaagaaatcccgagaatcgggtgaagacgaagctagcagcatggtatttaccaagtgctcgacacangagctaaaccagaatccttgccgtgttcacggatagcgcgtcagatttagaatg

SEQ ID NO: 70216 - DNA, 221 bp, Zea mays
  Clone ID: LIB3078-048-Q1-K1-E8
gtccctcgcacagacagggcctgtttttatggatcgtgactcaacaaccatcacagacccttttaaagtgcaggagctacctatacgaccttcatcggacatatgaccagcgactactacgtgtatccaactgctctcatctggccaaatgctaacattcatgaactaacatactattagacctttcaggagatgccttgcatctcgatggacaaggccct

SEQ ID NO: 70217 - DNA, 373 bp, Zea mays
  Clone ID: LIB3078-048-Q1-K1-D2
ccgacgcgtccggcttcctgcaggatggcactcctccttggcttgctgctgctagtgagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacaggatgcagcaacaaagttccttacgaccctaacctgattaccggcatccaaggcctgaatcagtactggagcaacatcaggtgccccagcaacaacgggcagagcagctggaagaacgcctggaag

SEQ ID NO: 70218 - DNA, 444 bp, Zea mays
  Clone ID: LIB3078-048-Q1-K1-B8
cttccctccctccctctccccgcgggccgccagaggcaatttcgccctcgattgggccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcagacaaggctccctatgtaaccaaagctaacaagctcaagctcgag

SEQ ID NO: 70219 - DNA, 349 bp, Zea mays
  Clone ID: LIB3078-048-Q1-K1-B9
ctacctggtgccctactcggcgcggtcgcgggagttctcgctgccggactacgtctgctacctgctgtcggagtacgcgcaggtgctggaccgcctctacgacctcggcgcgcggcgggtgctggtgcagggggtgggacccatcggctgcgtccccgcggagctggcgctgcacagcctcgacggcacctgcgacgccgagctgcagcgcgccgctgagatgtacaacccgcggctcatggcgctgctggaggagctcaacgcgcgccacggcggctgcgaccccgtgttcgtcggcgtcaacatgcagcgcatccacaacgacttcatcgacgaccccaaggcgtac

SEQ ID NO: 70220 - DNA, 409 bp, Zea mays
  unsure at all n locations
  Clone ID: LIB3078-048-Q1-K1-C1
gccgggcgtcctgatccaggtgtacgagggtgagcgcgcgaggaccaaggacaacagagctgctcggcaagttcgaactctccggcatccctcctgctccccgcggcgtgccccagatcacggttaccttcgacatcgatgccaacggcatcctcaacgtctctgccgaggacaagaccaccggccagaagaacaagatcacgatcaccaacgacaagggccggcttagcaaggaggagatcgagaagatggtgcaggaggctgagaagtacaaggcagaggacgaggaggtcaagaagaaggtggacgccaagaacgcgctcgagaattatgcctacaacatgaggaacaccatcaaggacgacaagatcgncttcaagctccccgctgaggaccaagaagaagatcg

SEQ ID NO: 70221 - DNA, 403 bp, Zea mays
  Clone ID: LIB3078-048-Q1-K1-C10
gacagatccactatatgtagctggaaatgctgctgatccagacactactttgggtgggtatatgggtttgtcaacacttccatcacttgctccaaagttaatgaatcacggcctgccaccagatacccctgctgttgcagtacagcgcgggactacaccccaacaacgaacggtgttcgcctcgttgaaggatcttgtggatgaagtcaagtcagccgatctagtttctccaactctaataattattgggaaagtggtatccttgtcacccttctgggttgagtcatctgaacatgatgcactgaaagttcagagctcgtatgcaaatgaggccagatgacaacagattttcttggtttttagtgactggacaatacttgagaaatgcaagatcccatatatg

SEQ ID NO: 70222 - DNA, 329 bp, Zea mays
  Clone ID: LIB3078-048-Q1-K1-C11
aattccctctcgacactaatcacacctcatactctctaatcttcgctcccttttcttgactgccaacaacttcttagggctgatttatctttaccacatcacattcatcaataattctatcttcaatgactctagttcattctctacatacgctttctctatcagcacaccaccattctactcctaaactactactcgataatcatctcgatcaaatatctatatttactccatcaagcaaatcaccactatgcctctacatctcataatagattatctgcaaaactcctcatgctacttcaacattcgtcctgttaaacatcttagca

SEQ ID NO: 70223 - DNA, 145 bp, Zea mays
  Clone ID: LIB3078-048-Q1-K1-C12
cccactcgtactaccactcgtccgctctgccttcgccgctccctattccttcagacgctctttccactcggtacaattcgtcaccagcccgcgaggcgccatcaccgacagggcgctagtagacacggactccactaataaggca

SEQ ID NO: 70224 - DNA, 381 bp, Zea mays
  Clone ID: LIB3078-048-Q1-K1-C2
cgccagagaggagaggaagagcgcgcggagagtgagagcccgggagccgggagaagcagcggctgggagcaagatggtgcagcgcctcacctaccggaagcggcacagctacgccaccaaatcgaaccagacccgcgtcgtcaagacacctggtgggaaacttgtgtaccagtacaccaagaagcgcgcgagcggaccgaagtgcccagtcaccgggaagaagatccaaggaattccacacctgagacctgctgagtacaagaggtccaggttggcaaggaaccaaaggactgtgaatcgtccatatggtggtgttctgtctggtactgcagttagggagaggatcatccgggcctttttggtcgaggaacagaagatagt

SEQ ID NO: 70225 - DNA, 373 bp, Zea mays
  Clone ID: LIB3078-048-Q1-K1-C3
tgccgatctcgtggggagccacctgctataccgactgctggagcgcggcgactgcgcggttgaacaggataacttactcacgcgtctcaaggaccacctaccccaccatctacagaacacaagttacaagattatcccccacgacgctcaaggagcccatagctggtctacgtctacacagatctaccaccattgcctgaaacagacactctcaagcactacacttacaacgctatcaagaccatatagacacaaggtgtaataacactgtacatactagcatatgacataatgactggctcaaggcacctacttacaagcactatctatggctatggagaaccgctgcatcaccataaagtggaaacctaat

SEQ ID NO: 70226 - DNA, 256 bp, Zea mays
  unsure at all n locations
  Clone ID: LIB3078-048-Q1-K1-C4
tgatcctgttttaaggaatgttgctcacctcggaagttggcaggttataagcccgntgcaagtatcaggttatgtggttgtggttgatgagttacttgctgtccagaacaaatcttatgataaaccaaccatccttgtggcaaagagtgtcaagggagaggaagaaataccagatggagtaattggtgtaattacacctgatatgccagatgctctgtctcatgtgtcagtccgagcaaggcatagcaaggtactg

SEQ ID NO: 70227 - DNA, 414 bp, Zea mays
  Clone ID: LIB3078-048-Q1-K1-C5
gcgagcgcaaggtgaagaaggcggtggtagggcatgaagggcgtgagctccgtggagggggcggtcaagcagaacaaggtgacggtcacgggctacgtggacgccgccaaggtcatgcgccgcgtcgcctacaagacaggcaagcgggtggagccctggccctacgtgccctacgagatggtgcagcacccctacgcgccgggcgcctacgacaagaaggcccccgccggctacgtccgcaacgtcgtcgccgaccccaccgccgcgccgctcgccagggcctcctccaccgaggtccgctacaccgccgccttcagcgacgagaaccccaacgcctgctccgtcatgtagtagacccacccacacaccgaccgaccgacccacttggtttctagctattagttactaatagta

SEQ ID NO: 70228 - DNA, 399 bp, Zea mays
  Clone ID: LIB3078-048-Q1-K1-C6
gcatggggccccatgctcctcgcctgttgagcagccgcggtaggtgctgccgcgcggatcgcctccttccacatactcggatcttgtttcttctgcagcttgcaatgattctttggtgctatttgatggctgttttcactgatcctggtgctgtacctgaaaactggagacatgatgctgaagatagcgggaacccttcattttcctcttcagatgagcaagaaagtgctcctagatattgttctcgctgtcaaaatggcaaacctccccgatgtcatcattgttctgtttgtaacagatgtgtgcttaaaatggaccatcactgcatttgggtagttaattgtgttggagcaaggaactacaagtattttcttccttttctggtgtatacatttatcg

SEQ ID NO: 70229 - DNA, 256 bp, Zea mays
  Clone ID: LIB3078-048-Q1-K1-C7
ggatcctgatcgacggtgacgacgttttctatcccgacacccgctacccggtggctgtgcggttcaacaaggtgaactacgccggcgtgtccaccaacaactacgccttggacgaggtcttagaggtgaaatgagtggggccggccggctcaagggctccaagctagctaccgtgtgattgattagtagtatttgtgaaatgaggctgcgaagctgcatgctgtgctggctagcgtcaccacttcgaccctatgtg

SEQ ID NO: 70230 - DNA, 372 bp, Zea mays
  Clone ID: LIB3078-048-Q1-K1-C8
cccacgcgtccggccgctcgaatccgtcatgaagggggccaaatccaagggcggggggaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaggctaacaagctcaagctcgagtacaacaaggccatcgctgcctacaacaagggcgagagcac

SEQ ID NO: 70231 - DNA, 442 bp, Zea mays
  Clone ID: LIB3078-048-Q1-K1-C9
ggaactgagaaccaccttgttctctgggatctccgcccccttggcttgactggaaacaaggtcgaaaggctgtgtgatctttgccacatcacattgaacaagaatgctgtcttcggtgacagcagtgcattgtctccgggtggtgtccgcattggcgcgccagcaatgacctcgaggggtctactggagaaggatttcgagcagattggggagttcctccaccaggcagtgaccatctgcctgaacatccagaaggagtacggcaagctcctcaaggacttcaacaagggcctggtgaacaacaaggacatcgagaacctcaaggtccatgtggagaagtttgccgactccttcgacatgcctgggttcacgcttgagagcatgaaatacaaggagtagatatgcctctttcatgcgcggcaaaggtcctctgtaccgatgt

SEQ ID NO: 70232 - DNA, 375 bp, Zea mays
  unsure at all n locations
  Clone ID: LIB3078-048-Q1-K1-D1
aacacggttccgaaagccatcgtgcattgccaagtgaaagaagcaaaaagaaatttggttaaccgtttctatgctcatgtgggaagcaaggagaagaaacagctgagcgcgatgttggatgaggaccccgctttgatggagaagagggatgccttggtcaagaggctagagctgtacaaatctgcaaggaatgagatcgactcggtcgcatggaaatgattggcttgtgacagctacatctggaatgtatgtaaaatgtacaaccgcagcagcacacgtgtgattgcagtagaatgttcaattcttttttacatttgaatntactctggaggccttgtacgcagttttcactcgagtctttgccggacatgctta

SEQ ID NO: 70233 - DNA, 372 bp, Zea mays
  Clone ID: LIB3078-048-Q1-K1-D10
ggacctgacacggtcaacacgatgcccgaccaagctttgcacgcattcatagaccagggcactgtctcgaggacagttgatgcgaatgtgtccgaggcggaaggtgtatacagcgccttggagaagcttggcattgactggggcgaggtcggaaagcagcttgagctggaaggtgtggactccttcaagaagagctttgacagcctactcgtgagcctacaggagaagggcaacagcctcaagacggcaactgtgtaaaactgagaagattgggtaccggcaggtgaacgattttactaaataaaatgctagcttgctggctctcttagtttttacgatgtacctttgctcttcattttctgaatcgggatt

SEQ ID NO: 70234 - DNA, 396 bp, Zea mays
  Clone ID: LIB3078-048-Q1-K1-D11
gacgtgatggcaacaaaccagaagcatatactaagccaactaggacactgtttgtcggtaactttgatccaatgaacacaagagtcagtgacatcgaaaggcacttcacaccatttgggaacatatcaagtgttcggataaggaagaactttgcttttgttcagtttgaaactatggaagaagcaagaaaggctcttgaagctactcatgctaccacccttttggacagggtgatttctgtcgagtacgccttcagggatgatagtgaagtgagtgataggtactgcagcccaagaagaggtggtggctatggtaggcggggtgatagcccagtgtaccggtcacgtcctagtccagactatggtcgcccagcaagtcctgtatatggttcatatg

SEQ ID NO: 70235 - DNA, 182 bp, Zea mays
  Clone ID: LIB3078-048-Q1-K1-D12
gtggagatctcatcacacaacagactctattctacgccatgttcaattcagacgcaggtgatgtttgacagaaccgaatgtccaataacgcctactatcaggaggcttactagctcgggttacatcttgagcagactattacggaagctcgctccgaccgttcagcaagaaactacacgata

SEQ ID NO: 70236 - DNA, 392 bp, Zea mays
  Clone ID: LIB3078-048-Q1-K1-B7
agttcagcgcgggacacgccaccgagcaggagcagcctgcggcggcagcaggcgacgactcggtgcccaagtcaccggcgccggaggcgcccaaggagccggcggcggtgcctgcgccggccgcggaggaaggcagcaagtcgtcggaggggttcggcctcggcgacgtcatgaagggcgccgagcagctggtgggagggaataagcagggcggcggggaggagagcgccggcggcggtgggctgtttaagatggcccagggcttcctcaagtagatattgtctggccaacgtatatacgagtacgtaattagcttcaaaataatgttcccctcgcctttatttgctgctcaagtccctgtaataaccgagaacgttaattgtagcagtgtg

SEQ ID NO: 70237 - DNA, 315 bp, Zea mays
  Clone ID: LIB3078-048-Q1-K1-A2
ccgacgcgtccggccgccgccgcctacggtgaagcagccaacgtgttcggcaagaccgagaagaacacggacttcatctcctacgtcggcgacggcttcaagctgctgatcccgtccaagtggaaccccagcaaggagcgggagttccccgggcaggtgctccgctacgaggacaacttcgacgccaacagcaacgtgtccgtcatcatccagcccaccttcaagaaggccatcaccgagtacggctcccccgaggagttcctctcgcaggtcgactacctgctcggcaagcaggcctacggcggcaagaccgac

SEQ ID NO: 70238 - DNA, 215 bp, Zea mays
  Clone ID: LIB3078-048-Q1-K1-A4
cggacgcgtggggcagccgtgcagtgctgaacttactaatgaactggtaggtcagcctgaagtagttttgataaaagcagttgccaaagagtctgcagctcgcaggatcacctgctatatgtgcgtgttcctgctatctttcggaaagatttgggttgtacataatctgtccttacccttcttttttaaaaaaaaattatgttcctactattctt

SEQ ID NO: 70239 - DNA, 398 bp, Zea mays
  Clone ID: LIB3078-048-Q1-K1-A5
ctcgttctcatggccgagcacaagtcttcctcaagcgtcgcctgctgtaccaggggcgagctccccacgcccaccgctactcctagcccctctcctccctggatttcgcccagtctccatctctctttctagccatggacggcgacctctcctgcctacagcagggcgtcgacatggggctcgcccctgcaacctcgcctcgctgggtttcctcagggcgccgggatgctgcttcctatacatcgtgcgactccctggtgcttgctctcgccctagtccatggagcagtagcagccacgacactccttcgtgtcgcgccctcgacgtgttcgatgaaatactgcaacgagctccaactcgatctgcacagcccctgcgcgacgtcacaaactccgctc

SEQ ID NO: 70240 - DNA, 386 bp, Zea mays
  unsure at all n locations
  Clone ID: LIB3078-048-Q1-K1-A6
cccacgcgtccgcccacgcgtccggggccacttcctcctggcgcgcctgctcctggacgacatgcagaagtccgactacccgtcccgccgcctcatcatcctcggctccatcaccggcaacaccaacacgctggccgggaacatcccgcccaaggccgggctgggcgacctccgcggcctcgcggcggggctgcgcggccagaacggctctgccatgatcgacggctccgagagcttcgacggcgccaaggcgtacaaggacagcaagatctgcaacatgctcaccatgcangagctgcaccggcggtaccacgaggagacgggcatcacgttcgcgtcgctctacccggggtgcatcgccaccacggggcttgtccgcgagcaca

SEQ ID NO: 70241 - DNA, 298 bp, Zea mays
  Clone ID: LIB3078-048-Q1-K1-A7
cccacgcgtccgcccacgcgtccgcctggacaggctcagggagctctattcggaggttgaagacaagattgaggggattgacaggtaaattgatttgccagatcggtcggccgatcggttccagcattcaacccataacgagcttggaactcttctgcctcattgggactcttgtacaatgtctgggtgtgtgatttatatatatataaagttgtaacatgtaatactggaggatacaatctttaacaaagagggtggcggttgttccattcacaaatgactaccatgcaagaactag

SEQ ID NO: 70242 - DNA, 425 bp, Zea mays
  Clone ID: LIB3078-048-Q1-K1-A8
caccatcaccatctccggcagcttctacctctacgcctgcatcgccgccgcagggggggtgttcatgtacttcttcctgccggagacgatgggcaagagcctggaggacaccgtgaagctcttcggcaaggacgcggacgacgaggacgtcagcgacatccgtcgtcacgtgcccactaagaagccgtctactgagctgagtgctcagcactgatcgagtaatgtgctacgcaacacgtgtcctcccgagtgtggccgaagcttatgttccgtaaagcttcgatgatgtagtataatatttttttttgtgtgtcggaactgtggtgaatctatgtatatcccgcgcctcttttgtttattagatttgtacattttttgttgatctcgtggcatggtgcgtgtgcgtagaaaaaatattattaaaa

SEQ ID NO: 70243 - DNA, 416 bp, Zea mays
  Clone ID: LIB3078-048-Q1-K1-A9
cggactcgtgggcaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcactccaaagtacacttcactgaagcctctgggagatagggtgcttgtgaagcttggtgccgcagaggagaagacagttggtggcattttgcttccatctactgcccagactaaaccacaaggaggtgaggttgttgctgttggagcaggaaggaccatcggggacaagaaaatagctgtggatatagaggttgcagaagccgaagacaaaactcctgggggccttatcctcactgaaacatctaaagagaagccg

SEQ ID NO: 70244 - DNA, 386 bp, Zea mays
  Clone ID: LIB3078-048-Q1-K1-B1
gcctcatcctatccaagaacgcagaaccgagacccacgaactcgcagcaggccagcagccatggccgcccccgcaacgagctccctgctgagcacgctgctgcagctaccgctcgctccgttctcggggaagagctcgccgccgtccgtggtgcacgtggcgcgccgggcgccgacggcggtggtggcggccaaggggttcaatgtgcagatcctggtggacgagaacgagggggaggagtccatctttcgcaggttccggcgggaggtgatgcgcgccggcgtgctgcaggagatcaagcgccgtcggaggtacgagagcaagacagacgagaagaagcgcaaggcgcgcgaggccggacgccgcaaccgtcgcatgcgtatgat

SEQ ID NO: 70245 - DNA, 407 bp, Zea mays
  unsure at all n locations
  Clone ID: LIB3078-048-Q1-K1-B10
cccactcgtccggcagtagctccaaagcagaaagagcttctccagtatgttggaactgtagaagaagacatggtcgatggctttccctttgaaataccagaagagtacagcaacatgcctcttctcaaaggaagagctactgtggatatgaaggttaagattaaggacaatcccaacatggaagactgtgtatttaggatagttctggatggatataatgctcctgtgactgctgggaacttcgtagatcttgtcaaacggaaattctatgatggcatggaaatccaaagagctgatggctttgttgttcaaactggagatccagaggggccagctgagggctttatcgatcccagcaacggcaaaatccgtacggtacctctggaaatatggntgatggtgataag

SEQ ID NO: 70246 - DNA, 427 bp, Zea mays
  Clone ID: LIB3078-048-Q1-K1-B11
gataggcgtagcatatggtgttggtggttgggcagatctcggtgtctattcgtggacgatatgctaaggagctaatgagaaattcaatgagcgctatcaaagatgagccagaacggaccattgatccaaccagagttttggaaaaggcttatattagtactaaagcaagggggtcatctaccgcgtgtatcatcactcttaaagatcagggtatccatgctgtaaatctcggggatagtggtttcgtagtagtccgagatggccgcactgttctcaggtcaccctcacagcagcatgatttcaattttacttatcagcttgagagtggaggtggcagtgatcttcctagttccgcacaagtatttcactttgcgggttccctggatgatgttatcgttgctggcacggattgactatttgacaattt

SEQ ID NO: 70247 - DNA, 223 bp, Zea mays
  Clone ID: LIB3078-048-Q1-K1-B12
tcccactcgtccgcttttctatagcatgtatcagtccaggactcgttttttttctgtcgagtatccttgcaagttccgactccctcactcatctccgttcgtccgtctcaccgacccctagctcctctccacgccggacacgtccagattctatgcctactactatcgctaacgctcttttatctccgaggctatgcaccatcttcttcattccattctccca

SEQ ID NO: 70248 - DNA, 153 bp, Zea mays
  Clone ID: LIB3078-048-Q1-K1-B2
ccgacgcgtccggcgaggcatcggaatgtatacatagctccgtacagtgagcactgtgcggcattcgacccgtcggcctgtgcatgtgcttcatctatgtaggcaactccgcctacatccagaacattgcatggcgcgtgagcgaccagacta

SEQ ID NO: 70249 - DNA, 367 bp, Zea mays
  unsure at all n locations
  Clone ID: LIB3078-048-Q1-K1-B3
ggaccgcatgccttagcacaggtgcggcttttatctcactggcatatgttgtagttggcgcgcagcatgcctggatggccttcacagtatcagccatcggaggtccgatcatgattggaaccctcctgttcctagcctatctgttgttgcgcccacggttcaagtttggcgaagacagacagcgccgcatcaagagggcaagcggcagcaagtccttctcctggtcactccatgatggtttttcagatctggaagccttctctgatcatgagaagaagatatatgccctgtangaaggtgtaacagtaattactcttgcatgagaagaggcaattgggagagtgcaaatggttcgtgtatatatttg

SEQ ID NO: 70250 - DNA, 391 bp, Zea mays
  unsure at all n locations
  Clone ID: LIB3078-048-Q1-K1-B4
ttcgacgacttcatcaagaacaccaagaagagtaacccctcgtctcgcggggcccgggggagccgcggcgtatccgcccctggcggcgggaccggcggggtcgggccgaccaggcgcccctttaaaagggctgggaacaggcaggcgccctaccagccgccgaaggcccccgacgctgcgtggcagcacgacatgtaccctgcggtcgccgcaggaggcggcggcggcggcgggagggtctcggctctcgagacgggcgccaagctctacatctncaacctggactttggggtttcgaacgaggatattaaggagcttttctctgagctaggtgatttgaagcgtttttcgattaattatgatcgaagtgggaggtctaagggaacagctg

SEQ ID NO: 70251 - DNA, 377 bp, Zea mays
  Clone ID: LIB3078-048-Q1-K1-B5
ccagaatgctatgtacggcaatccaagtgaccaacaacagggtttcaactttggacgaaacccatcaagttggttgaaccagccatttccccaggttgaacagccacgagtggtcaggcctcatgcaacggttgctccatttgatctggagaagactagagaaggaagtggcttcaagatttttgggttccaagttgatacaaccagtccatctcctgtccaattgagctctccattgcccgctatccaggagcatgtgttacaaactcgaccatcggcaccggtgaatgaattgcaacctgtgcaaattgagtgcttgcctgagggatctgtaagcacagctggaactgcaacggagaacattcagcaagccccgc

SEQ ID NO: 70252 - DNA, 417 bp, Zea mays
  unsure at all n locations
  Clone ID: LIB3078-048-Q1-K1-B6
gcaaacaccaggctgccttcgctgcctcatcttctttcttcacttcttaagcctgaggcttcatccagttcagatgccattgacagtcaattgacagaaatgtcagatgaggaggatgaatatgatcaactaccacccttccgcattctaaagaaatctgaatatgaaaatttgaccaatgaacagaagtctgcatatcttgacgaactggactaccgtgagactttgtacctaaagaaacagtggaaagaaggaatcagaaggaaaaagcttactgaagctcagagtgatgaagttggtgatgattatgatgagagtgcatncncagagattgtgcacatgtcagatatggacattccactaagttttgactctgattatcctgtgcatcgttaccgtcacattataactgatgat

SEQ ID NO: 70253 - DNA, 429 bp, Zea mays
  Clone ID: LIB3078-048-Q1-K1-A12
gacccactcgtccgcccactcgtccgtccactcgtccggcatgtgctaccttaggggtcttctaggccactcacacgaaagctttcatttgatgcctcctcaagtgaatcaaggggcacagaaccctcaacaagtatgtcaacagagaacacacctgtgtccatcaacgtcccaaagttggcagagggcattgaatttgggaggcaaccaatggtcacatcctccactttggtagagctaacaactagactagatttcttcaaggagcgaaggtcgcaactgatggaacaacttcatagccttgatttgggacgtggatctgctccgcaaggttttccattcaagccaccctctccttggaaccacccaaggtaggaggatgaccgttcgatttcatgattgtaaattcttcaatagtggttccttttc

SEQ ID NO: 70254 - DNA, 398 bp, Zea mays
  unsure at all n locations
  Clone ID: LIB3078-056-Q1-K1-A6
gttctacctgtggttcgacccggccgccgacttccacacctacaccatcatctggaacgacaagaacgtcatcttcaaggtggacgacctcttcgtgcggtgcttcaagcggtacccggacctggcgtacccgggcgggaagcccatgtcggtgcacgccacgctgtgggacggcagctactgggccacgcagcaggggaaggtgaaggtggactggtccgtcgcgcccttcggcgtctgctaccgcggctactccgncgacgcctgcgtgcccgacggcgacgggccgccgctcttctgccccgccggcaccgaccgctggatgagccgccagctcgacgccgtcgagtggggcaccgtcgcctgggccaggcagaactacatgcactacaactact

SEQ ID NO: 70255 - DNA, 381 bp, Zea mays
  unsure at all n locations
  Clone ID: LIB3078-056-Q1-K1-A7
cagccgcagccgctgcttttcgttcgtcttcatcctacgcgagggcgaaaccgagagaccctctccctcctgtactccggccgacacatccaggggcgatgacgctgggtagctccggcgccggatcgagcgtcgtcgttcctcgaaacttcaggctattagaggagctcgagcgtggagagaagggcattggtgatgggacagtgagctatggaatggatgatgctgatgacatctacatgcggtcatggactggtaccatcattggccctcacaatactgtacatgagggtcgcatctaccagctgaangttgtttgtgacaaggactatncggagaagccaccatctgtcagattccactcaagaatcaacatgacat

SEQ ID NO: 70256 - DNA, 383 bp, Zea mays
  Clone ID: LIB3078-056-Q1-K1-A8
cgcatattcgccgaatctgtcttgaggagactagaggagaaatgaagagacatcgaacactacaagcgcatttggttagtggtttaccgttcagctaccttgtaattcggttggcttcccaaaaaaaagtccgggacacgtcaagtgcccagctcagttttgttgtaaatttgttagaaatttgacagaattggtagtgtgaacttaccaagaaaggaagaatagccgcatgtgttgtggctgttcattctatgattggttaggaattgacacttgaaacacggtactctattcagaggctgtgtccgtatttatgaatcgacgatgtaatggtttaaattcatgtgattattgattcaataatatgagtagattacatcctc

SEQ ID NO: 70257 - DNA, 397 bp, Zea mays
  Clone ID: LIB3078-056-Q1-K1-A9
agaacacgatgaccggatccttgagcttgttgcgagccactctggtcttgagacactgtgagcatttcagacagatctcagggcatgaatcaagctttaaatcttgcttgtgcacaactcgtcaaggttgaatactctgaatattagtgagtgtatcatgccagaccaggttagtctgacgccaactgcacagacactactggaataaaattggggatactttgagaatcagagtcaacctgacgcaggctacaaattagagaacgaatatccaagtcctttactgcaccggtacaatatgctgtatatgatgacaaatgagagacagatactggtgacatatgctggtgtacttaaaaagatgaactcgttgaatacatgcctgtacaaacctgat

SEQ ID NO: 70258 - DNA, 320 bp, Zea mays
  unsure at all n locations
  Clone ID: LIB3078-056-Q1-K1-B1
actagttctagatcgcgagcggccgcccgcgatctagaactagttctagatcgcgatgtagaactagtctagtgatatgtgcactaggtttataggagttgcttggaaaccatttgctgcattgactaccttgatatccgttcctgttataggtacttctttggaagtatcaaatattgtttacaaaaatgcttagccctgcttagatcttgtggatagaggttgtcttttgcattaatgcctagctcangggttatcctgaggaaagaaggcttctacctgcaagaatattntcattgggagcatggtgggatcttact

SEQ ID NO: 70259 - DNA, 448 bp, Zea mays
  Clone ID: LIB3078-056-Q1-K1-B10
cccacgcgtccgcccacgcgtccgcattatggcagggcaacgtttcacaatttaatgaaggctccacttatttgatgggatggttaagagattacctatggttaaactcttcacaacttattaatggatataatccttttgggatgaatagtttatcagtatgggcttggatgttcttatttggacatcttgtttgggctacaggatttatgttcttaatttcctggcgtggatattggcaggaattaattgagactttagcatgggctcatgaacggacacctttggctaatttaattcgctggagagataagcccgtggctctttccattgtgcaagcaagattggtcggattagcccacttttccgtgggttatatattcacttatgcagctttcttgattgcctcaacatcaggcaagtttggttaatttagttattttttttt

SEQ ID NO: 70260 - DNA, 458 bp, Zea mays
  Clone ID: LIB3078-056-Q1-K1-B11
ttcgacgccacgcgtacgacgtcttcaaaggattgctggatcagatctcgacgatatatctttggataaggagctccgtccagaagcagttgatgagatcaaaaatttgcgcaagaagtcacaaactgctgatggtgatacgttcatttcggaccctgtgcatgagaaaagagtcagaagaatccacagggcacttgactctgatgatgttgagcttgtgaagttgcttcttaatgagtccgacatcacattagatgatgccaacgcattacactatgctgcttcttactgtgatcctaaagttgtctcagagctgttagatttggcaatggctaacttaaatttgaagaatagccgtgggtacacagcactccacttggctgctatgaggagagaaccagctataatcatgtgtctccttaacaaaggggcaaatgtgtcacaactgacagctgatg

SEQ ID NO: 70261 - DNA, 310 bp, Zea mays
  Clone ID: LIB3078-056-Q1-K1-B12
ctgactcgtgctcggacgcgtgctccgactcgtgggcagacgcttgtgcaccaggccaggcaagtaagcacccgcgcgcgtcaaagagttcacacccatggctagcaccaacattgcgtctgacaccttgcggttcatgcttggccgaggtcgtgcccactgtcagtagcggcattagacgtgttagcttctcctcagcgctcaaccggcttggctggaagcttgtggtccaggcctttgacgagtctccggcataactggagcccacggctgatggttagggcgccttggccaccattcttagggccga

SEQ ID NO: 70262 - DNA, 365 bp, Zea mays
  Clone ID: LIB3078-056-Q1-K1-B3
cggcggctggcatggccagggatggcttggcaagggcgcatggagcgttggctggacgcgagatgggcaaggatgggacatgccaacgctgtggggagaggcttgtctgcattgacattgatccagccgagactgacaactttgcaaattcgctcaccgaactggccattaagcttgaggccagggaagatttcctcagttttcagagctggctacgccgccatggaccattcgatgctgttatagacgctgctaatgtaggcctttacaaaagtaaagatttctgtttttcacaggttaactctgttgtaaatgctatacagagagtaactaaatcaaagaagttgccactgatcgttttgcat

SEQ ID NO: 70263 - DNA, 378 bp, Zea mays
  unsure at all n locations
  Clone ID: LIB3078-056-Q1-K1-B4
cttggcgcaggagcattacaaggatttgaaggataaacctttctttcctaagctgatcgattacataacttctggccctgttgtctgcatggcctgngagggtgatggtgttggtgcatcagctcgganattaataggagctactaaccccctttcaagctgaaccagggactataaggggtgatcttgcagttcaaactggaaagaaccttgtccattgaaatgataatcccgataatggcaagcgtgaaaatgaactgggggtcaaagaaggcgaggtctgccaatgggaatcaagtcaagcaccgtggcttataaaataactattgctaatcatttccagaagtgtatttcaatgtttttttggggtcgtcttga

SEQ ID NO: 70264 - DNA, 430 bp, Zea mays
  Clone ID: LIB3078-056-Q1-K1-B6
gctgcacttaaaggaaagctacatgcatttaatcagaacattagtgaccaagttgctggttacatgagagatccaagccggatgattaacaggatgtacttgaccaactctgctgttagtgtatttggaaaggatgtgggagaacctggaacagctgaggaggggcacaatatggaaggtgatcctgaacttattgacgattctgagttttatcaacaacttctcaaggagtttcttgaatcatgtgataagggggcctcagagtcggcaatttatgctctaaaaaagcagcaggttaaaaagaggaagcttgttgatcgtcgtgcttcaaaaagcagaaagatacggtaccatgtccatgagaaggtcactaatttcatggccccagagcccatggttcttccttcaatggctccgaaagttgttgaga

SEQ ID NO: 70265 - DNA, 397 bp, Zea mays
  Clone ID: LIB3078-056-Q1-K1-B7
cgcaccccggcgggcccgccatcctctaccaggtggaggccaaggtcgggctggacagggccagtatgcgcgccatccgccacgtcctctccgagtacggcaacatgttcagcgcctgcgtcctcttcatcctcgacgagatgcgcaagcgctccgccgaggacggacaggccaccacgggcgagggcctcgactggggcgtcctcttcggcttcggcaccgggactcaccgtcgagaccgtcgtgctccacagcgtccccatcaccaccggagcggtcaccgcctgattcatcgattcatcaacgatcaaattactcccctctgcgatccaattcgtcgtcggctcgttcgtcattatcttacgtcgtacgtccgcaaataatgtgctctctgcta

SEQ ID NO: 70266 - DNA, 315 bp, Zea mays
  Clone ID: LIB3078-056-Q1-K1-B9
acgcagtgcatgcatacggtcaggagggctgtttagctcatatacgaggctgatcacatctcgggcgggtatactccggtgagttcactggagttgggtggcaagatctatgacatgatggtgatcgccctcgacctgagatggataaagtccaacgtgcaggacaactaagcgctgaactttgaggccagcccagagccaaactactctgacgtcaccatgacgtacgtgcatacgcccatggaagagatccccgagaaccatccgtagatggaccagagggacatcccatacgcatacttaactgcattttta

SEQ ID NO: 70267 - DNA, 437 bp, Zea mays
  unsure at all n locations
  Clone ID: LIB3078-056-Q1-K1-C1
gccgccgccaaaatggtgaacgttcctaagaccaagaagacctactgcaagaacaaggagtgcaagaagcacactctccacaaggttactcagtacaagaagggtaaggatagcctgtctgcccagggaaagcgccgttatgaccgcaagcagtcaggatatggtggccagaccaagcctgtcttccacaagaaggccaagaccaccaagaaaatcgtgttgaagctgcagtgccagagctgcaagcactactcacagcacgcaattaagaggtgcaagcattttgagattggtggagacaagaagggcaagggaacatctctcttctaagtttctcatcacccatctcgatgttggatcgaaactgtgggtctactactgttctaaaaactcgtcaaatttcaatgttactagtaagtcttgaagcangtcatgct

SEQ ID NO: 70268 - DNA, 410 bp, Zea mays
  Clone ID: LIB3078-056-Q1-K1-C10
gcggctgagccaggaggagatcgaccgcatggtgcgggaggcggaggagttcgcggaggaggacaagaaggtgaaggagcggatcgacgcccgcaaccagctggagacgtacgtgtacaacatgaagaacacggtgggcgacaaggacaagctcgcggacaagctggaggcggaggagaaggagaaggtggaggaggccctcaaggaggcgctggagtggctggacgacaaccagtcggccgagaaggaggactacgaggagaagctcaaggaggtggaggccgtgtgcaaccccatcgtgtcggccgtgtaccagcggtcgggcggcgcccctggcggtgacgctgacggcggtgttgacgacgaccacgacgagctgtagatggttgtagatggtggtggtgacgtgg

SEQ ID NO: 70269 - DNA, 310 bp, Zea mays
  Clone ID: LIB3078-056-Q1-K1-C12
cccacgcgtccggaaacaataagttgatgctggagctccagaattgtatctgtttatagaatgatggagattttgattcagtaatctggagtctagccatccgagatcctcaataatctgtacctggaaaccaaacagtgccaagtaacttttacggagcgttatgtgcagctcgtgtagaaaattcaattgaaccgtatttcctgtcgtgtaccttccagtaccgtattatattatatatttattattcaattggacctgcactcagaagttgcagtctgggacgtatttgcttttgcattttataacc

SEQ ID NO: 70270 - DNA, 246 bp, Zea mays
  Clone ID: LIB3078-056-Q1-K1-A5
cggacgcgtgggcggacgcgtgggcggacgcgtgggcggacgcgtgggttgcggctgacaaactcatatatgctcgtgagactattaagtcgattgctcgaaagcatggactggtagcaacatttcttccaaagcctgatttggatgattttggatctggttctcacgtgcatctgagcttgtgggagaacgatcagaatgtttttatggggtcaagtaaagatacctttcatggaatgtcaaaac

SEQ ID NO: 70271 - DNA, 445 bp, Zea mays
  Clone ID: LIB3078-055-Q1-K1-H1
acgctggaattcttactgtcttcttctgtggaatagtaatgtcacattacacttggcatagtgtgagagaaagttctagggttaccaccaagcatacttttgcaactttatcattcattgcagaaattttccttttcctctatgttggcatggatgcattggacattgagaagtggaaattagctagtaacagtcctaataaaccaattgctttaagtgcaattattttgggcttggttatggttggaagagcggcatttgtattccctttgtcgttcttatccaacctaagcaaaaaggaagcccgtccaaagatctccttcaagcaacaagtaatcatatggtgggctggtctcatgacaggagcaatgtcaattgcgcttgcctatgacacgtttacagcatctggtcacactgaaatgcgagtcaatgctatcatgatcac

SEQ ID NO: 70272 - DNA, 370 bp, Zea mays
  Clone ID: LIB3078-055-Q1-K1-H10
gcggcgtccacgagtcacgaggagcccagaggcttcttcacagcagcagcggcaggtcggctgatgccagactccccccagctccaccaaccgcctccccctcccgcgccgccgccggccagcgcaacaccagccgcgccagcggcagcaaatgcgcaacccaagctgactgccgtgaagctgaggatgatcatcaagggcgtgctcgggcggtaccagcgctggaaccccgtgcacccgacggccggcaccttctggggtgtggggctcggcgtcggctgcggcgttggctggggccccggcttcgggcctgaggtgattgggtacgtaggcgccgggtgcggcgttgggttcagcgttgggttcacgc

SEQ ID NO: 70273 - DNA, 199 bp, Zea mays
  Clone ID: LIB3078-055-Q1-K1-H11
acgccgacgcgtacgcgtaagcatgcgcacatttgcttttcttcctaacttgccgaaagtagggtgaggatagactgcaacgctgtgcggcgatctcatactactaccgtcctgtcctgatccagctcaccaacatcctagtcaactgcaagcaatgcttaacccaagctgactaccttgaacttaaagatgatcatca

SEQ ID NO: 70274 - DNA, 377 bp, Zea mays
  Clone ID: LIB3078-055-Q1-K1-H12
gacgatgacccttcacgccaaccagaaaggagcaatgaggctgctggcgcttatgcacaggcatgcatagatgttgccacagaattgaaccatccagttatagacatctggaccaagatgcaggaatttccagactggcaaacatctgcattgagcgacgggctccaacttaccccggtaggaaacaagatcctgttcgaggaggtggtgaagacgctggagacgagcatcggtttcagccaggagcggctcacgtcggacctcccgctgttccacgagatcgaccccaaggaccccatgaaagccttcggagcttagcttgggccgcacggttggatcagccacgtctgctgcatttgaagtcgtcgtcagtatgc

SEQ ID NO: 70275 - DNA, 143 bp, Zea mays
  Clone ID: LIB3078-055-Q1-K1-H2
acaggagatcaagacgaatgccctactgcattctgggcggtctgaccgcatacgtgaccgcggacgggtgaaagggtatgggcaaaggcatgtgcgatactgtcgaccagacagggacgaacagttccggctacaggccagat

SEQ ID NO: 70276 - DNA, 415 bp, Zea mays
  Clone ID: LIB3078-055-Q1-K1-H3
acgggacctctccgtcgtgccatccctctccctctccctctccccgcgccgtgcccttccgcgtccgggccagtagggcagcgcggcgtccggccttcgtctgccgctgcagatgctccccggacgcgtacccggtggccacccggcggctgttcgcctgcctacttgccaccgcagcagctgtgggaggtggcgtggccggaggcggacgagaagccggcgcagtgtccaccagccagacggcactcatggcgtgcaagattcctgagagcgaattcaccacgctgcccaatggcctcaagtactacgacatcaatgtacgaagtgatgctcaagctgataaaggatcccatgttgcggtacattatgtggccaagtggaagggcatcacattcatgacaagttggcatggtct

SEQ ID NO: 70277 - DNA, 451 bp, Zea mays
  unsure at all n locations
  Clone ID: LIB3078-055-Q1-K1-H4
gctctgcggcgccgacggcctgccgcacctcatcgtcagcggcgaccagcggcactggggcgagttcgtcaccccgggcctgctcttcctctacatcgccgggtggatcgggtgggtcggcaggagctacctcatcgccatcagcggcgagaagaagcccgccatgagggagatcatcatcgacgtcgagctcgccacccgcctcctccccagggggttcatctggcccgtcgcggcctaccgcgagctcatcaacggagacctcgtcgtcgacgacaaggacatcggctactactagctgctgcacctgtgcttgcacatcgctgctggcgagttgggcagtcgtcgtacgtgggaaacatggcttttggtgtangaggaaggaatggaagtggtctgttgtacttaaagaactagatgaagaagtcttgtataactgaaacttcacccc

SEQ ID NO: 70278 - DNA, 412 bp, Zea mays
  Clone ID: LIB3078-055-Q1-K1-H6
ctagatccatcgcccggggtccgtcatgatcccgacgcggtccgcgcaggcgtcgttgggcgaccgcaccaacgagttccgcgccgccgtcgagagagcgcgccgccacgccgtaccttcctcgtcgtcagcccccgccgcgccgagtagcagctataccgggcccctcaacgggttgatcgcagccacgtaggctcgctcggagttcaacaaccgcgcgttcaagatcgtgctcgggatccaccagacctcacagaagctatcccgccttgcgaaattggccaagagatcatctgtttatgatgaccctacagtggagattcacgagttgactgcagtcattaagaacgatatcacggctatgaattctgctgttgtagacctacaagctctctgcaatttacacaatgac

SEQ ID NO: 70279 - DNA, 448 bp, Zea mays
  Clone ID: LIB3078-055-Q1-K1-H7
gagctgtcggcggtgtgcccgtgggcggaccaggtgcgctggcactaccactgggcgagcccgctccactacgccaacaccccccaagtctgcaacttcaagttttctcgggactgccacaattctcgtggccagcaagggatgtgcgtcgtcggggctatcaacaactacacggaccagctctacagctacggccagaagacttcgtataacctgacggagagcctgatgttcctggcacacttcgtcggcgacgtccaccagccgctgcacgtaggcttcgaagatgacgagggcggtaacaccatcaccgtccactggtaccggaggaaagcaaacctccatcacgtgtgggatgtcagcattattgatacggcaatcaaggacttctacaacaagagcatggataccatggtagaggctctcaagatgaatcttaccgatggat

SEQ ID NO: 70280 - DNA, 379 bp, Zea mays
  Clone ID: LIB3078-055-Q1-K1-H8
ctgaagttcctgtgcctaaatcaaaggacttcatgccaacattccctgctcttaatggacttgacaggcgttccagacggtatctgaagagtcctgatcctgtggaagagcaacttttgaaagaactgcaagggaacataggcaaccatgggcttttcgggtgaactagaagcacttgattgggtctgcaacggaacataggcaaccgatggctttttggctagaactagaagcactggatcagttcctgtccgtcctaactgttatgcttcacactgaaatcctgagttcatgaggttagatatcttctgacgtgacgtgccatggacatgaagtatcacatcttatcggtgtctagcagcaactgatagtgctcttt

SEQ ID NO: 70281 - DNA, 460 bp, Zea mays
  unsure at all n locations
  Clone ID: LIB3078-055-Q1-K1-H9
cggacgcgtgggttgtaccaagtccacttatgctcaaaagtgaaaatgtacaagaggatggggtctatttattggaaaacggtgaggatggtctagtctacgtaggaaacatggtaaatccggctaccctggaacaaatattcggtgtctcttctttggctgcattaccagcccagttagcattggagcagtttgacaacgaactctcgaggaagattaacgaagttgtaaatgaaattaggcgccagaggtgctcatacttgaggttgagactatgcagaaggggcgaaccatctggagattttttccggtcatttctaatagaggacaaggcacctggcgtcttctcctacgaggagtttctcgtgcatgtccacaggcagatccaaagcaagatgacctgagggccaagcgaatgcaaaagcaacatgaactgaaggtcangctggcaaatgcaaaa

SEQ ID NO: 70282 - DNA, 182 bp, Zea mays
  Clone ID: LIB3078-056-Q1-K1-A1
gggccaggtggtcgatacatatgccgatatgcacgcggattgatccccacgaccggtgcgactggctcattcaaacctgcacgggactatgccaatacttaaccaggtctgtctcccgctcatagcttggttttctgcttgttgctaacgcttcgtgcgacggatgtccttgtaaatgctgg

SEQ ID NO: 70283 - DNA, 75 bp, Zea mays
  Clone ID: LIB3078-056-Q1-K1-A10
gcggatactcactaataatatgggagtctccttctgttgcttgccacaatatttaggggcaggtttcactggcta

SEQ ID NO: 70284 - DNA, 417 bp, Zea mays
  unsure at all n locations
  Clone ID: LIB3078-056-Q1-K1-A11
ccggcatcgctccgttccgctccttcttgtggaagatgttcttcgaggagcacgaggaggacaagtacaccgggctggcgtggctgttcctgggcgtcccgaccagcgacaccctgctgtacaaggaggagctggagaagatgaaggagatggcgccggacaacttccggctggacttcgcggtgagccgggagcagacgaacgcggtcggggagaagatgtacatccagacgcgcatggcggagtacaaggaggagctgtgggagctgctcaagaaggacaacacctacgtctacatgtgcgggctcaagggcatggagaagggcatcgacgacatcatgctcgacctcgcagccaaggacgggatcaactgggtggactacaagaagcagctcangaagagcgagcaatggaacg

SEQ ID NO: 70285 - DNA, 180 bp, Zea mays
  Clone ID: LIB3078-056-Q1-K1-A12
cccacgcgtccgcccacgcgtccgacatctaataatctgcttatgtattatcatagtctagctatctagattatataattcacttaaaaaaaaaaaaaaaaaaaaaaaaaaaaaaaaaaaaaaaaaaaaaaaaaaaaaaaaaaaaaactaacaaacagcaaaaaggacgaagagaacgaa

SEQ ID NO: 70286 - DNA, 283 bp, Zea mays
  Clone ID: LIB3078-056-Q1-K1-A2
ggcctttccgtgctctcttggatgttggccttattaggactacgactgggaaccgtgtgtttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaaaaagggaattgaggctga

SEQ ID NO: 70287 - DNA, 361 bp, Zea mays
  unsure at all n locations
  Clone ID: LIB3078-056-Q1-K1-A3
ggcacgccgtggacgggtgccgcgagttcatggcggcgggcgcggacggcacggcggcggcgctcgcgtgcgccgcctgcgggtgccaccgcagcttccacaggcgcgaggtggagcagcagcccgccgtcgactgctgcgactgctccttcaccacctncggcgcctgaagtgaactcatatatatatctacgatgaatcgccggcggctggccacgccgcttgagtgagctgctagctagcaggtgggtggatgggtgcatgcatggggtgggaccgacgatcatgggggcagggcagggcattcatcaaacggtgtgatttggccggtgtagtcgatcgtaggtgcattatattcatc

SEQ ID NO: 70288 - DNA, 412 bp, Zea mays
  unsure at all n locations
  Clone ID: LIB3078-056-Q1-K1-A4
cccacgcgtccgcccacgcgtccgatagcatccgcggatctgactcttctcataattggtctctgccgcgtgcgccgncctgaccttgcgctgcangtgctcgacgaaatgcccaacctatgcctcgctcccggaagggacgcgtaccgcgcgattgtgcctgctctctgtgatgctggcatgcttgatgaggccacacacgtcggctatttcatgatgtggccggtgtcgcagaagggctgtgatgcagatgttatggtgtaccggacattgctggccgcactctgtgcggctggccggngtgaacaggctgagctggttctggataaggtgctcangaagggtctgagatcaccaagtagtcgtcggtctcttcgtgggccaatgctngctgtgcttagtgtcgaagatg

SEQ ID NO: 70289 - DNA, 426 bp, Zea mays
  Clone ID: LIB3078-055-Q1-K1-G9
acggtggtcctcattgttttcatccggctgtgcatcagttactacgcccacctatgtttaacggtgtagacctcacatgaagttaaaccagcctggagtttcatatcccatgcatgatgctgtccataggttttcaacccacatgcacccatttgggtgggctaatcatctggatgaatcatgcccacctcatatgcaagtttggaatggacgcagtagtgtgtttccgggtgaaccctatatttacggtagacaagagtgggatcagaatagacctcatggcggcagcagatggtgggagctgactggtgatatatccaagggaccaaatgatgtgccggatgctgaacttctgatagctaagaaagatccttactctgcaataactgctgtatctgattctggtggacaacataatcttcaacc

SEQ ID NO: 70290 - DNA, 440 bp, Zea mays
  Clone ID: LIB3078-055-Q1-K1-F6
cggacgcgtggggaagttctacttcctactgccaacacggtccatcttcgctgcggctgctgctgctcggcatgctcctattattccacagcagcttcctcctgcaccgtatgcacatgcacgggcaggccgccctcgtttgtccgagtttcatgaccgctccttcgaaggtgattatgggcgggaggttgatgagattgggaatggtatcagtgaaactgggatgaggggaaagctggtaaagaggaacaagaagtcttctggcgacttggatatctatggtgggcatagaatcaatgtggaaccaatacggacgctaggtgaagacagtagatcagaaataagatcaaggcgtgacagggatattgacaaccaacaagcccttcaagcagaagataaggatgttgagtcatctgtggccacagtgttatctgatctct

SEQ ID NO: 70291 - DNA, 449 bp, Zea mays
  Clone ID: LIB3078-055-Q1-K1-F7
cttacacgttctcccacccacacggccacacgcccacacgcactgctcctctgatctgagatgctcatgcatcctcctaatgtaacctgaagctttaagaaaacacagtgctcccggaagactccaagctgcagctaccggccttcctctcccccattccaattccgagaacaggggcggcggagtcaaccaggtacaatgtgctcggtagcgaggctggcgtttgtgcttgcactggccatagccggctcatcaattacggttgcggagagcatagattttaatatctttgctcacggcagcttgcctgatgcaaccaagggatcgacaggtctagctgcaaccagtggaaagctgtgtcagttatgcgagcagtactcatccgaggcgctcctctatctgacacagaacgagacccagactgagattcttagcattctacaccatga

SEQ ID NO: 70292 - DNA, 359 bp, Zea mays
  Clone ID: LIB3078-055-Q1-K1-F8
gtccagaacctcatcaagggggtcaccaagggctaccgctacaagatgaggggggtggacacccatttccccatcaacgcgtacatcaccaactccaacaccgccatcgagataaggaactttctcggcgagaagaaggtcagaaaggtggacatgcttgacggcgtgaccatcctccgctccgagaaggtcaaggacgagcttattctcgatggcaacgacgtcgagctagtatctcgctccgccgccctaatcaaccagaaatgccatgtcaagaagaaggatatcaggaagcatttggatggtatctatgtgagcgacaagggtgtgatcgaagatgagcactgagggacaattag

SEQ ID NO: 70293 - DNA, 416 bp, Zea mays
  Clone ID: LIB3078-055-Q1-K1-F9
acgcggacgcgtgcggtggatctccgggagattcgtaggtgccaaagcagcacggagctgaggacacggaacctccctataagggcctggaaacggagatcgctctcaactgccagaccgatctcaggttccagtactccaccgactgtgttctgtatgaggccgtctaagcgtacctcgtggggctctttgatgacactaacctgtgcgccatccactccaagcgcgtcaccatcatgcctactgacatccaactcgcacgccgcatcaacggagacaaggcctgaacgatgcgagctcatctcactcaaggccccgtagttgctgatgcttacctgctagcaggacttgtgctcatcgcggttacctttgtgccatcaacgacatcttcgtgccactgtgcttgctcttagaat

SEQ ID NO: 70294 - DNA, 353 bp, Zea mays
  Clone ID: LIB3078-055-Q1-K1-G1
aagaacacctagatgaggtggtacttgaagaagtctactccagtgcctgctcatcaagtggatggagctatctaactaaaggttaggtataaggatctagaatctcttctctgcaacaaaggtgatgaggagtactctaagtgttcctgtggctggagggcgtttccagttctggaggaagactagttaggctagtgtataagctttggagggttcctaccgtcctgcttttgtaataagttatgcattttgagtatatcaggacttgtaataaatgtaactcttactatgtgtcaaacgatttttgtttgatttcaaactttaccagagtatgttcaaggtaatttggcacc

SEQ ID NO: 70295 - DNA, 411 bp, Zea mays
  Clone ID: LIB3078-055-Q1-K1-G10
cccacgcgtccgcgagaagagcaaggccaacaaggagctgaacgacaagaagaggctgggcaccagtggagccaactttgcgcgcgcctacaccgtggagttcggcagctgccagttcccctacaacttcactgggtgccaggacctcgccaagcagaagaaagtccccttcatcagcgacgacctcgagattgagtgcgaggggaaggagaagttcaagtgcggctccaacgttttctggaagtggtgaagcagctagcagcagcgtctgatgggaatggaggagatcatcacctgtcttgtcgaccctagatatgtccaaactgcagggaaattaaatcttcatgtgtaattgtgctcattctgtttcaatcatctcaacatccgatcatgaacctcttgcatttataa

SEQ ID NO: 70296 - DNA, 400 bp, Zea mays
  Clone ID: LIB3078-055-Q1-K1-G11
acgcggacgcgtacgcctacaaagcctgaaggtcaccgtttactgcaccggctactggaaagagcgtgagctgtccaacaaattctgcagcaccaaggaccctgtgcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgcgttcgagattgaagtactcagtgcccagtaattcgcatctgtcagctatggaaacgttggccatgcttctcaagtaatgaaataattcccgtgtcacctcatgctacatacagcagattggtgt

SEQ ID NO: 70297 - DNA, 326 bp, Zea mays
  unsure at all n locations
  Clone ID: LIB3078-055-Q1-K1-G12
ccacgctncgncaagcgtcgggattcacaggacctttaggctcaaggaggaccgcacagatggaggcgaacagcggctgccggagggaccatcgcccggcggacggcgttggctggcgaggcacagtcgacgcggcaaaggcggcggcaggcaaggagcccgtaagcccgggcactccgtcctcggtggccgccggccgcagcagctgtgaggagaggcgcgcggtggacggcgtcgccctgcctgggtggaagctcgacgccctctgccaggagtcctgcccgtcgccggccatgagggcgcgctttccctactacttctgaagc

SEQ ID NO: 70298 - DNA, 443 bp, Zea mays
  unsure at all n locations
  Clone ID: LIB3078-055-Q1-K1-G2
ggctctacaagcaagccacggttggagatgtgaataccgatcgtccgggcatattctgccaaggggacagggccaagtgggatgcctggaaggctgttgaaggcaaatcgaaggatgaggcgatgaatgactacatcaccaaggtgaagcagctccaggaggaggctgccgcctcttaaaagtctcttaatagtgttgccaaacagctatttgtcagatgagctttgtgccatttcctcattagaagtatatcattcgatccattggggatctgtgaaccatgtacctgtttatgtaactntttttttttcgaaagagcgcangaggactgcgcacccatatattaaagtagagggaaaataaagggccataatgatgatatccatctatctatctatgtaactggtttatgtaccatgtacctgtttatgtaactggttacc

SEQ ID NO: 70299 - DNA, 438 bp, Zea mays
  unsure at all n locations
  Clone ID: LIB3078-055-Q1-K1-G3
cgggaagcttgtgtaccagtacaccaagaagagggcgagcgggcccaagtgccccgtgaccgggaagaaaatccaggggatccctcacttgaggcctgctgagtacaaaaggtccaggttgcctaggagccgcaggactgtgaaccgtccttatggtggagtactctctggaattgctgttagggagagaatcattcgtgctttcttggtcgaggagcagaagattgtcaagaaggtcctgaaaatacaaaaaaccaaggacaagacagctgcaaagtaaatctccaggaatggggaagcctagccctgttttgtacactgcgaaaattaattttggtggatggaaaatctaggtgccttgttgagcatttagcatgtgagtttagagattctggacactgaatccctttcacctttgaatngttggaatatcgggaa

SEQ ID NO: 70300 - DNA, 391 bp, Zea mays
  unsure at all n locations
  Clone ID: LIB3078-055-Q1-K1-G4
ccatggtcggcttcgcctccgcgatcgccgtcgaggtggccaccggcaagggcttccgccagaacttgggcgtgggtactccggcgccgacgctggcgctggccgtgtcggggctcgtcgtcggcctcgccgtcttcttcctgctgcagtcgggaggaggcacgcgagactgacggctgatggaaccccatgagctgagagcacgcgcacgtcgaacatcgtctccccactcgacatcagttgctgtaatggttggtgaagtgaggatgaaaacccagggcatatatcatcatcatcatgtcatgtgtaacaaagacgataactctcatgtgttgttggtgttgtctgctgctgttgtacgacatccgccgctcgcttgtaaaaaanaaaa

SEQ ID NO: 70301 - DNA, 438 bp, Zea mays
  Clone ID: LIB3078-055-Q1-K1-G5
gctacgcatggccaccaccgcccgcccgctcgtcatcaacaaagacgctgacggcggcgagctacaagcgggcgcagtcgatgccgtcgaccccgacgacgccggtgacgccgtcgtcgtcgtcgtcgtcgacgacgccgagcggcgtcggcaacgtgtggcgcagcgtcttccactctgggagcatcctggccaccatgggcatgggcgccaacctgttcgaccgggcgcagcccaactccctcaccgtctactactggctctacagcgacgagaccaggagcaaccaccgctagatcgggcgagatggatgtacagtgaagaggccatgtttgctggtccttgtggttatctaaaacgcacgcatgctctattatagctagtcatcactatatatatacttgtgtttgtgtatcgttgatcttgttctgctggtgt

SEQ ID NO: 70302 - DNA, 423 bp, Zea mays
  unsure at all n locations
  Clone ID: LIB3078-055-Q1-K1-G6
gcaaggagcgggagttccccgggcaggtgctccgctacgaggacaacttcgaggccggcagcaacgtgtccgtcatcatccagcccacctccaagaaggccatcaccgagtacggctcccccgaggagttcctatcgcaggtcgactacctgctcggcaagcaggcctacggcggcaagaccgactccgagggcgggttcgagaccgacgccgtggccaccgccaacgtgctggagagctccacccccgtggtggacggcaagcagtactacagcatcaccgtgctgaccaggacggcggacggcgacgagggcggcaagcaccagctcatcaccggcaccgtctccgacggcaagctctacatctgcaaggcgcangccggcgacaagcggtggttcaagggcgccaggaagggcgtcgaga

SEQ ID NO: 70303 - DNA, 450 bp, Zea mays
  Clone ID: LIB3078-055-Q1-K1-G7
cccacgcgtccgcccacgcgtccgcccacgcgtccgcccggcgcccgcgtacgggagcgccgccgccgtccgtgacccgtactacgcggcgccgccggtgtacggcgggcagccgccgtacgccgcgccgccggtggggtacccggtcgacgctcctcctccctacggcggtggttatggctatggagctgctgctccgacggcgtacggcgctgaggctgctccactacctgcccagcagcagaagagcagcaagatggggatggggacggagctggccgtgggcgccgcggcggtgctgctgggcggactcgcgctggcggaaggtgcgagctacgtggaggacaagttcgaggatcgcgtctgcgagagggtggaggaggagacgttcggcgacggagactacgacgacgattactagaatgaagcatgtgggataggagatcatga

SEQ ID NO: 70304 - DNA, 341 bp, Zea mays
  Clone ID: LIB3078-055-Q1-K1-G8
ggaaaaagagcgcatgactgctgtgaataatattatcgggaccttcctcggacacaacatcgtcgacagtcacgacctacttctatacctagctgtgctatcatcttgagtcagtctatccattgtttgctcccagtctggtgattaaaagtctgcaaattctgtttgcggaattggcatgcgatacaaattaggcttctttaagtaaatccggttgccggtacacagctgtattaattcacctgtcactgaatggaataccgagatgcaaaaggcacatcactatgcctgactaaaataacacggtgaaggttcagccttgctgtggttgctaaacaaaa

SEQ ID NO: 70305 - DNA, 421 bp, Zea mays
  Clone ID: LIB3078-055-Q1-K1-F5
caaaaaccggcaaggggagcgaagcggacagtctcgagagcaagggagcgcggtgacgtcatcgttttccaaggtttctcgatcggctgctatggcgaccagggcggcgtcgagattcctgcagcgcaggctcctgtcttccggcggcaaggtcctcagcgaggaggagaaggccgcggagaaagtgtacatcaagaaaatggaacaagagaagctggagaagctcgcacgcaagggccccagctcaggagagcaaccttcagcgactacagtctctgcagcaagtgatgtgaagactggggctgggccaacagagtcagcgtctgcaaacgtgtctaccgacaagaacaggaactacgctgtcctggcatgcacaattgctgctctgagtggcctgggttggtatctattgtcaaagcct

SEQ ID NO: 70306 - DNA, 335 bp, Zea mays
  unsure at all n locations
  Clone ID: LIB3078-038-Q1-K1-C11
cttctacaaataactttacaaacgaatnatttccaactttaaatcttcaattaacctttcttttaaaatctcattcttttacacttttaccacttaaaaattcctaattccaaaatataaatataaatttaaatcatacatgctatacattatcattaactttcaatacataaattcttattatcacctaaaatatctcacttactaacattcaattctttccaaatcttaattccatacttaactttacttattttccttaaccttacatactttgtacaactaattcccaatgtatcctttcccaacacaattcttttcttatattctttctc

SEQ ID NO: 70307 - DNA, 375 bp, Zea mays
  Clone ID: LIB3078-038-Q1-K1-C12
gccatggcctccctctcctctgccgccgtcaccgccccttccttcgccgcaccggcaccagcccgcgccgtggtcagaaggaggtccttcaccgtgcgcgcctctctccgcaaggccaccggcaccgacgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaggtgccgagcggcgtcgacgccaccaagatctcgcaggaggagtacctcaacgcgccaggcgag

SEQ ID NO: 70308 - DNA, 161 bp, Zea mays
  Clone ID: LIB3078-038-Q1-K1-C3
ccgacgcgtgcgttgacccaaggactgaccatcagctaatcaatgaggctgctgtccagagcatggggaccattagcctatgtgacactgactatctaatgcagtacgtccatatcggcctacaaatgaacaacaagggcatgaacaccattagatgtctg

SEQ ID NO: 70309 - DNA, 216 bp, Zea mays
  Clone ID: LIB3078-038-Q1-K1-C4
gttggcttctcctccccctccggttcgggttcgggttcgtgagggtctcccgcgttcggggtcgggggtgatcgcatctagatggcggcgtccgatgttgagtaccgctgctttttcggcggcctctcctgggccacagacgaccactccttccacaacacctttatcacctacggcgaggtcctctagtccaagatcatcctctatcgggagaca

SEQ ID NO: 70310 - DNA, 201 bp, Zea mays
  Clone ID: LIB3078-038-Q1-K1-C5
gcgtccacgcgtacgtccacgcgtccgtgctcagcggagtcgtgttccagcccttggaggaggtcaagggggagctcgccctcgtgccccagtccccagacaagtcgctcgcgcgccacaagttcgtcgatgactgcgaggccgcccttaacgagcagatcaacgtggagtacaacgcctcgtatgcataccactccctct

SEQ ID NO: 70311 - DNA, 299 bp, Zea mays
  Clone ID: LIB3078-038-Q1-K1-C6
tttgacgtcctgtacaagattgctgatgctcttttcttggcaccctacaagaccaggatcagtgatgttatcgagaagggagagaagcaacccaacatcactattggcattctggtctccgttgtcgtcgtgttcgataccgatctcttcaagatcctgtttggaggcaacaagcccgtggcacctgtcaaacctgtatctgaagcgaagaagcccaaggccacagtgaccgactgtgcttgaagcagtggcgacaaagatgagaaagaagacgaaaaggacgagacagcatgcccact

SEQ ID NO: 70312 - DNA, 391 bp, Zea mays
  unsure at all n locations
  Clone ID: LIB3078-038-Q1-K1-D1
cccacgcgtccgcccacgcgtccggcgctccgaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctggcaagaccaccatactctatagactgcaaatgggagaggtcgtctccacgatcccgacaattggattcaacgttgagacggtgcagtacaacaacatcaagttccaagtatgggatcttggtggtcaaacaagcatcaggccatactggcggtgctactttccanacacncaggctatcatatatngtggtgattcaagcgatacagattaggcttgtaacagcaaaggaag

SEQ ID NO: 70313 - DNA, 406 bp, Zea mays
  Clone ID: LIB3078-038-Q1-K1-D10
caggacgatatgctgaacgcaaaggagctggtccaatgggagaatggcttgtgagttcagtgacatagcggctaggcaggggattcgcatccgcagacactgccgccccactgcctccttgaaggagatagaggaggagctgggagccccccttaacatcctagagaagatcatttgggacaaggagattgaagtagctgaggggcatgctaagaagcctcttgaggaggtgattcaggctgcaacgaaagcccctccttcaagagacttctatggcgctttagaagctgcctacaagcgtaatggggtgcctgcattgattgctgaggtcaagaaagcatccccgagtaagggtgtgctcagggagaactttaatcctgttgaaattgctcaagcttaataaaag

SEQ ID NO: 70314 - DNA, 143 bp, Zea mays
  Clone ID: LIB3078-038-Q1-K1-D11
gtggatgtcatattttgagctatgcctatttaaattaatacaataattaatataaatatataaaagtatatttttgccttatggaaatattttggattgttacactagtacatacatgtgaaatatggattttcacgtcgata

SEQ ID NO: 70315 - DNA, 380 bp, Zea mays
  Clone ID: LIB3078-038-Q1-K1-D12
attaggctctccgagtctccggttccctcctctcggcggcggctcaggtccctgtccatgtccggcgtggcgcttggcgtctgacctcaacaagcaagaaagcaaatggcaggcggcagggttgcgcatgccaccctcaagggcccgagtgtggtgaaggagatcttcattggactgaccctgggtctgatcgcgggaggcatgtggaagatgcaccactggaacgagcagaggaagactaggtccttctatgacatgcttgacaagggccagatcagcgttgtcgtcgaggagtaaagagttcttcccagttattttcaaagaactctctcgagagcatgacaaagtgattgcttgctgtggagatttgtcctggaaat

SEQ ID NO: 70316 - DNA, 281 bp, Zea mays
  Clone ID: LIB3078-038-Q1-K1-D2
ctgcgccctctccgtcgagtggctcaccggcgtcacctggcaggacgccggcggggtggggctgataaacggttcctgctacctgggccagccgatgtcgttctccatctcaacgctcatctcgatcgaagtgctcgtgatcggctacatagagttccagcgcaacacctagctcgacccgtagaagaggctgtacacgggcggctcctacttttacccgctcggactgtgggccagacctgagacgaaggagcggctgctgctgctggatatcaagcacg

SEQ ID NO: 70317 - DNA, 390 bp, Zea mays
  Clone ID: LIB3078-038-Q1-K1-D3
gtcacgctccactacacccagctccagctcgcgtcgggcgatatcaagtacttctaccaggcgcggaggagccagcgcgggctggcggtggcggtggtgggcgacaaggtgccgctgtacggcggcggttcgggcctgagcagcaccgcgactacgctgccgccgcccaggaagcgcgcgccggcggtggtggtgcctgctgacgccgtgccgctgcagctggcggtgcggctgcggtcgcgcgcgttcgtgctgggcaggctcgtcgcccccaagttctacaccgaggcgcggtgccgcgttaccatggaccagaccaggctcggcaggcccagtctccctcgtcaaggcctgcacctacactcactagctagcgtaacacacacacgc

SEQ ID NO: 70318 - DNA, 453 bp, Zea mays
  unsure at all n locations
  Clone ID: LIB3078-038-Q1-K1-D4
cagcaagagagcacagcaagcttgagctcagttgcaccatgggatcgttctccgcttgagatggccaaagacgagccgccgtatctgttggtcgcagttctcttcatcatcctgaaggccgcagcgcgcttggtacctgctgccatgtctcatctgagggccttcttggccgtccgtgtccagaacctgaacctagggatccgcaagggatcaagccaggtcttggaacgagccttgaacgcccttgacgtgaggaggctgtgcagcaagctggggctgagcaacagggcaacagatctgaggaaaggtgcaagcaatgctcgagcctgggcttnctcgtttgcttccgtctcactgggtgaaccttcatcttcgagacaagcttagcccattntttttggtttttttttggagatgtcccttgttagggtagctagctgctcacatgatgca

SEQ ID NO: 70319 - DNA, 450 bp, Zea mays
  Clone ID: LIB3078-038-Q1-K1-D5
catctggacagttttgatattgacagaactttgactttaataccgcccgatggagaattgcctgtaatgaactaccgtatgacccaagaatttaagccaccattccgtgtaaccgcactaattgaagaagctggaccagcgagggctgaagttctactgaaaataagagctgacttctccgcgagtgccactgctaacacaatcgtagtacaaatgccagtgcctgcatacacaatgagagcgagttttgagttggaagctggagcagttggacagacaaccgattttaaggaaggatccaggagacttgagtggaatctaaagaagattgttggtggttctgagcacacccttcgtgcaaagctgacattttctcaagagtcacatgggaatatcacaaaagaagcttgcccagtgaacatgaatttcactataccgatgtacaatgca

SEQ ID NO: 70320 - DNA, 141 bp, Zea mays
  Clone ID: LIB3078-038-Q1-K1-D6
cagcacgatatcacaccaagctttcacttacttgaaccatgagaacgccctccgggtgggggttctatacacgtgccgctacctttgccaatcgctggcctttttaatattcacaatgacttagatcgatgggctcctgat

SEQ ID NO: 70321 - DNA, 397 bp, Zea mays
  unsure at all n locations
  Clone ID: LIB3078-038-Q1-K1-D7
cccacgcgtccggcgaaggccccgtcgagaacctcgccaagcacctcagcgaccccttcggcaacaacctgctcaccgtcatctccggcgccgccgagaggacgcccagcctgtgaggacgcgccacaagccggcagcgatgccaagtcatgcgctgctgccgtccttgattttaccggggaaagagctgtgtgtgagggtctgaagtgaagaacgtgccatgcccatgcgtgtacattatcgagagggggaagaaaccttctcattctgatctctgatatgactgctgcttcagattgcgcctgagatatgctaagtttttgaaagctaattagttcgtgcacattaagggtgcgtttgagttggattatttgtgaatgctagctnattttaactt

SEQ ID NO: 70322 - DNA, 179 bp, Zea mays
  Clone ID: LIB3078-038-Q1-K1-D9
acgggtatctgcctgacacaattgcctttttcttgttcaactctcatgttacaccatgagctattgtactaaccagacatggtcagagtttacataatgttagatgaagaatcgctagtaatacaattctaaattaaactgtataactttatgtacagatactatttaactttatataa

SEQ ID NO: 70323 - DNA, 310 bp, Zea mays
  unsure at all n locations
  Clone ID: LIB3078-038-Q1-K1-C10
gcgcgggcgcgtgggggagctcggacaaggcatcgccatcgntcggtttccttgctgaattcgtgaactctcacccgctcgaaaagaaagaagctagcttttagcatggcgtctctggcgttcggcagcaccgtagcggcggccgtggcggcgacctcggggaggacgcggccggcgcgccggtccgtgctggtcgtgccgcccgctgccagcaagggcggcccggcgccggccaatgaagagaaaggcctcggcgagaccatcttcggcttcatcttcaagaaagaccaacttgtggaaacggacccgc

SEQ ID NO: 70324 - DNA, 431 bp, Zea mays
  Clone ID: LIB3078-038-Q1-K1-E10
cgccgccgcagccatccgcttcttctcttcggttcagctctcgagtttccaggatgaaggtaatagctgcctacctgcttgctgttctgggtggaaacacttccccgactgctgatgatgttaagagcattctggaatcagttggtgctgaagctgatgaagaaaaactagagttcctgctcacagaactcaaagacaaggacataacagaagtgattgcagctggaagggaaaggttatcctctgtgccttcaagtggtggtgcaattgacatgggagctccagcagctgtagctggcggtggcgcagcacctgctgaagaggcaaagaaggaagaaaaggttgaagagaaggaagagtctgatgaagatatgggtttcagcttgttcgattaaaacaccactgccaagttacaagttctctcgcgaatg

SEQ ID NO: 70325 - DNA, 311 bp, Zea mays
  Clone ID: LIB3078-038-Q1-K1-A3
tgggaaagattgacaaaacccgggctggtgtgcttgtgggcactggtatgggtggcctcgcggtgttttctgatggtgttcagaatctcattgagaagggctacagaaaaataactcctttcttcatcccatatgctataacaaacatgggttctgccctgcttggaatggatattggtttcatgggtccaaactactccatctcaactgcctgtgctacctcgaactactgtttctatgctgcagcaaaccatatccgtagaggcgaagcggatataatgatagctggaggcactgaagctgcaattatt

SEQ ID NO: 70326 - DNA, 398 bp, Zea mays
  unsure at all n locations
  Clone ID: LIB3078-038-Q1-K1-A4
gcaggtgttcgagatgcccaccggcggcgccgccatcatgcgggagggccccaacctctggaagcgggcgcgcaaggagcagtgcctggcgctcggcaccaggttgcgctccaagtacaagatcacctaccagttctaccgcgtcttccccaacggcgaggtgcagtacctccaccccaaggacggcgtctacccggagaaggtcaaccccggcagggagggcgtcggccagaactttcgcagcatcggcaagaacgtcaaccgcatcgacgtcaagttcaccggcaaggccaccttcgactaatcacactttacgtacgccgtacgcnccagccgggatccaaattaaagaacttcttcttctattaattacagtatattgtaatttggcttgctgt

SEQ ID NO: 70327 - DNA, 400 bp, Zea mays
  Clone ID: LIB3078-038-Q1-K1-A5
ccgggtttctgagcatcaaccgcgcaatgagccttgacagcgtggaggttgatctgagcgaggagcttcaggcgccgaccaggccaatcttgcaaacccaggttgaggctgcctggagaggacgggcaattggtgctgaggctgtgaatggagccagcgctcctagatggaggctagtccctactcgcagggagcaggcaaagtgggacagagcggccaaggcagccactggtggaagtgatgttatactaagggagtcaaagtcaagagtgcagcaaggagaccctaaggtattggcagctcggtccagagaagactacttacagctgaaacaaagattacagtggttcactttaggcattggtggcgttggtgtaatctctgcttatatttcatacac

SEQ ID NO: 70328 - DNA, 433 bp, Zea mays
  Clone ID: LIB3078-038-Q1-K1-A6
cgaccaaccatatatcaagttgtcaaggaaatgattgataaaatgggctatgaggtaaaacttgttcgggtaaacaaaagaattcaagaagcgtactgtgctgaactttgtctaacaaagattgatgattctacagacagcatcaccttcgatcttcggccttcagatgccataaacattgctgttcgttgcaaggttcctgtacaagtccatagaagtcttgcatacagtgacggcatcagaccagtcgagccagcaagaatggcagtagcagctggcctatcagatgggttgttatttacagagcttgacagacccgatggacaggcatctgttgaagctcaagagtttggattggtgaagaacatgctcattgcaaccgtagaagagagatacaaggatgctgcatcatggaaagacaaactgatgcggc

SEQ ID NO: 70329 - DNA, 446 bp, Zea mays
  Clone ID: LIB3078-038-Q1-K1-A7
tggaaaagattgacaaaacccgggctggtgtgcttgtgggcactggtatgggtggcctcgcggtgttttctgatggtgttcagaatctcattgagaagggctacagaaaaataactcctttcttcatcccatatgctataacaaacatgggttctgccctgcttggaatggatattggtttcatgggtccaaactactccatctcaactgcctgtgctacctcgaactactgtttctatgctgcagcaaaccatatccgtagaggcgaagcggatataatgatagctggaggcactgaagctgcaaatattccaattggtgttggtggctttgttgcatgtagagcactgtcacagaggaatgatgacccttatacagcatccaggcccttgggacaaggatcgtgatggttttgtcatgggtgaaagagctggaatcctgatcat

SEQ ID NO: 70330 - DNA, 250 bp, Zea mays
  Clone ID: LIB3078-038-Q1-K1-A8
cccacacgtccgaggacgcgtgggcggacgcgcggggcgagccgcaacttgtggtctatggctcgcaaggaaactagtgtgaatctgtagtgcatgccaggactaataacctggatgagactgacatttctaccgtgtcactcgcaactgcagataaccattagctacatcggagggtacagttcatacccgtatatagcgtaaatgtgatgtaaatgcagtgggcatgacttccgcaaagtaatcctga

SEQ ID NO: 70331 - DNA, 365 bp, Zea mays
  Clone ID: LIB3078-038-Q1-K1-A9
aaccaaaacaaaaacaatggcaatgttccaaaatacacattgcctttccaatttaccaacaatgacatcacaccacaaatcatctctactaatataacacctgatattgttcttgcttcttcctactctcattaattaccactatataatcttgaaattcatcttaccaactatacaccttcctactacactctccttctcttttctctccatattctcaaaacccattctttatataacgaatattacttcaattataataccactttttaagatttctcttcttacccatcttattataacaatccttaccctactctctttaattttaaccttattactactaccacttttaacccaatctt

SEQ ID NO: 70332 - DNA, 373 bp, Zea mays
  Clone ID: LIB3078-038-Q1-K1-B1
attcgggccggatgacacgccgtgggacggaggcacgttcaagctgactctgcaatttacagaagattaccccaacaaacctgcgactgttcggtttgtttcgaggatgtttcacccaaacatttatgcggatggaagcatctgtttggacattctacaaaaccagtggagtcctatatacgatgttgcggcaatattgacctctattcagtccctgctgtgtgacccaaacccaaattctcctgccaactctgaagcagccagaatgttcagcgagaacaagcgtgagtacaaccgcaaagttcgtgaggttgtggagcagagctggacagctgattaaaactttagagctggacaggcgattaaaacttta

SEQ ID NO: 70333 - DNA, 232 bp, Zea mays
  Clone ID: LIB3078-038-Q1-K1-B11
ccttccttactaatatcaacctgtacgtgaccgaccttgtggcactgtctagcagtcacaccgtgggcatctcgcactgtagctccttcgacaaccgtctgttccctacgcatgacccgacactgaacaagttcttcgcggtgcagctgtaccggacctgcccgaccaacgcgaccgtgaacactactgccaacgacgttcgcacgcccaacgccttcgacaacaagtacta

SEQ ID NO: 70334 - DNA, 345 bp, Zea mays
  Clone ID: LIB3078-038-Q1-K1-B12
acgccggctgctaatcgacatctatgtcatagtttgacatccgctccaactgggatggaaattgcgtttgtggaagttcgtaaacatgggctgtggcttttggctaaaaatgtgaaacagtatatccacagaatacttgttgaggctgacttcagtgctggaactggtgatgatttatgggctgctgtgggcgaagctggtaaaaacctttacgcttaaggcgaattcaaagagtcgcaagttgcaaaccttgatgtctatttggtgaaaaagggttggacttttccctgatgttataaagaagaaaacattgcgccatcttgaaaaatgagataatgtcttaac

SEQ ID NO: 70335 - DNA, 372 bp, Zea mays
  unsure at all n locations
  Clone ID: LIB3078-038-Q1-K1-B2
aagaaaactagaaaaggctcctcccgaccgcaacgcccctcatctgcctcgaccccgacgtccccgagccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctncaaggccatgtccatcatgaactccttcatcaacgacatctttgagaagctggccggcgagg

SEQ ID NO: 70336 - DNA, 286 bp, Zea mays
  Clone ID: LIB3078-038-Q1-K1-B4
cggacgcgtgggcggacgcgtggggcaaatcaagcaagagatagacaagcagctccagtggaaccatgaacaaacaacaaccgcagcatgaggagaggaggctcaccggtcgcgaccaaattctcccagagacggtcggaaatgaggagccaagcgctgttcttcctcacgatcgcccttctcaccgtgctcgcgcgatccagcaacaggcaccaccaccaccactcccacgttcaaagcagagggcagggagcagcatcaggaggatgaggaggaagggagctgg

SEQ ID NO: 70337 - DNA, 307 bp, Zea mays
  Clone ID: LIB3078-038-Q1-K1-B5
gctgccacgagatctgcgcgccgaagaacggcgagaccgtgttcgtgtccgccgcgtcgggcgccgtctgccaggtggtgggccagttcgccaggctcgccggctgccacgtcgtctgcagcgccgtgtcccgggagaaggtgcagctgatcaagaccatgttcggcttccacgacgccttcaactacaacgaggagcccgacctcggcgccgagctcaagcgctgccttaacgactgcatcgacatctacttcgagaacgtctgcggcaccatgctcgacgccatgctgctcaacatgctcgtgca

SEQ ID NO: 70338 - DNA, 366 bp, Zea mays
  unsure at all n locations
  Clone ID: LIB3078-038-Q1-K1-B6
cccacgcgtccgcaaagctgatgcagaagcgaaggcgaaaaaactaaaatcaagaaagcagangaggagaggagattcttcctcggactctgacagtgactatgacagcgatgttgatcggaaacaccggaggaggaaggatcgtagaaggaacaagaagcatgagcattctgactctgatgatgccaggagacgcaagcataggtccagaaagggctcagactcaagtgatgagagcaaccgtgaatatgaaagcgggtctgaagaagaacgtacaaagaagaagcgttcgcacagaagaaagcatcacagacactctttaatgtcagactctgaagacaacagtgatgaggatgagcggagatc

SEQ ID NO: 70339 - DNA, 293 bp, Zea mays
  Clone ID: LIB3078-038-Q1-K1-B7
acggatccatccacgcgtccagtaaagggaaccttcacttagctaccaaactagcgattataggcctcacatcggtgatgggtcgtacatgtaacgagatctcaaaactgggagctgaagagcttaagacagctcataaggctgatggcatagcttgatacaacacatacataagatcatcacttccaagacgaagacgtctagcaattcatgtgtatggttgaaactcacatattgctgatgctgataaactccagcagctatcttgaactataatatatcacgtacaatca

SEQ ID NO: 70340 - DNA, 446 bp, Zea mays
  Clone ID: LIB3078-038-Q1-K1-B8
cccacgcgtccgggacaccttctggcccatcgtcgaggccgccggcgacaaggtcgtcgtgctcgacatgtacaccgaatggtgcgggccttgcaaagtgatggctccgaaattccaggagatgtctgagaagaacctggatgttgtgttcctgaagctcgactgcaaccaggacaacaagccgcttgcgaaggagctgggcataaaggttgtgccaacgttcaagatcctcaagggtgggaaggtcgtgaaggaggtgaccggcgccaagatcgacgagctagcgcaagccatcgacacagtcaagtcagactgacaaagaaagcaagtgatgcaactagctagtgtagacgatgaatgaatgagtccctggccggcatggctgctagatacgtacgtacgtacgtactcatcaacaattaatgatggatgatggcaattgcaaa

SEQ ID NO: 70341 - DNA, 121 bp, Zea mays
  Clone ID: LIB3078-038-Q1-K1-B9
cccacgcgtccgcgctgtgatatctggactaaatttcttgggaaggtcaagtggatcttgaaggaggcctgttatctcgagtagcactgatgcggttattaccgataattcccagctatta

SEQ ID NO: 70342 - DNA, 215 bp, Zea mays
  Clone ID: LIB3078-038-Q1-K1-C1
gtttcaactcctgagcactttctcctcgtcccagacaagccaatcgaagccgagatacggccatggactccaccggcaccggagcagggggtaaggggaagaagggagcggtcgggcgcaaggtcttcgggccaaggaagaaggcggtgtcaaagtacgtgaaggccggtctcaagttccccgtcggtcgtatcgggcgctacttgaataagggc

SEQ ID NO: 70343 - DNA, 438 bp, Zea mays
  Clone ID: LIB3078-038-Q1-K1-A2
gtctccatgttgcctgtcggccttatctccatccctcatcacctctgcgagcacaagttgtagcgcctgccctcagtccagctcgccagcagctctctgccctcctccctcaagccctagctgagtttttccatggtgctctggatgccagcccctttactcgatgcccctgctaggttccatggtcgtcgctgccccagccatctccttggtgaccgacctcgcccctgccccagccacagcttccccttcggccctattgctgcaagcactcagcctctcctatggcacatggtgctcatccagcccctttctactggtgtttgcaccatctctctggtgctcgacgaaatgaccatgatgaagtttgtgttgtgtgtagccccacctgcgacaccgtcgacccccggtgaggttctgttcttgccctgtcgcttt

SEQ ID NO: 70344 - DNA, 411 bp, Zea mays
  Clone ID: LIB3078-037-Q1-K1-G3
gacagactgctatcgttctgttgatgaagcatatgaagatggaagaaatcggcttgaagctttgttatcaagattacattgcctcaatgtcccaacactttcttctggttctataaaactcaatgttgaaaactttggcccagtaatgcaaaaatcaacgatgtcaagcgaagaatataaaaatatcgttgtccaagctaaagaacacatcttggccggtgacattttccaagttgttttaagccagcgttttgagagacggacattcgccgacccctttgaaatctatcgtgcattgcgcatcgtaaatcctagtccatatatggcctatctacaggcacgaggttgtattctcgtggcatcgagtcctgaaattcttaacccggtacaaaagaggacaataatcaatcg

SEQ ID NO: 70345 - DNA, 390 bp, Zea mays
  Clone ID: LIB3078-037-Q1-K1-G4
cccacgcgtccggccatccacaatctccgtcgaggtgaagccgcctgtaaagcaaaaggtcagctcgacgccattcaaaactgtggtggagaacttctacatgactgatgcaatcactcgagcttcgaagattatggcccaatgcagtgcgacattgctgaagaagtgagatttgcacccttcgagctaatcttcagcaaacaacttcttagttccctcccttttttttttttacttgctacgagtttcgccaccgttgcttgttttcttgggaggttttggtgtataatttggactgcctctagattttcttcagagcagcaaaacctgatcagtacatctccgtgctgtgtatgagaagcagagcatactcaataagcttgttgcccc

SEQ ID NO: 70346 - DNA, 446 bp, Zea mays
  unsure at all n locations
  Clone ID: LIB3078-037-Q1-K1-G5
cggacgcgtgggcggacgcgtgggtggcacatcaaattggacaaaagtggagcagaagctggttgctaaaggaaccaatagaacatcaaggcttcaaataacaacgaacaaaaaaggagttgtttggcttgatcaagtatcactcatgcctgaagacacatacaagggacatggtttccgcacagaacttatatccatgcttttggatttgaaaccacgattcttgagatttcctggaggttgttttgtagaaggtgactggctaagaaatgcattcagatggagagagtcaattggtccatgggaagagaggcctggacacttcggggatgtttggcattactggactgatgatgggcttggatattatgagttccttcagcttgcggaggacctgngtgcttgcccaatctgggtattcaacaatggaataagccacaatgatg

SEQ ID NO: 70347 - DNA, 448 bp, Zea mays
  Clone ID: LIB3078-037-Q1-K1-G6
caaatacgccacagcttgggacgctttgagaaaagatgctgcagtattaactcaagatgtaacacttttggcagaagatgctgcacagaaaagcgggatcaccatcgaacaagtcagggataggttacggtcagtgttgtctttgactgatgtcactcgatttccagtcccaaagaacccacaggcggtcatctttgttggtgcaacggacgatggttatattcccagacattcagtgatggagctccagaaggcatggccaggctcagaggtccggtgggtaacaggtggccatgtctcctctttcttcctccacaacgatgcattccgcaaggccatcgtcgacgcccttgatagattgtaacaccagaaggtgagagagaggccatccttgtgatggcacttttatgtgtgtgacatttctgaactttgggttgccgcatgagct

SEQ ID NO: 70348 - DNA, 228 bp, Zea mays
  Clone ID: LIB3078-037-Q1-K1-G7
caaacgcgccacagctcgagactcttagagatttgatgctgcagcattaactcaaggtgtaacaggttacgtcagctgatgctgcacacaatatcttgatcaccattaaacaagacagggatagactactgtcacagttatctataactgatgtaactccattcacagatctaaagatcccactggccaacatatataacacatcttcggacgatacatttatcaaga

SEQ ID NO: 70349 - DNA, 409 bp, Zea mays
  Clone ID: LIB3078-037-Q1-K1-G8
cccacgcgtccggaagaaggaaagaagcagtttattgaggcctatagtgcagcatattacccgtgcatggacatattgtatgagtgctatgaagacgtctcttctggaagtgagattagaagtgtggtgttggctgggaggagattttatgagaaggaagggctccctgctttccctatgggaaaaattgatcaaacacgtatgtggaaggtgggtgaaagggtccgttcaaccaggccacaaggtgatcttggcccactgcatcccttcactgctggagtgtatgttgcactaatgatggctcagattgaggtccttaggaagaagggccactcttactcagagataattaatgagagcctgatcgagtccgtggactcgttgaacccgttcatgcatgcttcgcgtg

SEQ ID NO: 70350 - DNA, 375 bp, Zea mays
  Clone ID: LIB3078-037-Q1-K1-H1
gcctctttgcggcgctgtccaagaaggtgatagatctcgatgaactgaggatgctggcggctcagggagtcccagacgcggcgggcgtccgagcaactgtatggaagctgctactgggctatctgcccaatgaccgctcgctgtgggagcaggagctggcaaagaagagagggcagtacgctgctttcaaagatgagttccttacaaaccctgtagaaagagcgcaacaggtgccaacagaaggccaccacaacgtaagtgcagagcatgttgacaatggcttcctgcacaggtcagaggtaacccgagaggagcaccctttaagccttgggaagaccagtgcttggaatccagtttttgagtactcagagatta

SEQ ID NO: 70351 - DNA, 457 bp, Zea mays
  Clone ID: LIB3078-037-Q1-K1-H2
cgctttcacacaaccttctcaagctaatatctcacaagccatttgtgatgaagatgatgagctcagagtattggatccaccagcccctgcatcagtgagcaaaagggcaaaaaatgttggtactggtaattcaagaacaagaattaacaagcgtacacaagatgggaatgtggttgagatgatgggaaggtttctagaaatgaaagaaaaacaagctgaggcggatgaaagggccacaactaatgcaaatgaggatgatttccctattcaaacatgcattgctattgtggatggaatggaagagttttctgatgatgagaaggttgattcttatgatgtgtttaaggatgcccaaaaccgggccattttcatgactgccaaagatgctacgcgcataaaatggttgaagaagaagattgcatgaacatgatatgatatatgaagctaaagtaatgaa

SEQ ID NO: 70352 - DNA, 473 bp, Zea mays
  Clone ID: LIB3078-037-Q1-K1-H3
gagaaaagtgactggactggatataaggaattaggtgcagagaaatctgggaagaatgctgaaggtgattcttggtgggagaagtggaaagaagtactgtaccaagatgaatggagcaatcttgcaagaatagagaagagtgctgaaaaacaagcaaaatcaggtgcagaaaatgctgggtggtatgagaaatggtgggagaaatatgatgccaaaggctggacagaaaaaggtgctcacaaatatggaaggttgaatgagcagtcgtggtgggagagatggggtgaacattatgatggccgtggatttgttttgaaatggacagataagtgggcagagacagacttatgcaccaaatggggggacaaagtggaagagaaattcttttgcaggattgggtctcgacaaggggagacattgcatgtatctcctggcagaaaacgtttgtcaagaacttggggagaagaacactt

SEQ ID NO: 70353 - DNA, 412 bp, Zea mays
  unsure at all n locations
  Clone ID: LIB3078-037-Q1-K1-H4
ccgtccgcgcccctctcgatggggggcttcgtcccgcaagggtcnttacggcatcctcgctggcgcagnnctgctcctcacgcgaccgccgtnnctccgccctctaccgggttctccaaccccatccctcaatcgccacgcctcnntccgactccnnccgggcctcgcgcctcgtgcctcnngccgtcctgggcccttcatcctgggatgatcccattgtanntcattatcagcaccaagccacccacactatatttcgttttccctgggtnctgttcacagttgtgccttgagccnnntcagcatcggtnngtggcttgtgcctaaccacccaaggggannaaatcgttctggagggcctttagtggctgaccggcnntggcgtggtgnnngtttctctggacctggcgta

SEQ ID NO: 70354 - DNA, 399 bp, Zea mays
  unsure at all n locations
  Clone ID: LIB3078-037-Q1-K1-H5
cggacgcgtgggtggaggaggggaggggaggggagccgagcgcagaaccctaattacctccatggattgctaacagctcagatctcagaggcaggggaggtaaaatgccaagagcaaatgaaatgttcagggcagattctagaatgatggtggtttttggtgccttgacatcgaaaccagagcagctgacattcgaagaaaccctcagatttgtcaagaaagtgaaggcccgcgattacatgctatacctgtcattgttcgacattcttggcagaatggaactatcccagctcgatgcctaccgagagttacagctgctgtttggaaaccacccggatctgtgcgaagagctcgagaagttcaagccaccggtgcctacaaagcangcagcaaacaaca

SEQ ID NO: 70355 - DNA, 415 bp, Zea mays
  unsure at all n locations
  Clone ID: LIB3078-037-Q1-K1-H6
cccacacagaaaaccctagccgccgccaccgaagcggcctcccaggtaagcaggagcgtccagcccgccgccgccatgaagcgcaatccccgcgtcacgagctcccgccggaagtgccgcaaggcgcactttacggccccgtcctccgtccgccgtgttctcatgtccgccgggctgtcgacggagctccgccacaagtacaacgtgcgctccatcccgatccgcaaggacgacgaggtgcaggtcgtgcgcggcacctacaagggccgtgaggggaaggtggtgcaggtgtaccgtcgccgctgggtcatccacgtcgagcggatcacccgcgagaaggtgaacggctccaccgtgaacgtgggcatccaccccttncaggtgatcgtcaccaagctggaactcgacaaggacc

SEQ ID NO: 70356 - DNA, 451 bp, Zea mays
  Clone ID: LIB3078-037-Q1-K1-H7
ggcgcgttgggctgcgtgttcccggagctgctcgcccgcaacggcgtcaagttcggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgaggggtaccgcgtcgccggcggcccgctcggagaggtcgtcgacccgctctaccccggcggcagcttcgacccgctcggcctcgccgacgaccctgaggccttcgcggagctcaaggtgaaggagctcaagaacggccgcctcgccatgttctccatgttcgggttcttcgtccaggccatcgtcaccggcaagggcccgctcgagaacctcgccgaccacctcgccgaccccgtcaacaacaacgcatgggcctatg

SEQ ID NO: 70357 - DNA, 313 bp, Zea mays
  Clone ID: LIB3078-038-Q1-K1-A10
cccgcgcgtccgcacggagcccaagaggctttcatacaagcccctgcgtctgcccctccggtatgtgtacaagattggtggcgtcggaactgacccggacgaacctcttcatactcggcttctggcggcgttcttctaagcctcgcctcggcttaatggggccttttggaactcatcgcgggatctgcttgagttgacaaagcatggcatctgccttctcgccattcttgtcatctttgtcgggacaatcatgcctatatcattgactggccttttaatcttcatgttctttctgctaattgccacttctaat

SEQ ID NO: 70358 - DNA, 270 bp, Zea mays
  Clone ID: LIB3078-038-Q1-K1-A12
cccaacctggttcacgctcaaagcatcctggccatctatacgtgccgggtagaactcatggggttcgtcgagggctaccgcgtctgcggctgcccgctcggggaaaggctctacaaggtgtaccccggcggcgccttcgacccgctgggcctagccgacgacccggacaccgccttcgagctcaaggtgaaggagctcaagaacggccgccttgccatgttctccaagttcggcttcttcgtgcaagccattgtcaccggcaagggcccc

SEQ ID NO: 70359 - DNA, 409 bp, Zea mays
  Clone ID: LIB3078-037-Q1-K1-G2
gccaagacgaaggcgtcgcagctggtggggcgcttcctggccgcgtccgagccggccgtgtccgtgcagctcggcgaccacggccacctcgcctactcccacaccaaccaggcgctcctccgccccaggtcgttcgcggccaaggacgaggtgttctgcctgttcgaaggggtgctggacaacctgggtcgtctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactccctgctagtcgcatccgaccccgagggcagggtgccgctcttcttggggatca

SEQ ID NO: 70360 - DNA, 434 bp, Zea mays
  Clone ID: LIB3078-052-Q1-K1-F1
tgattatgctgcgaggatgagagaagatgacaagaagatgccatcattatggagccctgagaattcagctcttgcttctgagccatatcagatgagcagccaaaaagccctatgaagcgtttcatgtgcgaagactgaagatgctggatctggaaagatggacgacatgtagactgctactgaaaagagtgaagaatcgggtactgaatctggagaggaggtacaaacacggactgaatcaagcacaggtgagcataaaaacttgcctggagaagataatgccccagcagataaaagtggcctttaatctgatctccgggtatcaccatgaaacataaatgtgaaacattgataggagctctaccacatttcactaaagtttgaacatgaaaggcgacgagaaactgttttacacggcatatcggcatgcctga

SEQ ID NO: 70361 - DNA, 270 bp, Zea mays
  unsure at all n locations
  Clone ID: LIB3078-052-Q1-K1-F10
accgaattccctgcgattcctctcccctctccttctcgtctccccctaggggatcgtcggagaagaatcgcaaagaaggccgtctcatccgagttaaggaagccatggagcacaaggaagcttggtgccaagcccccgagggacccatcctctgcatcaataactggggcttcttcggcagcgccgcgaccatgaacatgtgctccaagtgccacaaggagatgattacgaagcaagatcaagccaagctggctgnctnctctatcgaca

SEQ ID NO: 70362 - DNA, 463 bp, Zea mays
  unsure at all n locations
  Clone ID: LIB3078-052-Q1-K1-F11
ctcgtgctctgttctcatcttctgctcgctggtgtcccctctctctcacccatggcttcggcggcggcggcaactcaagtggggacttacttcctgcggaactactacaacctgctgcaacaaacccccgatgtcgtccaccagttctacagcgaagccagcaccatggtccgcgtcgacgacctcaccggcaacaatactgcaacaaggagctgtcgttcagccattgccaagccgagagcagaagcagaagagaaactgagaagaacccagcttagatcagactgaagaactagatgcggtggacgccttcaagacctgctgacatgagggctgctagtcagagctgctgtttttggcctgttctttgacatgagggtacccaaaaactctagttgctcgtgggtgtcaactttntattatatgttgttatgtttgtgcaaaatcaactgaaaatggtgaa

SEQ ID NO: 70363 - DNA, 139 bp, Zea mays
  Clone ID: LIB3078-052-Q1-K1-F12
cccacgcgtccggcaatccacacaagcactttgacgtcacacgggcgcttcgcacaaacgcaccaaacggccgcaccaatgggttactaccaagaaggggactactggtccgaagaagtgaagtccgtggcccccggcc

SEQ ID NO: 70364 - DNA, 309 bp, Zea mays
  Clone ID: LIB3078-052-Q1-K1-F2
cccacgcgtccgccgagctgctctcccgcaacggcgtcaagttcggcgaggccgtctggtggaaggccggctcccagatcttcagcgagggcgggctggactacctgggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgacccactaggtctggccgacaacatcgaggcctttgccgagctcaaggtgaaggagc

SEQ ID NO: 70365 - DNA, 150 bp, Zea mays
  unsure at all n locations
  Clone ID: LIB3078-052-Q1-K1-F4
tggtggtcgttcgtgatcgcggaggtcgtcctcgtcggcggggccgagtactaccggatcatcaacggactggacctcgaggacaagctgcaccccggtggccccttcgaccccctgggcttggccagcgaccccgaccaggccgncatc

SEQ ID NO: 70366 - DNA, 432 bp, Zea mays
  Clone ID: LIB3078-052-Q1-K1-F5
cgacgaggtgaggtgcttccacctcgagggtgggggcggcggcagaggcggcggcgtggtggaggccgtgccagagaggttcgacgacttcgatgttgtgttcgtgtgctacttccctggaatgggagtctccgcgggggcgctcctcaaatcgctggccaagaggtgctcaaaaggtgagacctgttgaaacggcaccttatcctttcttagcttgttgtttcttgtttcagacttccagtggactgagcctgaggtggttagaaggatgcggcttattacgctgtgcattgcgtttgctaaatcacaactaaatcatttgagatggcaaattggtggggtttagagttgaggtattgattgatcagattggttattatgaggctgttgttgccagatatcatattgcatcaagcccctaacatatacttg

SEQ ID NO: 70367 - DNA, 409 bp, Zea mays
  Clone ID: LIB3078-052-Q1-K1-F6
ttcgcttcgaagcacggctgctcctactacaaggaggtaatggagaagaacaagcagtgcgtcgttcagccccccaccgtcgagaagtgccaggagctctccaagcagctcttttacacccgcctcgcaagcctaccaggtcgctatgagtcattctggaaggagcttgattgtgtcaagcaggtatggaagaacaggaaggacctcacggtcgaggaccttggcattgcgagtttatttggagttgagctctatgcatggttctgcataggcgagattgtcggcagaggtttcaccttgaccggctataaggtctagatgatttccactggtcaagacctgctttataatggatactcttagctgatgcttgttgaaacgacgacgatggtacctgccttggttcaca

SEQ ID NO: 70368 - DNA, 432 bp, Zea mays
  Clone ID: LIB3078-052-Q1-K1-F7
gcaggaggacaagtggtggttgccctgtccaagagtgccgcccaaggggctgtctgaggacgcgaggaggaagttgcagcaaagcagggattgtgcaaaccagatactcaaggcggccatggcgattaacagcgatgtgctcgccgagatggaaatccccgaagtgtacctggagacactgcccaagaacggtaaatcttgcttgggtgagataatttatcgatacataacagctgagcagttctcaccagaatgtctcctagattgcttggatctatcatccgagcaccacacacttgaagtggcaaacagaatagaaggtgccatccatgtttggaaactgaaaggccaaaaaaagtcgacacctcaagccaaatcaaagatatcttggggtggaaaagtgaagggtcttgttggagataaggagaagag

SEQ ID NO: 70369 - DNA, 446 bp, Zea mays
  unsure at all n locations
  Clone ID: LIB3078-052-Q1-K1-F9
atttgctgttgttctagaggtctntgaagttgctccttctctgttcatggtcgatgttcgaaaggttgccggtgacactccggaataccacaggttttacgagaacctatgcagcaaactttgcagcataatctggaggccaaccgaagtttctgccaaatctacgccgctgaggacgaccacctgctagccgcctagcccagcactgagctactgtagtggcatcaccaagagacgtgattcgtagccgtcagaaagggagagcttctgttgaatctagcattgctcgtggagctgggattcatgttgaccaccaggtgtttgtatattgtagtaacgctattgtagatagtctgtatagctccatttgtgcagttgtacgtagcaggaatatgttaaaaaacaacttttaatgtcaggtataatcggtttgcatccaggaagca

SEQ ID NO: 70370 - DNA, 336 bp, Zea mays
  Clone ID: LIB3078-052-Q1-K1-G1
gttatgcctgcctacacttatccgacgttcctatcactagctatataagaccaaatctgtggggaccaacgatgagctgatgatccatgccaagctcccaattgatatgcagcccgccaaggtgtacgactaccgggagctgttaccctagatatctgtcatgctcttctacagcatgaacaccatcgatgtcgacgaggtcacggtcgatatcgtcaagtttcagaagctcacagacgaattgacaatgctgaacctaatgggacagatacctgcgactgttgacgacagattcaaactattttaaagcaatgcgattttcaggtatcttgcata

SEQ ID NO: 70371 - DNA, 271 bp, Zea mays
  Clone ID: LIB3078-052-Q1-K1-G10
ggcacgccgacctcaaggacgcgccctgttggcccaagatgcagaccgtggccgaactggtcaaggcctgcaccaccatcatctggatcgggtccgcgctccacgcggccgtcaaacttcggcagtacccgtacgccgggtaccttccgaaaccgccgtccgtcagccggaagccgatgccgacgccgggcagcgacgagtacgcggagcttgagcgcaagccggaaaaggtgttcgtgcgcaccatcaccagccagttccaggccctcgt

SEQ ID NO: 70372 - DNA, 60 bp, Zea mays
  Clone ID: LIB3078-052-Q1-K1-G2
agcgaaccctagccgtactcagcgacttattttagatctcctatccatgacgttcaagcg

SEQ ID NO: 70373 - DNA, 56 bp, Zea mays
  Clone ID: LIB3078-052-Q1-K1-G3
accacgcgtccgcccacgcgtccggcttactatgttaggtgccatactaatcatgg

SEQ ID NO: 70374 - DNA, 436 bp, Zea mays
  unsure at all n locations
  Clone ID: LIB3078-052-Q1-K1-G5
cccacgcgtccgcccacgcgtccgcccacgcgtccgcccacgcgtccgccggcatctgtgcctcgccatctgcagcgcccagcaccgctcggcgccgccatgacgcagcgccgcagcagctgagggtgaaggcggcggcgcggccacagctgctgcacgccggccgccggcgttcgagtgtcgggaggaggccgggcggcggcgcggtggtggtgagggccgggcctgggccgctgtcggagatcgagccggacctggaggaggacgccatcgacgtgtaccgcaccaacggcatcagcccggaggacttcgagtacgggaagtatgacggacaccacacctatttcgaaggccaagacaagaagggcttctgggaggatgtctccgagtggtaccaagaagctgagcctnctcagggctntcaagcactcatctc

SEQ ID NO: 70375 - DNA, 239 bp, Zea mays
  Clone ID: LIB3078-052-Q1-K1-G6
cccacgcgtccgcccacgcgtccgctatacacaagatttagaccactacaaacaacagaagtgccacaaaagagaaagtaagcaagagagagctactcatttgagtttagcactagtgccttgtgagattcattgagagatagtgtgtgctacatatttgggttcattggtgcatggattttggactccaatggaacttcttccgaagttttggaggcttggtaaaagctatcaacacc

SEQ ID NO: 70376 - DNA, 423 bp, Zea mays
  Clone ID: LIB3078-052-Q1-K1-G7
atcggggagatggagcaggagttcctctaggcgatgcaggctttctactacgaaggcagggcgatcatgtcgaacgaggagttcgacaacctcaaggaggagctcatgtgggaagggagcagcgtcgtgatgctaagtccagatgagcagaagcttttggaagccgccatggcgtatgtctctggcaaccccatcatgacggatgatgaattcgatcaactaaagctgagactaaagaaagaaggaagcgacattgtacaggaaggtccaagatgcagcctacggagtcgaaaggtctacagtgacttgactgttgactacttcaagatgttgctcttaaatgttcccgcagctgttgtagctctggcactattcttctttttggatgatttcacgggatttgaaatcacatatcttctcgag

SEQ ID NO: 70377 - DNA, 327 bp, Zea mays
  Clone ID: LIB3078-052-Q1-K1-G8
gtgagcgcaggaggaagtctgtccgtgtttgcatcgtgagccaagacctatctgttagcaacttggtgattgtgaagaagggtgagaatgatctgcctggtctgactgacactgagaagccaaggatgaggggtcccaagagggcctccaagatcagaaagctgttcaaccttaacaaggatgatgatgtacgcaagtacgtgaacacataccgcaggacattcactaccaagaacggcaagaaggtcagcaaggcacctaagatccaacggcttgtgacacccttgacccttcagaggaagcgtgctagaatcgctgacaagaaga

SEQ ID NO: 70378 - DNA, 458 bp, Zea mays
  Clone ID: LIB3078-052-Q1-K1-G9
cccacgcgtccgcggacccctggacgctgttcgtgtcgcagatggcgctgatgggtgggcggaggggcggcggtgggcggactacctgaggcccgggtgcgtggacatcgagccgcgcttcccgaaccgcaagaacccggtgcccgacgtggggtaccccggggggctgtggttcgactgggccaactggggccgcgggtccccggagcccgtgatggtgctgcgcaccaaggagatcaagaacgggcggctcgccatgctcgccttcgtcggcttctggttccaggccgtgtacacgggccagggccccatcgacaacctgctcgcgcacctcgccgaccccggccactgcaacatcttctcggcattcacgtcccactgatccgatgttgcttcggagctggcggagagaccgcgaagaataaaaaaaagggcattctgttgagggagaaagaaac

SEQ ID NO: 70379 - DNA, 447 bp, Zea mays
  unsure at all n locations
  Clone ID: LIB3078-052-Q1-K1-E9
gccgagtcgaagaaggagctngatgcgcttcttgcagatgactcccttgcaaacgttccggtcctcatggtgggcaacaagattgacatgccatacgcggcttcagaggaggagctgaggtactacctcggcctgagcaacttcacaaccgggaagggcaacgtgaacttggccgactccaacgtccgccccctggagatcttcatgtgcagtgtggtgcgcaagatgggctatggcgaaggcttcaaatggatgtctcagtacatcaagtgagtcgctgctgtcctcttttgtccatggcgctgctgctttcgcaggagggttgaaatcaagtctggtcgtgacatggcagctgcatggaaaggtttatggtagctagtgataggcaaagcttgtaagtcggtgttaatcctagatatgtgatgtggggtctactttctcttctga

SEQ ID NO: 70380 - DNA, 419 bp, Zea mays
  Clone ID: LIB3078-052-Q1-K1-D3
ctccaccgccgttcgaatattccaagcttgatattggaggaggaggggaggggagccgagcgcagaaccctaattacctccatcgattgctaacagctcagatctcagaggcaggggaggtaaaatgccaagagcaaatgagatgttcagggcagattctagaatgatggtggtttttggtgccttgacatcgaaaccagagcagctgacattcgaagaaaccctcagatttgtcaagaaagtgaaggcccgcgattacatgctatacctgtcattgttcgacattcttggcagaatggaactatcccagctcgatgcctaccgagagttacagctgctgtttggaaaccacccggatctgtgcgaaaagctcgagaagttcaagccaccggtgcctacatagcatgcagcaaacaaca

SEQ ID NO: 70381 - DNA, 161 bp, Zea mays
  Clone ID: LIB3078-052-Q1-K1-D4
cggacgcgtggggtcgccgctctcgatcgtcttcaggaactgtgcctactactggacgttcggcgcttacattgcttactactgcaaccacccgctgtacaccccagcgagtgatctgcacatgaagattgcgtttggtttggggtcgtctgccaggtcgc

SEQ ID NO: 70382 - DNA, 362 bp, Zea mays
  Clone ID: LIB3078-052-Q1-K1-D5
gttttgctgacattgttgggaggaggtttggctcagcgaagctgccattcaatcggaagaagagctgggccgggagcatctcgatgttcatttctggtttcctgctgtccgcgatgatgatgctctacttctcaagcctgggttacattgatgttatctgggaagaggcacttggtaagctggcgcttgttgcactagcagcgacagtagtggagtgcgttcctgtgaccgaagttgtagatgacaacatatctgttcctttggccaccatgctggtagcttttctcttgtttagctccaaccgcacaatagttaattaaaatactactagtgcattatttaagacatgtgatgagttcttc

SEQ ID NO: 70383 - DNA, 417 bp, Zea mays
  unsure at all n locations
  Clone ID: LIB3078-052-Q1-K1-D6
atctattctccagtccacccattccattccactacccactcccagaatttacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagtggggtcgtgttccagcccttcgaggagatcaagggggagctcgccctcgtgccccagtcccctgacaagtcgctcgcgcgccacaagttcgtcgatgactgcgagggcgncctcaacgagcagatcaacgtggagtacaacgcctcgtatgcataccactccct

SEQ ID NO: 70384 - DNA, 407 bp, Zea mays
  Clone ID: LIB3078-052-Q1-K1-D7
cccacgcgtccgcgacgccaacaagatttgcgccgccgcgacgtcctccatctccatggcacagcagccactgccactgccagcagcctaccacgcgctcgagggctcgagcccggcgttctgctacaccaccacgcccccagctcccggcaccgccgcgcggctgggcgttgctgcgtcggacgccaaagccttcgaaatggctcctccttcgtcggcggccaccgtgaaccacgccggcaccgcggagcggcggccactcgaaggacctgctgatgagaacgcgagtccccagatgggggggaggagcttgtgggaagagggcgatgatgatctgcagagcctagtcctgatgggattccggaggcgacacgtgatcattggcggcccgatctgattggcggacg

SEQ ID NO: 70385 - DNA, 371 bp, Zea mays
  Clone ID: LIB3078-052-Q1-K1-D8
gaccacgcgtccgtgcacgcgtccacttcgccaacatgattcgcgccgccgctacgtcctccatctcgatggcacattatccactgccactggcagcagactaccacgcgctcgagggctcgagcccggcgttctgctacaccaccacgcccgcagctcccggcaccgccgcgcggctgggcgttgctgcgtcggacgccaaagccttcgaaatggctcctccttcgtcggcggccaccgtgaaccacgccagcaccgaggagcggcggccactcgaaggacctgctgatgagaacgcgagtgcgcagatggcggggaggagctagtgtgaagagggcgatgatgatctgcaaagcctagtcctgatggga

SEQ ID NO: 70386 - DNA, 131 bp, Zea mays
  Clone ID: LIB3078-052-Q1-K1-D9
cacaagtagtcagtcagttcaaactagcttcgtccagtgtgttcagcgtgccaatctcagatctccactgcatgcaagctactcatcacttcaaaccatatgtgccaagtggaactcttaattggatccgg

SEQ ID NO: 70387 - DNA, 393 bp, Zea mays
  Clone ID: LIB3078-052-Q1-K1-E1
gcctcactggcctcgacatgaacaaagtttttatcttcgtcaagactaatgctgatgggggcgcatcatgtgtcaaggacgtgacgaagctctatgtcatctctgaaatcatccccgagatggagatctgcgattctgactcccaaccctgtggctactccatgaatgcgatccatggctctgcattctccacaatccatgtgacgcccgaggtcggtttcagctacaccagttacgaggttatggacttggatgccactgctctgacgtatggcgaccttgtcaagagggtccttcggtgctttggcccctcagagttttacgatgtcgtgaccatctctcacgagagttgccatgcctggacatggggaaaggcacttggtgcccaggtct

SEQ ID NO: 70388 - DNA, 293 bp, Zea mays
  Clone ID: LIB3078-052-Q1-K1-E10
gccacgcgtccgcccacgcgtccgcttcactcttcatggattagaaaacttgatgccaggggcaagtacgtggtcctgtgcacgcatattcagcacccaagtatatcgggcgcctgaagaaaaccttgctctggacatggaaaccgaaaaaaaagggtaatatttgcttgcctcaatgctccattccgaagcttgtacgctattgctgcacaatttcggcattcattggctcaagtgaataacgatgtaaatgtattttaagggaagccaactttgtaccaagtacgatctga

SEQ ID NO: 70389 - DNA, 465 bp, Zea mays
  Clone ID: LIB3078-052-Q1-K1-E11
cccacgcgtccggtttcattgattcttgaagagatcgagcttcttttgcaccacaaggtggaggatgtcgtgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcaatgttttt

SEQ ID NO: 70390 - DNA, 289 bp, Zea mays
  unsure at all n locations
  Clone ID: LIB3078-052-Q1-K1-E12
cccacgcgtccgnccacgcgtccggccactcgtccggccacgcgttcggccacgccttcggccacgcgggcgggttaatcgggccggcggcggcggcgaaacagcacatcgctcttttgatctcagccattgccgaagtggagcaaccccaggacgcggtgaagctcttcaaccggtggaccttcgacgatgtccaagtgaacgatatcttgctgaacgactacctggctgtgactgcggcgaaacacgcgacatttctggcggacttcgcggggcgctacttcaagaa

SEQ ID NO: 70391 - DNA, 428 bp, Zea mays
  Clone ID: LIB3078-052-Q1-K1-E2
cccacgcgtccgacactaacgaacgaactcttgctccgatcacgagctagctgaggtcgaggatggcggctgtgctgaacagcacgaagacgccgcaggtggtggccgtgctggtggtggtggcgctgctggcttcgtccgcgtcggcggcgatcacctgctggcaggtggggtcgtcgctggcgccgtgcataccgtacgcgacggggagggccagcgcgcttcccgcgtcgtgctgcatcggcgtcaagagcctcaacagcgcggcgcggaccaacgcggaccggcaggcggtgtgccgctgtctcaagagcctcgtcaacagcgtcaagagcgtctacatgggcaccgtcgccaccatgcacggcaagtgcggcagttccgtcagattccccatcagcatgtacaccgactgcaacaagatcagc

SEQ ID NO: 70392 - DNA, 433 bp, Zea mays
  Clone ID: LIB3078-052-Q1-K1-E3
ggccaccgtaccgccgggctctcccgctggcgttgctcgttttgctctgcctgcaatgggggccgcacggactgtactgtacctatatatacacctacatactacgacgtgcacctgtactacgacgtgctgctgtaccatactaaatactagtgcgctgctgctcccttgccttcttgcttgcaccagccactccgcttttttgctcgaacgatcgactgctcgtgtcgcgtcgggccacggccggtcgtcagtttgggtgtgtccactccactgtaaagctccttttttgggtactccctgcatgccaaagttagcggacgtgtactaggtgtggttcggagcagcaggttgtattacttaccacccgctctgtgatgtaagaacgcgtgctgaaattatcatgtcgataccaagttatggcatatggatt

SEQ ID NO: 70393 - DNA, 303 bp, Zea mays
  Clone ID: LIB3078-052-Q1-K1-E4
cccacgcgtccgctcgattacaaactgtgtactatgttaatgtaatgacatagtttgggtgatacagatcgtagtgatgttggttgaagctgtttgtatgaactgtttcctactatcttgtatgaattatgatgtctgatgtagtttgtatgaactatgtcatattatgttgaatgaagctattgcatgcccttaaaatgtaacacccgacgtctagttgaatctctccagttacgaggttatgggcttggatgccactggtctgtcttatggtgaccttgtcaagagggtgcttctgtgctt

SEQ ID NO: 70394 - DNA, 258 bp, Zea mays
  Clone ID: LIB3078-052-Q1-K1-E5
cacacgcgtccgaactcatcacagcttcttgcaagacataccagtgcactgagcagatggctaactacaccggtagggcgctacacgtaattcatgacagttatcggcggatccagctgatgtattcagacatcccaataccagttgctcaggctcagaggcattaccaaccgattaagagccaccggatggtgacctgcgatcatccaccgatagaaggaaccgctgtactgtacaccaggcacactgatgctgttg

SEQ ID NO: 70395 - DNA, 391 bp, Zea mays
  Clone ID: LIB3078-052-Q1-K1-E6
ggcaggcagcagttatccatgctgatgatctgccttctcttgcaccacaaagtcgtgggaaaggtcgatgttttcccatgttgaattgagcgggaattcattattctgggccgggctagtccgcattgatgttatcaaggctcttccacgttcacggctgacattctatgggcccaagaagctaaagattaatatggtcccgacaacagaagctgatcaattttacgagactgaagttggcgtcacattgactccgacaactggtaacgagagagctgaaggatggacagggcttcaaggggttcgcgagttgaagatgaactatgaggaacgtgacatgcctgcctgtgacatcgcgatctctgggctcgggtggatttctgtggagcca

SEQ ID NO: 70396 - DNA, 404 bp, Zea mays
  Clone ID: LIB3078-052-Q1-K1-E7
tgtgtcgttgaccgagaagctgcaagagaaggaggatgcgacggagggcggcgccacggctgacaccgccgcgccggcggtggacgtcgaggcttccctggccgacgacgtcgaggagccagcagagcctgcggcgacgttcgaggtgctgcaggaggtgaagtccgaggacaggctgagcaccggcagcggcgggagcgcggtggtggacgcggacgcgctgctgtacggcaggttcgccgcggcagttgatagcagcgtggagtcgtacttccccggcggcgaggaccactaccacgactgcgggacgatgggccccgtgaatcatggcgccggaggaggcatccagtcggacgacgactgcgccggcagcgacgaggggtgcagctactacgccgacgaag

SEQ ID NO: 70397 - DNA, 410 bp, Zea mays
  Clone ID: LIB3078-052-Q1-K1-E8
ggcgctttctcctctccggcacggtggccgcgtcatcccagctctcccgcgcggcgggggccgtttcctctcctgcgctcctcctgccgtacacagtcagaaaattgcagctgaagtttgtttgaggataggcgacagctatgcgagtccttcgtgttgaacgagaaattgtagctgaagtgaaaaaacagcagggaacgatggcactatcacgaagtatgagagcatgtttgcacagtggaagacttgcacttcttgccatattggtctctggtggaattgtatcgcacatcttggcttgtgctctctataacaactggtggccaatgctaacagttctcatgtatcttatcctaccaatgcccctcatattgttcctgcgttctgatactacctacatgatgtccaat

SEQ ID NO: 70398 - DNA, 341 bp, Zea mays
  Clone ID: LIB3078-052-Q1-K1-D2
ccagactacgatcgtaactacaaaaggtttgttaggagctcagtgcctggcttcaacgtgagcccaggtgtttttaactttgttgtgcctcagtttatgcagtatgacattggttatgtgcaatctcctggcatgtccacaaaccagcatactatgtactttggccagcctgatctaacaatatggtcttctggagctgctgtttatcgacattggccaaccccaacaatgatgtatcctcattgctatgataatgctagtccaatgatgtctcagtttgttcttgcaggttcctctgtaccagtctatcaaccatgattatgagattctgcttgctggaa

SEQ ID NO: 70399 - DNA, 229 bp, Zea mays
  unsure at all n locations
  Clone ID: LIB3078-052-Q1-K1-B8
tcgacccgcatcttaccccgagcggcaagctgtcgaacccgcttcggcgctcgaccgacgacctccgaggggccttcgccgagcctcaaggtcaaggggagctcaagaaccggccgactcgccatggttctccatgtntcgggattcttcgtccagagccatcgtcaccgggaaggggcccgctcgagaacctcgctgaccacattggcgaccccgtcaacaacaacgc

SEQ ID NO: 70400 - DNA, 401 bp, Zea mays
  Clone ID: LIB3078-052-Q1-K1-B9
taccggtctggaatcacgcgtccgaccaagcaggcgcaggatggcgtggcgactgcggtcgcgacggaggcgccagcgtcggggaaggagtgcttcggggtctgctgcaccacctacgacctcaaggcggaggacaagaccaagtcgtggaagaagctagtgaatgttgctgtgtcaggcgcggccgggatgatatcaaatcacctgctgttcaaactcgcttctggtgaggttttcggacaagaccaaccaatagcacttaagctactcggctcagaaagatcgtttcaggccctcgaaggtgtagctatgggactggaggactcgctgtatccactgctgagggaagtcagcattggcatagatccttacgtagtctttcaagatgtagaatgggccct

SEQ ID NO: 70401 - DNA, 393 bp, Zea mays
  Clone ID: LIB3078-052-Q1-K1-C1
ggatctcgcaggtgaacatcgagggcttcggttgcgggcgggcgctgccagacgcaggcgggcgcaaggtgtactggcgcgccgacccagactacgccatgagcgtccgccacgggaaggtggtgctggcaccggctaaccccaaggacgagtaccatcactggctcaatgacatgcggtggagcaccagcatcaaggacgaggaaggttacccggcgttctgactggtgaacaaggccaccgcagaggccatcaagcactcgctggggcagtcccacccgatgcgcctggtgccctacaacccggacttactggactagtccgtgctcgtgacggagagcacgcgacgtctacaacagctttcgctgcgtacgcatgggcaacaacatctac

SEQ ID NO: 70402 - DNA, 402 bp, Zea mays
  unsure at all n locations
  Clone ID: LIB3078-052-Q1-K1-C10
cggacgcgtgggctcacgagcgattgcggttgcggaagtaagaggcgatggngcactccggcgtgtggaactcgcaccccaagaactacgggccccgatcccgcgtctggcgggtctgtgcgaaccctcatggactgatcaagaagtacgggctgatgtgctgcaagcagtgcttccgcagcaacgccaaggacattggcttcatcaagtaccgctgaagtcagctgggcgggctatctgaatgccatctcttggacagtgtagtagaggcgatgccacaattttaattactgtcatttagatgttcccttcagaactctgctatntaagtccgccatgtttgtgatggagaacttaagctntgnttgntatactgattatgagttacctgtgctttgctta

SEQ ID NO: 70403 - DNA, 392 bp, Zea mays
  unsure at all n locations
  Clone ID: LIB3078-052-Q1-K1-C11
cccacgcgtccgcccacgcgtgcgcggattcgtgggcgggagtactcacggaaaggcgccgacaagcctgcaacattcaagcttccggaggcagtgcccagcacggagtgagaacccaacacagtcatagatcgtatggaacactgcagagatacttagccccgccattcacttcgtgtatagcctgatcatttacagagagccgtaagcctgtatagtatctgctctctgactccacatggtatacctgtaaatcctctgctagtgatagctcgggtcgattacccatagagacacttacattgcagacgcataacaagtgttcacagaaagccttaatccatagaacactggcacatacttttacaggatggcattatgtcaaanaaaaa

SEQ ID NO: 70404 - DNA, 61 bp, Zea mays
  Clone ID: LIB3078-052-Q1-K1-C12
gagccgtacgtcgggaggtgcctgctcatctcccagatcacccgccaaccaaccccccggg

SEQ ID NO: 70405 - DNA, 434 bp, Zea mays
  unsure at all n locations
  Clone ID: LIB3078-052-Q1-K1-C2
cccacgcgtccgggcaccagaaaggatgcttctcggcgtctgtgccgtgctgatggtggtcggcgtcacgaacgcggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgncgacctccacggcgccgactgccacgcgcagctccacagcgccgncaataacgcgccttgccctgggcaggagccgtccaggatcgcgcccatgtcaggcggcaccttcgtcgccgtgcctggcaagatgcactacccgtccgcggagtgcgcgtncgcgtttc

SEQ ID NO: 70406 - DNA, 210 bp, Zea mays
  Clone ID: LIB3078-052-Q1-K1-C3
gaaataactacatgcatcttctcatcttctgtattgagtacatagaacacttgtgcagcacgttctgcgagaacacgggtcatgtttatattctactttctttaagtataccagtgtgagtaccagtgtggtccgtagttattcattatcacccccacgggatgttgtacccattgacacttaaataaagggtattttcatgcttgggcc

SEQ ID NO: 70407 - DNA, 424 bp, Zea mays
  Clone ID: LIB3078-052-Q1-K1-C4
ctcgctcattaaaggaacagtatttatgactacctcaaatggtgcatatatcgacatgcaatccaagtctactgcttttttgcccttagatgaggcatgtcttcttgatatcgataatgttgaagaggctggcattcgtcctgggttagtagaagaattcatgataattgatgagaacccaggtgatgaaactttgattctaagtttgcaagcaattcagcaagaacttgcatgggaaaggtgccggcaacttcaggccgaagatgtcgttgtcacgggtaaagtaattggtggaaacaaaggaggtgtagtagctcttgtggatgggcttaagggtttcgttccattttcgcaagtgtcatcgaaaacaaccgccgaagagctgcttgagaaagaatgcctctgaagtttgtaaaggtcgatg

SEQ ID NO: 70408 - DNA, 233 bp, Zea mays
  Clone ID: LIB3078-052-Q1-K1-C5
atgaggatggattcctctacatgacctacagtggtgagaacaccttcgggctcctctagatggctcaccacaatcgggtctgccttgcccttgcttccctactgatgccctgcctcgtgtaaataagacctgccaagcaattgtgtatattctggtttcctcgctcaactgctggaagtctaaaacctaccttatcatggacaccgtttaaattaagtaattgactggacctg

SEQ ID NO: 70409 - DNA, 432 bp, Zea mays
  unsure at all n locations
  Clone ID: LIB3078-052-Q1-K1-C6
gttgaaggctaccgttctactcggaagcaaagctgatgttctttgtatacttgtggtgccctaagacaaaggtctttagattgtcctttgcttcttctatctcacagtttagtttttggcaacaggctgatgtgtgctttcattacagggaactacgtatgtttatggaactttctttaaaccatatatttctcagcatgagaatgaaatcgaccggaatctccttgagctgagagctcgagccaccgacacggttgtactttattttcagaaggctgcttcggcaggacaaagtactttctttgacgttttaaaatatgttgctgcccagtcaccttctcagaaatcaaggcaacgccttcatcangtgtgtgtggatcaaatgcactattactctctnttttgtcaaaaaaaaatccattgaatcatttg

SEQ ID NO: 70410 - DNA, 434 bp, Zea mays
  Clone ID: LIB3078-052-Q1-K1-C7
cccacgcgtccgaggacctttacatcaacggtgctatccagctggatgttgccgggagcaggaaggctgttgtgatccacgtcccataccgcttgcgtaaggccttcaggaagatccatgtcaggatcgtcagggagctggagaagaaattcagcggcaaggatgtggtaattgttgccacaaggaggatcgtgaggccgcccaagaagggttcagctgttcagcgccctcgcaccaggactctgactgctgtccatgatggcatcctggaggatgttgtcttcccagctgagattgtggggaagcgtgtcaggtaccgtctggatggtgccaagatcatcaagatcttcttggacccaaaggagaggaacaacacagaatacaagctggacacctacactacggtctaccgcaggctgtgtgggaaagatgtg

SEQ ID NO: 70411 - DNA, 442 bp, Zea mays
  Clone ID: LIB3078-052-Q1-K1-C8
gcggtcgacgatcgggctggacaagtcggacccgagcgtggccgacgcggtggcggagctccgggacctgtccaactcgtgggtggccaagtaccggcgggagaagtcgctgctggggcgtccgtcgttccgggagatgtactcggcgctcaacgccgtgtcgggccactacatcagcttcggccccacggcgcccatcccggccaagcgccgcgcccgcatcctcgaggagatggacaccgccgagaaggcgctccaacggggcaggtaggccaaatcccagcgaagctggcccgttgcaggaacgcgagtgcccagctcggcgacaacgctaccattttgtttttgtaactactgcgatgcattcgtcgtcgttgttttcgcggctgggagcgtgtgttgtgactgtggagtaaaaagttaccgagcttttgagctgagt

SEQ ID NO: 70412 - DNA, 433 bp, Zea mays
  Clone ID: LIB3078-052-Q1-K1-D1
gtgcattacctgtcaggccagccacaattgcagagaggatgagggactgtctaagaaatctgaagcaacagaataaggatgatgatgccaaagtgaagagggcattccaaacactgcttacttacattggaaacggtggtaaaaaatctggccagggagaatttagaaaggtcaaggctgcgaatggcacatttccaggaagggtggaaatcttcatggggccttcaagtcctggagctctgccgatttgagaaacttgaaagcgacgaattctcgtttttggcaagggaaaaagtcgacagtgctatcctgaacacagctggagccgagctgaattctgccatcaccaaatccttttttcggagtcctttgaatcgttaaaagctacaatgtatactcaaaactctcgggttctcctttgcttgacatcaat

SEQ ID NO: 70413 - DNA, 364 bp, Zea mays
  Clone ID: LIB3078-052-Q1-K1-D10
cttgttgggactatgcttcgtcgccgattgtcttgtaggaagaagcagcttcggctgagagctgtccgcatgagacgaccggagggtccttttcgtgaaactttgggatttccaaccaacttaaaagttggatggccttttagttcattaatggttgaatcgcttgtggaattccttattaagggcattattggtattccccacaagctgggttctgtgcctattaatagtggacagtattcctttactggtcaccgattcctggatttgcaatcggattattcgggaaccaatctttggcaaggcagaaggattactggtttcaatgatttaatatactgagttgatataatattggtcggtt

SEQ ID NO: 70414 - DNA, 233 bp, Zea mays
  Clone ID: LIB3078-052-Q1-K1-D11
cggacgcgtggggtaccatacatctgtgtgtttccaatcaaggtggagcaagatatggggagaagctcttcaccacaagataacagttctgaggccatgaaaacggcctttccttccagaatgaatccaattcaaatgctggttcaattaaacaaggcttcaatggccgttgccattaccatgttggatccaattccaagaatggtgcttcaaaggctttcggttaccaggaa

SEQ ID NO: 70415 - DNA, 422 bp, Zea mays
  Clone ID: LIB3078-052-Q1-K1-B7
ggacaagctgcaccccggtggccccttcgaccccctgggcttggccagcgaccccgaccaggccgccatcctcaaggtgaaggagatcaagaacggccggctcgccatgttctccatgttcgccttcttcatccaggcctacgtcaccggcgaaggccccgtcgagaacctcgccaagcacctcagcgaccccttcggcaacaacctgctcaccgtcatctccggcgccgccgagaggacgcccagcctgtgaggacgcgccacaagccggcagcgatgccaagtcatgcgctgctgccgtccttgattttaccggggaaagagctgtgtgtgagggtctgaagtgaagaacgtgccatgcccatgcgtgtacattatcgagagggggaagaaaccttctcattctgatctctgatatgact

SEQ ID NO: 70416 - DNA, 76 bp, Zea mays
  Clone ID: LIB3078-052-Q1-K1-D12
gcagtcagtagataagtcgtaacctgcgttattctattcttgcgacggaagcaaaatctgcacgagagacagacga

SEQ ID NO: 70417 - DNA, 338 bp, Zea mays
  Clone ID: LIB3078-040-Q1-K1-D6
cccacgcgtccggtctcggcgtctctggcatttacgtcctcctccgcgtttgcgggtgcatgtttgggaatcgagttcagctacagtataatgacaacacggagatcccgtggtatgcagattagggctggaaaggctgccctctgcatgaccaagaggtcaaggtctaggaagtcacttgcccgtacacatggtttccgcaggcggatgcggactacttctggaaggaaggtactgaagcgcatgcgcgccaaaggcaggaaggttctttgcacaaggaccaactcaaacagtgggaagaaaagaatggtctaattacactgcaaattgatgtgctt

SEQ ID NO: 70418 - DNA, 369 bp, Zea mays
  Clone ID: LIB3078-040-Q1-K1-D7
caaacacatgttagggttttcatgaagttatctttcttcgcagctgagttattcgtgaacggtgaaatcgttcagcggtcgccagaaaggcagagaagggtggagccagtgcctcagagagctcaggatcggccacggtacagtgaccggacccgctatgtgaagcggagggagaaccaatcttaccagagatgatgtctccgtttctggagatggaaaatgccagggtttccacaggtgtgccatactggagatgcaggagcaacccccactacccacatgagaatgacatccgttgtgtttgctgcgctttctaagcttgacaagttgacattgcttatgcgtttgggcttgtacctctagttgata

SEQ ID NO: 70419 - DNA, 387 bp, Zea mays
  Clone ID: LIB3078-040-Q1-K1-D8
gtccggattcccgggccgcagctgaggcggcggaggggagggtgccgtggccaccaagcccaaggccgagaagccgccgtcgatcgggcggaagaggggcgccaaggtgaagatccttaggagggagtcctactggtacaacgggatcggcaacgtcgtcaccgtcgatcaggatcccaacacccgctacccggtggttgtgcggttcaacaaggtgaactacgccggcgtgtccaccaacaactacgccttggacgaggtctcagaggtgaaatgagtggggccggccggctcaagggcttcgcgctagctaccgtgtgattgatttgtagtagttgtgaaatgaggctgtgaagctgcatgctgtgcttgctagcgtcacaacat

SEQ ID NO: 70420 - DNA, 480 bp, Zea mays
  Clone ID: LIB3078-040-Q1-K1-D9
ggatccaacgcgacacgaaagtctgaccaatagttgtttacatacatcctacgtgcaaattcgctgccgaatactctttgtgactgtgattgcagatatccacggactttgatttgatgtaaccaaggctgagaatcaggagccactttttaggcgcagcctgatgagaacgggacatgagattcagctcggatgtagcaagcgtttcgctggtgtgtttgggggtgcattactgcatagctaattttgattttaatcttgatgtgttttatgatgtcctaatttttgatgtattattaatttttgtgttttgtattttttctaatttcttttttctttatcttttatttttttattgtttctttttttttttttttttgtttttctttgtattttatttattttttttatttttatatttaattttttttttttattttttatttttttattttttattttttattttttttttttttt

SEQ ID NO: 70421 - DNA, 362 bp, Zea mays
  Clone ID: LIB3078-040-Q1-K1-E1
gatttagctgccgatgcgggaacatgtactgttcggtgcaccgctactccgacaaacatgactgtcagttcgactatcggactgcagcaagggacgcgattgccaaggccaatcctgtggtgagggcggagaagctcgacacgatctgaggcgggcatagcgggagcgaaatggttgcaatctgcaagaattcaacatgctgtctatgctgcgttatcattgaaacttgccattcttgtctgctgctgcgtcccgtgcggttcaatactgtgatgcacacatcatctaggcagccgcaagaattccatcaaaatggtttcccgtgttggctatgacgcgtaagctcaattcagttattcatg

SEQ ID NO: 70422 - DNA, 345 bp, Zea mays
  Clone ID: LIB3078-040-Q1-K1-E10
tgccgacgcttacgggcacgacgtgcggagccccattgtggtgacgtggctgcagcccatgtgactgtcaggtggtggcaactttacggcctctgtggagcctgccctggctgggactgccgataaagatggcagcaggagtcaaggcgcagtggccagtgggccagtaacggtaaagtcgtgcggtcgggactgcgccattaaaggtgggtcctgcacgctcgctctgcagaattgattaaccgggcgtgctgtaacagtatgggcttatccgagtatagtgactactggtagtgacagtggtgtgtgaaaaactgataactctggtgtttctacttgcttgac

SEQ ID NO: 70423 - DNA, 188 bp, Zea mays
  Clone ID: LIB3078-040-Q1-K1-E11
acaacccacccagccccataaagcaaccttccatgcaacccatcccaccaacacctacccgcacatttacaacctctatacgcgcctcttctacatcccactccctacaaagaacccacccaacctcaacgcccacctcaccaccaacaacccactgctacatctctccttatttcaccctccacaca

SEQ ID NO: 70424 - DNA, 336 bp, Zea mays
  Clone ID: LIB3078-040-Q1-K1-E12
ttacgggcgagggcagtgaggtgcgctgctgtggcgatggcttctgacgcggctcacgtgaaggcctggcgccattacatcaaggagcttctcaggacgactcacttacacccgatactggtccgtctaggatggcatgatgctggtacgtatgacaagaatattgaggagtggccacaacgaggtggagctaatggaagtttaagatttgatgttgagttgaaacatggagccaatgctggtctgataaatgctctaaagcttatccaaccaatcaaggacaagtaccctagtatcacttatgcagatttatttcagttggcaagtgctacagca

SEQ ID NO: 70425 - DNA, 392 bp, Zea mays
  Clone ID: LIB3078-040-Q1-K1-E2
ccgcgtgcgaaccaagcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccaccacggcagcgtctgggcacagtccgagaacttccccgagttaaagcctgatgaggttgctgggatgataaaggactttgatgaacctggaactcttgcaccaactggtctttttgttggaggtacgaagtacatggtgatccaaggtgaacctggagttgtcatccgaggaaagaagggcactggacgcattactatcaagaaaactggcatgtccctgattatcggtatcta

SEQ ID NO: 70426 - DNA, 384 bp, Zea mays
  Clone ID: LIB3078-040-Q1-K1-E3
cccacgcgtccgagccactgcacttgctaacgccccaccagatcagcagagacttatgcttggtgagaacctgtatcctcttgttgaacagctggaacgtgagcaggctgccaaggtcactggcatgcttttggagatggatcagacggaggttcttcacctgctggagtcgccagatgctctgaaagccaaggttgctgaagccatggaggtccttcgctctgcccagcatctccagcagagcaatgtttctactgagcagcagctggctaatctatcattgaatgatggcgtcgtctccagctgaacgttaatgtttctgatgtttcggaagtgctgccagtttttgcttgaatactaccctaatctgagtgtaatgacttt

SEQ ID NO: 70427 - DNA, 266 bp, Zea mays
  Clone ID: LIB3078-040-Q1-K1-E4
ggcgaggccgtgtggttcaaggccgggtcgcagatcttcagcgagggtgggctggactacctcggcaacccgagcctgatccacgcgcagagcatcctcgccatctgggcctgccaggtcgtgctcatgggcgccatcgaggggtaccgcgtcgccggcggcccgctcggagaggtcgtctacccgctctaccccggctgcagcttcgacccgctcggtctcggcgacgactctgaggccttctcggagctcaaggttaaagagct

SEQ ID NO: 70428 - DNA, 369 bp, Zea mays
  Clone ID: LIB3078-040-Q1-K1-E6
ctcgccagcacctgctacgtccacttcggctcccacctcgtctactacgagaggaccataaccggcaagctctccaggggcgccatctcggacctctccggcgtccaggccaagaagctcttcctctgggtctacgtcacggggatggtcgcgcaccccgaccagggcaccatcgagttccaggccggcttcgtctcggagtcgctatcagcctccatgtttgacgaggtgcgcacctgcggttccagcgctggcgcgcagctgcgcggcgcggctggggtcatcggagagcttgggctgctccccgttgcgcaggcatgaacctcgagtttgagaatccacgctaccggagaaacgcatgagcttcct

SEQ ID NO: 70429 - DNA, 330 bp, Zea mays
  unsure at all n locations
  Clone ID: LIB3078-040-Q1-K1-E7
gacccacgcgtccgaagtgactgaagaaaagacatcaccacctttggaatctcaggcagagacttggctctacttcgacatctgcgagtccgagcctgactcacctactaacaaagaaaacggagaagagggtgaagtgactgaagaaaagacatcaccacctttggaatctcaggcagagacttggctctacttcgacatctgcgagtccgagcctgactcacctactaacaaaggtgaggaagtagcagacttttgctgcttctgtgctaaggtggttcccaacaaggaaaactaagactgaaatgcgggaggactcggtcctncatc

SEQ ID NO: 70430 - DNA, 407 bp, Zea mays
  Clone ID: LIB3078-040-Q1-K1-E8
cccacgcgtccgcccacgcgtccgctgatccgtccactcctattatcatgattggtcctgggacagggctggctccttttagaggcttcttgcaggaaaggttagcattgaaacaatctggggcagaattgggcacttcaatccttttctttggatgcaggaaccgtaatatggactacatatatgaagatgagttgcaaactttccttgaggagggggcgctttctgagctaattgttgcattctctcgggaagggccaacgaaagaatatgtgcagcataagatggtggaaaaggccacagatatttggaacatcatctcaaatggtggttacttatatgtttgcggtgatgccaagggaatggctagagatgtacacaaaatgctttataccatagtccaagag

SEQ ID NO: 70431 - DNA, 213 bp, Zea mays
  Clone ID: LIB3078-040-Q1-K1-F10
ccacgcgtccgcaacaaggcaccacacctcttcctcctcttcctcctcctagcacagctagcgcctgcttctcatcgtctgtgatcatgtcttgcagcagcggcaagtgcaactgcggctccagctgctcctgcggcagctcatgcaactgcatgtcccctgacgtggagaccgtcgccgccagcagcatcaagaccatggtcctcgctgcgc

SEQ ID NO: 70432 - DNA, 161 bp, Zea mays
  Clone ID: LIB3078-040-Q1-K1-F11
tccaagtacctttactgaacaagattttgattacagaataatcaaacaacatcaagagcagcattatcagaagcttcagggcaaatataaaaacaaagagaatacaacagaacactcaactcaacattaacctgatcactcatatcctaacatccctacca

SEQ ID NO: 70433 - DNA, 275 bp, Zea mays
  Clone ID: LIB3078-040-Q1-K1-D5
ctccacgcgtccggactcgctgcacgcatgaggtgccgaacggatcatggcaggttaggggtagaccagatgataagaaacccgtggttagaaatcacatccaaaacaacaccgggtactcaataccaaacatagtacctatgatcagtagccccactgggagttgcagagatggtgaagatgtaagtgtgaaccaagaagggtgtggtattcaggttgatatataattgaaccaatattttgacagttttgcgcataactttggtcaaacatac

SEQ ID NO: 70434 - DNA, 337 bp, Zea mays
  Clone ID: LIB3078-040-Q1-K1-F12
gccatcgaggggtaccgcgtcgccggcggctccgctcggagaggtcgtcgacccgctctacggcggctttatcatcgacccgctcggcctctccgacgaccctgaggccttcgcggagctcaaggtgaaggagctcaagaacggccgcctcgccatgttctccatgttcgggttcttcgtccaggccatcgtcaccggcaagggcccgctcgagaacctcgccgaccacctcgccgaccccgtcaacaacaacgcatgggcctatgccaccaactttgtgcccggcaagtgaaggggtggaggcgccaccgtccacctgccactcgttctgatatct

SEQ ID NO: 70435 - DNA, 409 bp, Zea mays
  Clone ID: LIB3078-040-Q1-K1-F2
cttaactggtgatgatttatgggctgctgtgggcgaagctggtaaaaacctttacgctaaaggagaattcaaagagtcgcaggtggcagaccttgatgtctatttgttgaagaaggttggacttttccctgatgttatagagaggaaaacattgcgccatctcgaaaaaggagataatgtctcagctctcatcactggagaattctataccagagataaatttccaggatttggaagaccctttgtgttcaatgcagagatttttaaaagagttggacgtacatctgaagccaaagattcagctcgagtggctctgaaatcaccatggtggacacttggctgcagttacgaagaggctgctgaactagctgggtgggaggatgagcagctagagtttataagagagaag

SEQ ID NO: 70436 - DNA, 324 bp, Zea mays
  Clone ID: LIB3078-040-Q1-K1-B7
tccacttcgtccgcctagctcaaaagggatacaaggtggctaatgtcccaatcgtgatgggagtggacgtgccaaagtccctttttgagatcaaccagtacaaggtttttggactgacaataaacccagcgatccttcatgcgattagaaagaccagggccaagactctaggttttgatgggcgtcagagcaattacgctgagatggaccatgtgaggcaggaactggtccatgcgaatcaaatctttgctcagaatccatcgtggccagtcattgcggtcactggaaaagctatcgaggtaacaactgctgtcatcttgggga

SEQ ID NO: 70437 - DNA, 351 bp, Zea mays
  unsure at all n locations
  Clone ID: LIB3078-040-Q1-K1-B8
cttctctggacctggccaagccggtgaccaccagggccaccatttttcgtggaacattgctggttaactgccagtgaaaccacctaattttggttgaaggtttctgaagtgaaaggagatgatgtggtgtgtataatcaagaacacagccaccttggctgggtcactgttcacgctgcattgctcccagattcacattgacttgcccaccctgtctgatgaggataaggatgtcattagaaaatggggtactcccaataagattgacttcctttctctgtcctacacaagacatgcanaggatgtgcgccaggcacgggaattcctgtcaaaattgggcgatctaagccag

SEQ ID NO: 70438 - DNA, 382 bp, Zea mays
  Clone ID: LIB3078-040-Q1-K1-B9
tgccgctcttacggcggcagcagggtcaaaggactacgtacacgttcgcatccagcagcgtaatggtcgcaagatcgtgaccttcgaacagggattgagagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatggtttctgagcaaccgccttgtccatagcaaaccaaccctgcatgcatggccagcttattatattttaatatctgaggtgtatcatatctatctggctttg

SEQ ID NO: 70439 - DNA, 246 bp, Zea mays
  Clone ID: LIB3078-040-Q1-K1-C1
tctggcatgagggagtcgtcaggctatgagtaagacctgtgtgatgactgatggtttggctttgctatcgatctaactctcctatatgcaccatgtgtgtagcatctgtatcagcgcgaatcagaagttgctcacaatacatcagggccagttatggcgatcactgtaaaagctattgatcaaacagccgctgtcatcttagtgattctgcatgacaggaagcagaagtgcttcatgccactcata

SEQ ID NO: 70440 - DNA, 264 bp, Zea mays
  Clone ID: LIB3078-040-Q1-K1-C10
tgcccgctcttactccgagcccacggaacactggaactgaaccgattcggaggtagatgcagcgcagcgtagactctggatctgttccaagcggtggaggaataaataattcggagcgagaggcgggggcttttctgcaaattttgtaaaatggagttttacgtatccctctttcgtcaattctcgcgcgaatattttagcagtagcagtagtctttaggaacccagtcgggatcagtacctggttgcgtttggactcgaatgc

SEQ ID NO: 70441 - DNA, 336 bp, Zea mays
  Clone ID: LIB3078-040-Q1-K1-C11
acacaccactcaacactacaacccacacacattcaaacacaaccaactcacctatactaggaaactttaaaacccactccaggaatatttaacaccaacctcaactcactaaccttcctccaaaatttttaccatgaacttttactcaccccaatctctcaaataccatctctactatttcaccattaacaacactctttaataaccccatacctaatcacaaccccaactcgctcatactcaaattcaactttaacacacaacgtcacacccactataccatccaatcttacaaactcctgcattccacttcatatctttactatattttcacct

SEQ ID NO: 70442 - DNA, 385 bp, Zea mays
  Clone ID: LIB3078-040-Q1-K1-C2
cccacgcgtccgcccacgcgtccgcaaaattaggcatagccgcttaggtgctactcactctaagctactagtactccagtaggcaagcatcagatcacccagctgcgctacaaacaagtggcgtttaattgtaaaaccaaaccattttttttctctatcttcttcttcttctttttccctcccctttagattttttttataagccagccagatagtggcacccataggagagaagaacacaaggaaaccataaaagaaagagagggaggccctgattgggattctaattgtaagctagctaggttgcccacctgaaagcaggctggcagctaggtcgagtaacccacggatggatggattggaatggaatggaatggaatggatg

SEQ ID NO: 70443 - DNA, 395 bp, Zea mays
  Clone ID: LIB3078-040-Q1-K1-C3
ctcggatggaggctcgactcgagccacgcgtgcgaccacgcgtccgaagaacactttaccgagaagcgatcagagcgaggcacggcgagggcaacgacagagccatgagttaccagaaggtccctgagttttatccgccaccagggtactcgcatccgcacccaccgccccaggctccaccgcaagggcctgactacccgccgccgcagcaaccacctgcggggtaccagggctactttaacgacggccagcaaccctacggctatccgccgccacaaggctggccgctctttgctgctgctgcatggtggacgagtgctgctgctgctgcttctgacatacatgcacctgaagctcgctgggtcttggcatcgaggcacggcaacatttgagcg

SEQ ID NO: 70444 - DNA, 389 bp, Zea mays
  Clone ID: LIB3078-040-Q1-K1-C4
ctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggc

SEQ ID NO: 70445 - DNA, 246 bp, Zea mays
  Clone ID: LIB3078-040-Q1-K1-C5
cgtcacgcgtccgctctgaccggttattcagctagatgagctcagtgtgatcacactaagatggaatgacaagagaactagtcatcactccgttggaagtatgtatatttggccagagggcgttctaagtcatcgaatagttgactcttgagggtatatacgcttacatacctgctatcgcttcaactatgcttatagccaccatggctgcagcaacgacgatcactgacgctaccagtatccgtc

SEQ ID NO: 70446 - DNA, 352 bp, Zea mays
  Clone ID: LIB3078-040-Q1-K1-C6
cccacgcgtccgggcatgtctatgatctggtcgaggccctagatacgtgattgaagagccggtgtgatgatgaaggtgaaatcagcatagcactcgccaagcattctacacaagagctcccaaaataaagagtgaagattgaagatgaagtggttgctgaagaggagtctactccagtgcccgatcatcaagaggatggagccatctaactaatcatcgcgttagaagtatctagaacctcttctgtgcaacaaaggagaagttgaatcaccttatctttcgggtactgacttcatgtgtgaggcctagaagctcagaatgtctatgtgtatctctgatggaaaggcttcac

SEQ ID NO: 70447 - DNA, 361 bp, Zea mays
  Clone ID: LIB3078-040-Q1-K1-C7
gtgaaacaaagatggtcctatgcatgcgcaaaacaacttattgagaggcttgtatttgctgaaggtgcagaaaatggccttgatttcacaatcgtgagacctttcaattggattggaccaaggatggacttcattcctggtgttgatggtcctagtgaaggtgtgcctcgggttttggcttgcttcagtaacaatctgctccggagagagcccttgaagcttgttgatgggggtcagtctcagagaacctttgtctacatcaaggatgccatcgaagctgtagtgctgatgattgaaaatcctgctcgagccaatggccacatcttcaatgttgggaatccgaacaatgaagttaccggta

SEQ ID NO: 70448 - DNA, 340 bp, Zea mays
  unsure at all n locations
  Clone ID: LIB3078-040-Q1-K1-C8
agctgccggcgtacgtgctggcccaaatgctgggcgccacgctggcctccgggacggtgcggcctcatgttcggcggccggcacgagcacttccccggcacgctgcccacgggctccgaggtgcagtcgctcgtcatcgagatcatcaccacattctacctcatgttcgtcatctccggcgtcgccacggacaacagagcaatcggngagctggctgggctggccgtgggcgcaaccatcctgcttaacgtgctcattgccgggcccgtctncggcgcgtcgatgaacccggcccggagcgtgtgcccggcgctggtgagcggtgagtacacgttcatct

SEQ ID NO: 70449 - DNA, 335 bp, Zea mays
  Clone ID: LIB3078-040-Q1-K1-D1
cggacgcgtgggttggaattaaaaaaacccctaatggattatggcaggttagcaggggaccagatgataagaaacccgtggttagaaatcacatccaaaacaacacggggtactcaataccaaacatagtacctatgatcagtagccccactgggagttgcagagatggtgaagatgtaagtgtgaaccaagaagggggtggtattcagtttgatatatcattgaaccaagagtttgacagttttgcgcataactttggtcaaacatacaatacagaagataggcaacaagagccacaacataatgctgcagatgtcaatggtcttagtgattct

SEQ ID NO: 70450 - DNA, 152 bp, Zea mays
  Clone ID: LIB3078-040-Q1-K1-D10
cgtcctaattcccggtcggccgatcttacccaggataaggctgattaaccaagacaaaaacaagtacaatacacccaaatacagatttgttgggcgatttaccaacaaggacattacaacacaaatcatctctgctaatatagcaagtgata

SEQ ID NO: 70451 - DNA, 231 bp, Zea mays
  Clone ID: LIB3078-040-Q1-K1-D11
cggtcctgattcccgggtctgcccagtctaactcaccaaccaagcatacctcactcactacaaacaatatacaacacgcgaaagttctctctcgagatgcgatatttaaccaacacctggcagagattacaacatcatctactacaaaagcttctacgtggattgcttccattaacttgcacgccttgcaagcacttaaagaccaattttgcctcatccactataactact

SEQ ID NO: 70452 - DNA, 190 bp, Zea mays
  Clone ID: LIB3078-040-Q1-K1-D12
accaaccaagcaacctaacccacaccaaaccttaaacaacacacccaaatacacactcgactgcccatttaccaaccaacaccgggccgatcaaaccacagcagcaactacaacagcttatacggttcttgcttccactaactcgcacgccttgccaccacacaatcaccaattaggcctgaccaactat

SEQ ID NO: 70453 - DNA, 274 bp, Zea mays
  Clone ID: LIB3078-040-Q1-K1-D2
cccgaccttgcctcctcctgcagcagcagcataaccagaggggagtacatcaagccggttcgagagagctttaggctactgctagcagtatggcttccgctgcgcgcttcctggtggccgtggtcgtagcgtgcgcactcctggccagcaacaactgccacgcggcgcgccgcttggccgacacggccgcggctcccgctgctgctgctggtgccgtccctggccatctcgccgtgccgaccttgccaactgtgcagccagtgccacaagtggc

SEQ ID NO: 70454 - DNA, 378 bp, Zea mays
  Clone ID: LIB3078-040-Q1-K1-B6
tttagcagttcatcaacgcgctcaacctagcacgacgtacggcgatgaggcgccgcggcagcaactcctcgccgcttgcggctgctgccctgcccctcctactcctcctcgtcgccggctgcttccactgcgcggcaacggcagctcgccacctgccttctcctggcgccccagtccaagcgctggatcaccaagccgagaacggtgccaaggctgcatcagctggtgcagacggcgccggcggccttgtgctccaggaaggtggcacgggcaacggcgacgagctctcttcctccaccctcctcgagacgacgacgacgacgatgggagcggaggcgtgcgaggaagggaacgacaaggacgagtgcttgctgacta

SEQ ID NO: 70455 - DNA, 131 bp, Zea mays
  Clone ID: LIB3078-040-Q1-K1-D3
cccacgcgtccggactccacgcgtccgttcacgcgtccggcgagggccgccctgagggggtatttttaggaccatgaaataccatgtgtatataaggattactacaaagagtacaaatcttaatattttta

SEQ ID NO: 70456 - DNA, 438 bp, Zea mays
  Clone ID: LIB3078-040-Q1-K1-D4
aaccatctcgactcgtggggaagtttcgctctcgccggcgtcgacagcctagggttcgaggaacgtccgtccgtccgtccggggaaggagcggtagggaggctgagatgatcgaggtggtgctcaacgaccgcctggggaagaaggtgcgggtcaagtgcaacgaggacgacaccatcggcgacctcaagaagctggtggcggcgcagacggtgacgcgctccgagatgatccgcatccataagtggtacaacatctacattgaccatattatccttaaggactacgatgttcacttctgcattgtcctttagctctactacaactgatctagttgttcttttttttttatacttgttattgttgttcttatattttaattttatttgttctatttctttttttttttgttttttctttattttttttttctttattt

SEQ ID NO: 70457 - DNA, 199 bp, Zea mays
  Clone ID: LIB3078-039-Q1-K1-H9
ggccttcgtcgtcatctgcgacggggacggccacttcgagctcggcgtcaaattcgggaagggggttgtcaccaccatccgtgtcgccatcatcctggccaagctttagctcatgcccgttaagatgggctactgcggaaacaagatccgtcatccgcacactattccctataagggcaccagctagtacatatccttt

SEQ ID NO: 70458 - DNA, 377 bp, Zea mays
  Clone ID: LIB3078-040-Q1-K1-A1
gtcaggcgaggtatgcatgtggcgctcggcctctgttggagaagacaatgaaaattgcggttgagggtttggtcgacatctttcttagtgtttttcatgagaataagaccaacgattttagattgctggatgcgaatggtttttgacaactgatgcctgagcttgagtattttgagactgtactgcacacgtacttctcacctgaggcgcaacaggctatgaaatctttacaagagaattagttggaaaaggcctgtgaatgtgttgcagaagccatggaaaatcctggacaccaacttcgaccaaccctgggcagtgaagatacagcatcggatgacagacagccattcatatcacctgttgatttgcttgggctt

SEQ ID NO: 70459 - DNA, 314 bp, Zea mays
  Clone ID: LIB3078-040-Q1-K1-A11
cccgggtctgcccgcttctacgggccgcaaaccctagcggtgggaggaacactttcggaggaaatggcggcggcgatgcaaattggtctctttcgaagaaaatatgggccggctttctgccctctactctgactgaggatgggtttcggcagtatttccagaccttcggcatcttcactgatgttgttgtcatgtattaccagaacacgcatcgcccacgtggctcctgattcatcaccttttacttatacgactcgattatcatcttaccctttattacacctcatcatcttttttgacttcatatacagttt

SEQ ID NO: 70460 - DNA, 447 bp, Zea mays
  Clone ID: LIB3078-040-Q1-K1-A12
ttatgtttgtgatttttgtggagaaacaccttaggcagttgggtggagaagaatcaagaaagctctcgtccaacacacacctagccctctacataatcattgattttgaatcgtctccgttttcctatattttctatactcatttacttttattgatctcttaatatatattttcttcatctctatttatttcaaacttattcttattttcttatcttatttttttcttctttctttctctattatttttttttattttttattttttcttttttttttctttctattattttttttttctttctttctttttttattttcttattttttatatattttcttttttctctatttattttttcttttatatttttctttctttttttctcttattctttttttttttttttttcttttttatttttttatttttcttttatttttttt

SEQ ID NO: 70461 - DNA, 394 bp, Zea mays
  Clone ID: LIB3078-040-Q1-K1-A2
ccaagggtccagagattagaactggatttttgaaagatgggaagcctattcaattgataaaaggccaagaaatcacaatttctacagactatagcattcagggtgatgagaaaatgatatcaatgagctacaagaagcttgctgttgatctgaagccaggcagtgtcatattgtgtgctgatggtaccatcactcttactgttcttcactgtgataaagaacaaggcttggttcgctgccgctgtgagaacactttcaagcttggcgagaggaagaatgttaatcttccaggagttattgttgatctccccacactcacagacaaggacaaggaggacatccttaaatggggtgttccaaacaagattgacatgattgccttgtcaattgttcg

SEQ ID NO: 70462 - DNA, 360 bp, Zea mays
  Clone ID: LIB3078-040-Q1-K1-A3
tcgactcaagccacgcgtacgacgactatagaagtacgacccttcgctttgatgaggcacaatcaaaagatgggtcgaggcgctctgctgcagctggatcagcgagatgtactacaactaggcacgcaatttgcggttatttaactctactgctattggtgatatacttccggaacacgattatagagctactctgccacagacgttgcttttactctcggcacagcaatctacgaaaattattacatgagaccttagctggaaacaaccccgtgaaagtgttgcatgaagccatggttaaatcctggacgccagcttacgaccaaccacgcggcagtaataaatacagcgatcggatga

SEQ ID NO: 70463 - DNA, 286 bp, Zea mays
  Clone ID: LIB3078-040-Q1-K1-A5
acgaggtatactctggcgctcggcctctgttggagacgacaatgaaaattgtggttgagggtctgttctgacatctttctctagtgttattcatgagaattagaccagcgattttagattgttggatgcgaatggtttttgtcaactgatgcttgagcttgagtattgtgagactgtactgcacacgtacttctcacctgaggcgcaacatgctatgaaatctttacatgagaatttgctggaaaaggcctgtgaaagtgttgcagaagccatggaaaatcctgga

SEQ ID NO: 70464 - DNA, 450 bp, Zea mays
  Clone ID: LIB3078-040-Q1-K1-A6
gagggaggaggcctccgagcttgccctcttttatccaaccaagaaaaagaagaagaggaaggttttcatccaagagccttctgatgaagtggacatgcttgcagagaagacagaatcgctagcagatgcagaacctgcttaacttaacttcactggaatgaagactatattgaataatcagctggatcttgattcatctattgatgaccttgtagatgtgtaggacacttaaggttttcaagtcgtttagttaccagtatacatatttttttctcgtaatttttgtttttcttattttctgttattgtttattttcttttatctttattttattattttttttatcatttatttatttttttatttttaattctattattttttttttttttttttttatttttatttttttctattttcttattttttattttttttttttcttttttt

SEQ ID NO: 70465 - DNA, 330 bp, Zea mays
  Clone ID: LIB3078-040-Q1-K1-A7
acgacgacgcgtagatacgaccgatcgcatgagatgagcacgctagatgtacatgatcgtcgtcgcaagtgctctgcgtgcgagcatgatcaaccatatgaactataactaggcgcgcagtttgcggtcaactaacaatccacctatagcagctatacttcaggtccacgttcatcaacatataatggcacagaggttgaggagcctgacgacaaagatatctacgtaaactattacatcgaccatagctgcttcaacacccgatatgcatgcctgacgagaacttacatccaaatgctagcgcatggctaggaatcatcatcttgagca

SEQ ID NO: 70466 - DNA, 365 bp, Zea mays
  Clone ID: LIB3078-040-Q1-K1-A8
tggacagggactacctgtctacgacgagccaaaacgggttccggcgagctgcgagaccttgcggcaagttctgcgaggcgccgtaccaggacggcgtctccaaggagctggcgcacgcctgaagaccctgatccatccatttctgtccaccacgctatgtacgtatgtgtagcagatggtttacatctacgtgttagagcccggagagctggagaagctagctagcgtgcttacagaataacagcagccaagcaaagccaagggtgtgtatataataggcatgccttgggttgtgtcagctgcgactgtatgtatagtttaaaccaagatgaaatggtactgatggtgatattccgtgttttaaa

SEQ ID NO: 70467 - DNA, 493 bp, Zea mays
  Clone ID: LIB3078-040-Q1-K1-A9
tgccgactcttacgattagatctcccagatgttgcagatctctgttctccccctgcagacaatgcatcaaggaagagggaatcttataggtctgctctgcatgactcgcgcaataaatttccaaggatgcaatcacaatcccaaggcataggaagtgctgcagggaacgccctaattccaccgcagcttcgtggaaggagcaatgttgttaccgaagacatgagcaaactctttgtggctaaacgaaaagagtagcatcttaaccttttctggacctgaacctctgtttggactccatagactgataaacgcatgtactgagtgcaatggatgtgccggcatgatccaaggttgttgctgaatcctaaagaaccggacgaaggatgctaacggtaggacaacctggtctcttagcctaccgtgggctgttgtcagatgtcaaaaatgccctcttagaaatttagaacatttctttggtgctcactcgcgtttc

SEQ ID NO: 70468 - DNA, 352 bp, Zea mays
  Clone ID: LIB3078-040-Q1-K1-B1
cggacgcgtgggtaagaatgatcgcatgagtggccgtgagttgttcatggctgacgcaagtgtgtttgttgatgatgctgaagcatatgaagtatatgagagagaggagtctgaggccaatgaagaatcgaccaataaaagtcagaatccaggtccaagttcatcaacatctaatggcaaggaggttgaggagcctgacgacgatgatatcgatgttgacgatgacttagacattgatgaattgaatgaacttgaagcaagcctgtcgagaacttacatccaaatgcgagagcctggcgagggaacatcatcttgagcagtactacaatggaagattgttgcgaagttgctc

SEQ ID NO: 70469 - DNA, 427 bp, Zea mays
  Clone ID: LIB3078-040-Q1-K1-B11
tgcccgctcttactcaaaatacaggaacgtttcaagattcattgctcccatctctcagccatctacgaagaacataggtccatgttgtaacttcagctgggcttcttatggcaatggatacatggctggaaactttagcgacagtgatgaagattatgttaattctactgtgctagaagcagttgatgtgagaagtggatcggaaggatatgtgataaagatgcgagatgggaaaaacttgcgttgtgtccataacaattctcaagggagaaatattccagagagtgcaccctaacctgtaattgttttgaggattgaagatggaagcgaaactttaacttccaatcattgttttggagattccaagtgtacttctgatggctgctattcgtaatgtccacatttcacgaccaaccatatatcaagt

SEQ ID NO: 70470 - DNA, 399 bp, Zea mays
  Clone ID: LIB3078-040-Q1-K1-B12
tctgtcgatcttacagcgctggcgttcgagggacctagccggcagtctatcgaggcaccgaaaacgaacaactgggacggcgtcttgggaaactgagatcgggcctatgggtgcaacgagttgaatcatatagaagaagtgcaagggctatgacctatgggagtttgcttgccttttgattcatcaaaaataagattgcggccagataccgcctttggtggcaacttaggggaagctgtgaagaagaaactgctgggcctctcttgcttttcgcagctttgccttgatgtacctgcgagggccatggcccatgacagtggtaggtttttctttaatcgcaactgtaaggtttggtgaagaacggtttcacagtgcactgatatatatgtagctgcttgc

SEQ ID NO: 70471 - DNA, 166 bp, Zea mays
  Clone ID: LIB3078-040-Q1-K1-B2
cagaccatactcaaacacgatctctttattggacaagacaataacaagactggcgcgggtatttttaaacatcattcttaatcatatgaactacaacataaccaaaaatatgagacccatgaatactaaaccattacaacacataaaccacgaccaagattatcaa

SEQ ID NO: 70472 - DNA, 244 bp, Zea mays
  Clone ID: LIB3078-040-Q1-K1-B3
agcgtgcttcatggcgatttgaggatcggagtcatacggtcagattgcaatggggataccagcctatacaatcctgctggacactatggacacaacgaggcacagcatgcgatgtccaggaccactgcatatactctagacttcgacagcccctatagcaatgacactccgatgcaccatgtgaggcagaagctgatgcatgcgtatcaaatctacgatcagaatccatagtacccagtcattg

SEQ ID NO: 70473 - DNA, 374 bp, Zea mays
  Clone ID: LIB3078-040-Q1-K1-B4
gttgcagccctacagcgaggtgttcggcctccagcggttccgcgagtgcgagctcatccacggccgctgggccatgctcgccaccctcggcgccctctccgtcgagtggcttaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaggagcggctgcagctggcggagatcaagcacgcgcgcc

SEQ ID NO: 70474 - DNA, 307 bp, Zea mays
  Clone ID: LIB3078-040-Q1-K1-B5
cggacgcttagctaagaatgattcattgagatctcatgagctgaaacataaggacggatatctatgtggatacgatgctaatgcataccaactatatctatggacacaacgagacacagattgagatttcctgatttgctgcattaattagggacttgtacatcacctattaacaggtgatacctaaacaaccaggattacagaagtgtaggaacctacatctactttaccattacttgaatcacttcaatttattcaacgctggctaccgctcatcagctatgtccataatcgaacactacctata

SEQ ID NO: 70475 - DNA, 409 bp, Zea mays
  Clone ID: LIB3078-039-Q1-K1-H8
catacactggcgaatatagaaacggtcaatatgaaggacgagatagaagtaggggtggcgttgttccggacatctagcattctatctgcaatggtaggccatacgatcgggattcataatggaaaagatcatatacctattcacataacaaatcatatggcaggtcccatattgggggaattcgtgcctactcggcatcttacgagttatgaaagtacacgagagggtactaaatctgagtcttaattgaattcagaatagaacgattcagaataagcttcatatataggatacatattatcaaataaagtaaaggttggcggctaataaccttatttatgacaagattcaaatcggggaagtatacccctaagattaagaagaagaaggggcttaaaaaacttcgtag

SEQ ID NO: 70476 - DNA, 425 bp, Zea mays
  Clone ID: LIB3078-034-Q1-K1-G11
cccacgcgtccgggaggaggaagacgatgaggggatggaagtggacggggaggcggaggatgagccggggtggccgtgtggggcgccggaggcggggcccggcgagacgaggccggcagcgatcctcgtggcggacgcggcggaggtcgacttccccgtcatctacgtcaacgccgccttcgaggccgccacggggtaccgcgcgcacgaggtgctcgggcggaactgttgatgctgaagctgtttctattgcgttccagaagagaggttattttgatgatacaaagtcgtgctccagttccaagtctaatgattccttagagttggttgacattcaaatttaggatcctagtggtgtttgggaaacagttctatggatttagagtcaaggggagatttgttgtaatatgcctctaattcctttt

SEQ ID NO: 70477 - DNA, 254 bp, Zea mays
  Clone ID: LIB3078-034-Q1-K1-G12
gcgtctcacacttgttatgacagctttttgactatcatctacatatttgttatcgaagatgattttcatttcaaaattcacaactaccacttcgttaaaaaattcaatgcattgtatgaacaattttatttaatgagttcaagagaagactttattcttgcacaatttgtaccacgttgtaaactctgtctcacaggtatttgctacacatgtcgtacatttaaacatcttacttatatattctcattttaact

SEQ ID NO: 70478 - DNA, 416 bp, Zea mays
  Clone ID: LIB3078-034-Q1-K1-G2
ggaagcccgagcccgacgaagaagggacaccggaaggcgtgcccaccgcctccgtctggcccgacgccgacacccacgcccacgccgtcctcggacaagtgccccatcgacgcgctcaagctcggcgcctgcgtggacgttctcgggaacgaggtgcacgtcggcgacgccaacgtccagtgctgcccgctcgtgaagggcatcgccgggctctccgcggcggcgtgcctttgcaccgccatcaaggccaaggtgctcgacatctccgtctacgtgcccatcgcgctcgaggtgctcgtcaactgcggctgcgccgtcccgccaggctacaaatgcacttgaacgattccatcccattccatttccatttccacccagcacacgtgcacagcaaaacgtctccttttgccctcccg

SEQ ID NO: 70479 - DNA, 405 bp, Zea mays
  Clone ID: LIB3078-034-Q1-K1-G3
cttactcagagataattaatgagagcctgatcgagtccgtggactcgttgaacccgttgatgcatgctcgcggtgtggccttcatggtcgataactgctccacaactgctcgtttgggatctaggaagtgggcaccacgcttcgattacatcttgacccaacaggcgtttgtgactgttgacaagaaagcaccgatcaaccaagacctcatcagcaacttcatgtctgaccctgtccacggtgccatcgaagtctgcgctcagctgaggcccactgttgacatctcagtgaccgctgatgctgatttcgtgcgtccagagcttcgacagtcttcataagcttgtatggatccgcagtgtgactgcaatggctagtttgcaagaacttaatatgcctgggcttttg

SEQ ID NO: 70480 - DNA, 293 bp, Zea mays
  Clone ID: LIB3078-034-Q1-K1-G4
gaaatgatcgaaagtggtgtcattaagctagatgacaagcagagcgaaagcaagtgtgctcttgtttacgggctgatgaatgagcccccgggtgctcgtgctcgtgttgtgttgactggtttgactgttgctgaacatttccgcgatactgaaggacacgacttgcttgatgttatcgacaacgtgttcacggtgactgacgctgactactgcggttttatctctccattgacgctccccaacgtgaccaagatccttgtcatctacatcaactgcctgtacctccttatgtt

SEQ ID NO: 70481 - DNA, 410 bp, Zea mays
  Clone ID: LIB3078-034-Q1-K1-G5
atcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaggagctcaaggaggcgttcagggtgttcgacaaggaccagaacggcttcatctctgcggcggagctccgccacgtgatgaccaacctcggcgagaagctgaccgacgaggaggtcgatgagatgatccgcgaggtcgacgtcgatggcgatggccagatcaactacgaggagttcgtcaaggtcatgatggccaagtgagtaaagcctgcggtaacggtatactaccccgcgggaattga

SEQ ID NO: 70482 - DNA, 385 bp, Zea mays
  Clone ID: LIB3078-034-Q1-K1-G9
cggacgcgtgggcggacgcgtgggcgctgatctagtggctgagctgggcaacaagctggagaggaggcacgcgtcaggcatcagcgaggacgagacgcgtggcctagctcgccggttgaaaaacatactggctgttctgaacgagtacgataaagctagagccatttcgaaggcgtttcatctcagagaagccctttaggtcgtcctggatggagtcagagtgagaaatccagttttggcacaggtttctacatccttccagtttgcagagatgttgtaccacatatacatcttgaccatgatcgagtttttagtccatcgcttgatgctatcaaagaaagctgggttgcttctaggttgttttctgcttactaacgcactaact

SEQ ID NO: 70483 - DNA, 355 bp, Zea mays
  Clone ID: LIB3078-034-Q1-K1-H10
gtcttcttcctggagagaaaaagcagtttacaatacagagatgtccaagatggcggagtagaaggctgctgcagtgggcggactcggaggagcctgtgcggctgacgcggcgcatcatcagcagctggcagcaggggaggccgtggcggctcgggtgcggcccgtggaaacgctgcttcgcgcggcaccgctggggctctgcgtggccgccatgaccgtcatgctacgtaaccagcagagcaacgagtatggcgccgtcgcctactccgacctgggatgcttcaagtaccttgtctacgccaacggcctctgtaccggctactcgctggtatccgcgttctacactgccgtgccg

SEQ ID NO: 70484 - DNA, 119 bp, Zea mays
  Clone ID: LIB3078-034-Q1-K1-H12
gagaaactcacgggtaatacatttcatggaagtcctgtgagggtgaactgcggtccagcgcgagttacagatggatccgaaccatgagcaccaatgggtggaggtggtgggactggata

SEQ ID NO: 70485 - DNA, 420 bp, Zea mays
  Clone ID: LIB3078-034-Q1-K1-H2
ggagattcttctgagatatatgctgaagtggtgaaagggcttggcgagaccctcgtgggagcctatcctggtcgtgctatgagctttgtttgcaaaaaagatgaccttgactctcccaagttacttggttacccaagcaagccaattggtctcttcataaggcaatcaatcatcttccgttccgactccaacggtgaggacctggaaggttatgctggagcaggattatatgatagtgtaccgatggatgaggaggatgaggttgtacttgattatacaactgaccctcttatagtagaccgtggattccgaagctcaatcctctcaagcatagcacgggctggccatgccatcgaggagctatatggttctcctcaagacgtcgagggagtaatgaaggatggaaaaatctatgtagtc

SEQ ID NO: 70486 - DNA, 321 bp, Zea mays
  Clone ID: LIB3078-034-Q1-K1-H4
cccacgcgtgcggcctggcggcgctgctgcgtgctgctggcaacctgctgacagccggggacgacctgttgctgatgcacgctatcaacgcacccgactacaaccagagccaggccatcctctgggaatccaactgctccccgttgatttccctcttggaactctctgaccctatcattgggaaaaaatatggagcaaatcctgacatataaaccttggacatcctgaacactacagctacccagaaggatatcatgatggttgataaagtcctgtggactgatccgcgtaagaagctctgtcaagttatgcatgataccc

SEQ ID NO: 70487 - DNA, 422 bp, Zea mays
  Clone ID: LIB3078-034-Q1-K1-H6
gcagaaaaggagatcaaagaaaaaaagtcatcaggcaaaaaggtgacaaagggtgaaggagaatccgttgaagcagttcttcccagcaaggatgatctgaggaagaccattactgaaatcctcaagaaagttgacttcaacacggcaactttcagtgacatccttaagaagcttgacaatcactataaaatggatctggccccaaagaaagaagccatcaaagttatgatccaagacgagttaaccaagttatcagaggaggacgaaggagagggagccggagacaccgagaagaaacagcagcagcctcaggcgaaggagatcgaggcatctcgttgattatcgccgcaccaactcgagaacctcacccctgatcgtgtatgttatggggcatgatgtgtatgcagccttcacaccttttt

SEQ ID NO: 70488 - DNA, 411 bp, Zea mays
  Clone ID: LIB3078-034-Q1-K1-H8
cccacgcgtccgcccacgcgtccgcccacgcgtccgagagctccacccccgtgatcgacggcaagcagtactacgccgtgtccgtgctcaccaggacggcggacggcgacgagggcggcaagcaccagctcatcgcggccaccgtctccgacggcaagctctacatctgcaaggcgcaggccggcgacaagaggtggttcaagggcgccaggaagggagtcgagaaggccgccttctccttcagcgtcgcatgatgatgtaattttatttcttcgatgggatgggatgcacgcactacgtagagagcttggctaggccaggcctggctgagcacgcttgtgtgttccttcgactgtacatgagaacaaagactaaggagagctccattcccgtacaaggatcgatttcttc

SEQ ID NO: 70489 - DNA, 425 bp, Zea mays
  Clone ID: LIB3078-034-Q1-K1-H9
cccacgcgtccgaaaaaatggaattgaaccccttcatgcttactataactagttattggggttttctactggctgctttaactataaccctagctctatttattagcttgaacaagatacgtcttatttgaaatgaattgaatagaagaatctttcttttggattcttggtattctagactcttttccacactaattaccaatttttttcttggtcattgagattcgtgggtagtttagactattatttagagatagatcgtacctctttttttatcccctcgaacaaatcgaaatgattgaagtttttctatttggaatcgtcttaggcctaattcctattactttagcgggattattcgtgactgcgtatttgcaatacaggcgtggggatcagttggatctttgattgagtaatatttcttt

SEQ ID NO: 70490 - DNA, 234 bp, Zea mays
  Clone ID: LIB3078-035-Q1-K1-A1
ccaagcaccaagaccaagaaggactactgcacagattataaccttcaccgctactataagaaacactacctcttcctctcttcactttggccttttacctatcctaccttaccacggtgctttttcttgacaatatgaaacccttttaaaatgttcacatacttttccaacccaaatacttcgttgaattaatcactcatcagaaacaaacttccctatacttttgtcaacata

SEQ ID NO: 70491 - DNA, 431 bp, Zea mays
  Clone ID: LIB3078-035-Q1-K1-A10
ggctctaaccaataaccactgcagggtgaagttgtctggtgtccagccaggggagtcgttcccttactgagagttaagttgtcctgagctgagtgtcaacctcctgtgtggtgaccagggtcatcagtgcccacctcgccgcggtcaagcaatcacaagcgattcccactgtacagtgcaagtttcgtgttctccttagacacctaacgaggtggtatttaaagaagtctactcaagcctgctcctaagtggatgaagcctttaacttgttattggatagagtgatctagaaccacttcatttgcactaatgatataactttgttctgtttttatggagttaagtgtctgtaggcttttttcttttttattttaattattctcattttttttatttattttattttagtatgtttttcttttttttttttt

SEQ ID NO: 70492 - DNA, 427 bp, Zea mays
  unsure at all n locations
  Clone ID: LIB3078-034-Q1-K1-G10
gcttgtaacacttgttaggacagctaaaggactagcatcgacatatttgttattgaagatgatgatcatttcaaaattcaaaactaccacttcgttaaaaaattcaatgcattgtangaacaattgtagttaaggagttcaagggaagactgtattcttgcagagtttgtaccatgttgtaatctttggctcacgggtatgtgctacacctgccgtacatttaaatatcttccttaggtatgctcatctgaacttcaggtcaccatggccccatatccttgtatgtggtgcttatttaattgtttcttctcggngtatcatatctgttcttgtccctgtccaatattttatacggtacatgctgtgtagatttggatacgtcgtcacatcgattcatatatcccagtggacctatcactggtcaaac

SEQ ID NO: 70493 - DNA, 265 bp, Zea mays
  Clone ID: LIB3078-034-Q1-K1-E5
actacccatacgcttacctcaactcccataacaaagcccgtataactctccagggtggtgtccatcctctgcttcgtgccgacataaacataccatcacttcaagcccagccgcgtctaccacatacagctcgtcactagcgagaaaaccctattaaaggacgaagacttattgaagaggtttaactcattcaataactgtattaaacatttctacaagattgtgaatgtacttactatcatctataatattaggtacaaactac

SEQ ID NO: 70494 - DNA, 411 bp, Zea mays
  Clone ID: LIB3078-034-Q1-K1-E6
gccgccgcctccgacatcgtctcttcgtccccacgagcaaccgataatccgccggcgctgagatgttggtttatcaagacctcctatctggcgacgagctcctgtcggattcattcacctacaaggagctcgagaacggcgtcctgtgggaggtcgagggaaagtgggtcacccaaggtcctgttgatgtagacattggtgccaatccatccgccgagggtggtgaggatgaaagcgttgatgacacagccgtgaaggtggttgatattgttgacacattccgtctacaggagcaacctccttttgacaagaaatcatttgtctcttacataaaaaaatacatcaagaatctcactgctgtgttggagccagagaaagcggatgagttcaaaaagggtgtcgagggtgcaa

SEQ ID NO: 70495 - DNA, 178 bp, Zea mays
  Clone ID: LIB3078-034-Q1-K1-E7
cccggcccgacgcactcgtccggccgacactacacataaatcctagagtttaaccatctcccttttcaccacaagggcgagtttgtttctccactgcggatcaaccaccaaacgcctctcaagctccaagatcagccagaaatacccacacctcaatgagaccagcaccgccacacaa

SEQ ID NO: 70496 - DNA, 429 bp, Zea mays
  Clone ID: LIB3078-034-Q1-K1-E9
cccacgcgtccgtccacgcgtccgctcatcacgccgccactgatctgctctgttgctggtgactaggagcagtagcgagagggattctggatggccaagtcgaacaaccacactgcgcataaccagtcgttcaaggcgcacaagaacggcatcaagaagcccaagcgccaccgacagacctccaccaaggggatggacccgaagtttctgaggaacttgaggtactcaaggaagggcaacaagaagagtggcgaggctgactccgaggagtaagatgatggtgattgagactgtggcgacaaatgcatctcttgtatcgctaagagtcttagctgtgaacttagttctcacttatgtgtgactgtgatcaaaggacttgtgtatgatcaaaggagatccatcaggtggtaccgaactggattttatgtt

SEQ ID NO: 70497 - DNA, 404 bp, Zea mays
  Clone ID: LIB3078-034-Q1-K1-F10
gtcaatgagaagctgcacaacctgcatggtgtggcaacaaggtgcaatgatcctcaggtgacagacttcatcgagagtgagttcctcgaggagcacgtggaagccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgtgttgatcaggcggaggaataataatgggtcaactgacaactctgggtcggtggatttgtagttggtttgggttttttagttgtagaacggtgttgccctcctagagagggatgaacacattatgcatgcgatgtgtcaattcggtcggtgctatgc

SEQ ID NO: 70498 - DNA, 426 bp, Zea mays
  Clone ID: LIB3078-034-Q1-K1-F11
gtcagcacccgcgcgcggcagggagtcaagccccatggcaggccccaccttggcgtgggccacctcgcggttcatcctggccgcgggcgtgcccactgccagtagcggcagcggccgtgtcagcttcgcctcggcgcccaaccggcttggcaggaggcttgtggtccgggccgatgaggagtccccggcagagccggcgcccacggcggaaggggagggcgccgtggccaccaagcccaaggccgagaagccgccgccgatcgggcccaagaggggcgccaaggtgaagatcctgaggcgggagtcctactggtacaacgggatcggcaacgtcgtcaccgtcgatcaggatcctaacacccgttacccggtggtggtgcggttcaacaaggtgaactacgccggcgtgtctaccaacaactatgc

SEQ ID NO: 70499 - DNA, 410 bp, Zea mays
  Clone ID: LIB3078-034-Q1-K1-F12
cccacgcgtccgccatttctacccggagacctccagccgtccgcccctgaaccctcgggcttctccgtcccgcctcggcactcgacggccgccggcacacaccgcgcagtctcgagacaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggtgccaccttcgccaccatcgggggcctctacatcggcgtcgagcagctcgtgcagagccagcgcaagaagcgcgacttcgtcaacggggccgtcggcgcgttc

SEQ ID NO: 70500 - DNA, 412 bp, Zea mays
  Clone ID: LIB3078-034-Q1-K1-F2
cccacgcgtccgacggcgtggactaccacctcaaggacgccaagatcctgaacaacaaggtgaggaccctggtgactcgagaggcggtgaacgccggcagcatgcccagcaagaacacgctgaccctcaagtacgtggtcagcaacggcaagatctgggacgccagcaggtccttgaggctgggcatcaaaagcagcttccaagccggagtccccgaggtcgtgaccggatcgattacgctggagagcgagttcgacaccagctacatctggggcgagaacaccgtcaacacggaggagttctccaccgactacgaggtcatcgtgcctccgcacaccgtcatcacggtgcgcatcctggccacgcatggcacttgccaggtccccttctcctacacgcaggaggatatttt

SEQ ID NO: 70501 - DNA, 416 bp, Zea mays
  Clone ID: LIB3078-034-Q1-K1-F4
cccacgcgtccgcttatcgcaacgcgagcagcagttgcattggaggcgaggaggagccacgccggggctcaaggaatggccgctctccgccacctcgctgccggccccacctgccaccaccaccaccacggcgtcgcggcagccaccgcctccctccggctccatcgcctccccctccccttccgcccccttcgctcccgctccggctccttcaccagggtttatgcgatctccagcaatgacatcagggtcggcaccaacgtcgaggtcgacggcgcgccatggaaagttctagagttcctccacgtcaagcctggaaaaggcgctgctttcgtcaggacaaaactgcgtaactatgtaactggcaacacggtcgagaaaaccttccgtgctggaagtacgctacaggaaccatc

SEQ ID NO: 70502 - DNA, 308 bp, Zea mays
  Clone ID: LIB3078-034-Q1-K1-F5
gcttcgagtacatcaaaggcgtagtgttggatcctgtgccttttgacatcgagagggatttggtgactgcaacaatgaagaagaagagaaagaatatgctgaactattaccagtctgagattgacacaatatacaaaaagctggaggcgcagaagagtgctgccagagctaagtgaagagatgtgccctattcgaccatcagctgaaaacaagggaaacgacaccgttgtaaatttcacattaatattgcgaagtaacaactcagggctatgagtaaggaataaaatgtatattgtgcctttgtctat

SEQ ID NO: 70503 - DNA, 369 bp, Zea mays
  Clone ID: LIB3078-034-Q1-K1-F6
gacagggaaagagaccgagaccgagattgggagagggacagagatagggagagggagagggagattgagaggtacagctagagccatatcgatgtcatagacggcctctctgtgccaaaaatcacaattgtacccttgcttgtcgatgctctgcgttcaatgactcatcttccgttggatgtacatcttattattgtggaaccttagcaccgagtccccgattttatcaaggcttgtgctcatattgatagtgtccactgttaacagacattttccattcattttcaccgaacagtctatcttatttaaagtctatgagcctagtcttgatttgtttttaattcatctacttccctcactgttatttat

SEQ ID NO: 70504 - DNA, 409 bp, Zea mays
  Clone ID: LIB3078-034-Q1-K1-F7
gtcatgactacgctggacatcctctcgtcgcactcgcccgacgaggagtacatgggggagttcgcggagccgtcgtggctggcggagcccatggtgaaggcggcgttcgagaagttcggcggcaggatgaaggagatcgaggggttcatcgacgagtgcaacatcaacctggacctcaagaaccgctgcggcgccgggatcgtgccgtacgagctgctcaagcccttctccaagccgggagtcaccgggaggggcatccccagcagcatctccatctgatccatcctcagcatgcattagtccaattaattaaatcggaggttgtactattattgcatgcagaggctgcttgtcgaataaaacgtactatatgtacgattgtattgtacatgtgtgtcaatgcaacaag

SEQ ID NO: 70505 - DNA, 418 bp, Zea mays
  Clone ID: LIB3078-034-Q1-K1-F8
ggcaagctgaggctaaccgcatcagggatgagtaccccgatagaattcctgtcattggtgagaaatgccgagaggagtgacatcccagacatcgacaagaaaaagtaccttgtccccgccgacctcacagtgggacagtttgtgtacgtggtgcggaagcgcatcaagctcagcgccgagaaggcgatcttcatcttcgtgaagaacaccctcccaccaacagctgccctgatgtctgccatctacgaggagaacaaggacgaggacgggttcctctacatgacctacagcggcgagaacacctttgggctgctatgagtggcgccgcgccgtcgtggatcgacgtccgacaatgccccttctactgtaaatacttaaaaaaaaataggcgtctcaagaatccgtgtacataataata

SEQ ID NO: 70506 - DNA, 427 bp, Zea mays
  Clone ID: LIB3078-034-Q1-K1-F9
gccacgcgtgcgaccacgcgtccgaccacgcgtccggcggccgctgctagcctgcaacgaacaaaccagcgagcgagcgggcggaggaggagatgccggcaaaggggcagcggctgacggagaagaacttgcgggcggcgcacggcggggtaccgtgcctgcccactacgccaaagcagatggagctcgaggccatcccgactaaactccgtcgtctcatcgccttacagaacaagcacaacgccaatgctgacgcgttctcaagaggtgctctcaagaagcacgacgatgggttaaggaagaacaagctagcagcatacaaggcatatgacaagaaaaccaagtagcatgcattggtggttcctgctgatagcaaagcatcagatgttaaaggtgatgatgaacgttcagctgccaatgaggatgt

SEQ ID NO: 70507 - DNA, 406 bp, Zea mays
  Clone ID: LIB3078-034-Q1-K1-G1
cgatcatgtcggcctactgcggcaagtacgcggatgagctcatcaagaatgctgcctagatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagccttttgtcgatgtcctcaaggagggaggcgtcctccctggcatcaaggtcgacaagggcaccattgaggttgttggcaccgacaaggagaccaccacccaaggccacgatgacctcggcaagcgctgcgctaagtacta

SEQ ID NO: 70508 - DNA, 378 bp, Zea mays
  Clone ID: LIB3078-034-Q1-K1-E4
gacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcagagtccggcgaggccgtccacggctgcagctgcggtggcaactgcaagtgcgacccctgcaactgctgatcacatcgatcgacgaccatggatatgattattatctatctagcttgtggtggtggttgaacaattgtaagcgagtccgatcttgct

SEQ ID NO: 70509 - DNA, 418 bp, Zea mays
  Clone ID: LIB3078-034-Q1-K1-D1
ccggccgccgcgaaggcgagcaccaggcgagcccgtggcgatccgggacgcccgcggcggaggaggactcgggcgccttcccctccgccatcatcttcttcgctctcgctggcgctaccgccaccaccgacgccgtcggacaactgcgccggacggtcagctggttctacactcaacttagtaggtcggaaccatatgtattctgggaagacatacctcgtcgaccaaatcgtcatcggtgcggtgaagcctgggaacgatatcaccagacgatgcgtgacaggaccgaggatcaaagggaaagagtggaacgcatacggcacatgcaagatgtatttaaaaaggagagaagtacatgtctggattatcgaaattgggatagccataatcccaactattatcagcatcatcaaagaga

SEQ ID NO: 70510 - DNA, 389 bp, Zea mays
  Clone ID: LIB3078-034-Q1-K1-D10
gcgcagtaatgtactcgttcgacagattcctatagctgctaactaggtatagtcctttgtatgtgtccatagaaaagctggcctcgaactagcgtagcatcaacatcaacatgggttcctgggtgcgcaccatcacgtcgcccttccggaagatgctcagcccgcaacagcgcgacggcaagaagacgccgcgccgtcgtcaccaccaccaccaacgacgccagcagcaatctccttctacttctccttcttcttcatcagccatggaggaggagcacatcggcgagatggagataagcaggtcgcaactctactgcgaggtgattgcgtgcacgtactatgacgtgcaagtcatgtggtccatgctcgacaaggccaggatctgcatc

SEQ ID NO: 70511 - DNA, 321 bp, Zea mays
  Clone ID: LIB3078-034-Q1-K1-D11
gacccacgcatccgctctactcttgcgagtcgatagctcgatgctagctacgatttcgagactcgcagcgcccatggcgatggacacgcaagccttggccgacacgcgctacctgatggacgacaactgagctccgtatgccaagctcgagaacctgaactcgcagctggagctgatgacggcgtactacagcagtccggacctgatcctcgcgttcaccgacgaagcggtggacgcgcactaggagttcgtgtccccctagctggaccacatcgcgccggacgacatcttcggcggtaacacacgacggactgttccaca

SEQ ID NO: 70512 - DNA, 422 bp, Zea mays
  Clone ID: LIB3078-034-Q1-K1-D12
cccacgcgtccgctctgaccggttattcagttgtatcagcttgtgtgatcacactaagatggaatgacaaaggaactagtcgtcgctcccttggaagtatgtcaatttggcaagagggtgttctaagtcttgtcatagttgctctttgtggttttatagtgggactttgctatcgctttaactatgctatagcctttatggttgtagcttttctgatagctgttgctgccagtttcgctctccagtttcgtcaggtctatgtggatccacctggcttttcttgtcctggggtaccgttggttcccattatttctgttttcttcaacatggtcctgtttgctcagctacatgaagaagcgtggtatagatttgtcattcttagtctcatcgctgtgggagtttatgccggctatggtcagtac

SEQ ID NO: 70513 - DNA, 403 bp, Zea mays
  Clone ID: LIB3078-034-Q1-K1-D2
gcgcgaaccagacgcagacggcgcagcgcaagtcgtattcggggacgacctctccgccgtcaggttcagtgaaagagaaggtgaagccgaggctcgacgacgggggcgtcgggttcccgccgttccggttcgggggaggcggaggaggaggaggcggcggcggcagcagctcgtccggcgggttcatcctcttcgtggtcgtcctgctcctggattacctcaaggagttcgagaggaacctgcagaacgggccacggaggagcggcagtggctacgacgactggctggcgccacagtagattcctctctctctctctctcacacacactctcggtatgtggtttggaagagaacgtgtactacgtctctacacgagcatgtgttgcagagatgcttcggtgtt

SEQ ID NO: 70514 - DNA, 401 bp, Zea mays
  Clone ID: LIB3078-034-Q1-K1-D4
gttgaacgagactttctataccgccttttaacggctgatgaacaaggagaacaagcggggcacacaaaagtgttccaattggattaattctggagtagaaagagcgaaagagtcggatgcactaaatctaggcttgaaatagttcctggcttgggactgttcctatgctgccgaatggggccgagcaatttccaaatatatattatctattgctacttccttcacatatcattactttatatgttcttattggttacatttggcgccattgttggtaagactgtaccacccacagttttattgagaaaggcttttaagatggttgtagttgcacaaattggaaaataaaactacactaacttaattttccttttcttcttgtgcttcatgaaacttgatta

SEQ ID NO: 70515 - DNA, 401 bp, Zea mays
  Clone ID: LIB3078-034-Q1-K1-D5
gttgacggagactctctctaccgccttcccacggctgctgaacaaggagaagaagcgtgccagacaaaagtgttccaattggattaattctggagtagaaagagcgaaagagtcggatgcactaaatctaggcttgaaatagttcctggcttgggactgttcctatgctgccgaatggggccgagcaatttccaaatatatattatctattgctacttccttcacatatcattactttatatgttcttattggttacatttggcgccattgttggtaagacggtaccacccacagttttattgagaaaggcttttaagatggttgtggttgcacaaattggaaaataaaactacactaacttaattttccttttctttttgtgcttcaggaagcttgatta

SEQ ID NO: 70516 - DNA, 416 bp, Zea mays
  Clone ID: LIB3078-034-Q1-K1-D6
agggtttcttcggaggctttatttatcgtttatccacggaacttccggtgccggcggggaccacttgtggcgatccatccctcaccatgtcgtcggagaaggaggcggcgctcgccgccgtgctcgatgacagcccaaccatatttgacaagatcatcaaaaaggaaataccttctactgtggtttatgaggacgagaaggtactggctttcagggacataaaccctcaagctccaacacacattctcatcatccccaaagtcaaggatggactaactggcctggcaaaggctgaagagaggcacatagaaatacttggctatctcctctatgttgccaaggttgttgcgaagcatgaaggacttgaagatggctatcgcgtcgtcatcaatgacggcccaagtggatgtcaatct

SEQ ID NO: 70517 - DNA, 385 bp, Zea mays
  Clone ID: LIB3078-034-Q1-K1-D7
gttgacggagactctctctaccgcctttttacggctgctgaacaaggagaagaggcagtgcagacaaaagtgttccaattggattaattctggagtagaaagagcgaaagagtcggatgcactaaatctaggcttgaaatagttcctggcttgggactgttcctatgctgccgaatggggccgagcaatttccaaatatatattatctattgctacttccttcacatatcattactttatatgttcttattggttacatttggcgccattgttggtaagactgtaccacccacagttttattgagaaaggcttttaagatggttgtggttgcacaaattggaaaataaaactacactaacttaatttttcctttcttcttgtgct

SEQ ID NO: 70518 - DNA, 461 bp, Zea mays
  unsure at all n locations
  Clone ID: LIB3078-034-Q1-K1-D9
tcgtctcgtgcacaagtanngtgtatctcgttcgactagatctcctatnnagctgctagctaggtatttagtccttgttggtttgtacctgatagaannaagctagcatnctgatctagtcgtatngcatcaacatcatnacatgggttcctggngtgcgcatctcatcatcgtcgcccttctcggaagaattgctcagcccgcaacaagcgcgacggcatagaagacgctcgcgccgccgccaccaccaccaccaacgacgccagcagcaatctccttctccttctccttcttcttcatcagccatggaggaggagcacagcggcgagatggagataagcaggtcgcagctctacggcgaggtgatggcgtgcacgtacgaggacgtgcaggtcatgtggtccatgctcgacaaggccaggatctgcagcgcgtcgtgaccggaccgtcacacacggacc

SEQ ID NO: 70519 - DNA, 263 bp, Zea mays
  Clone ID: LIB3078-034-Q1-K1-E1
cccacgcgtccgcccacgcgtccgcggtcgcttttgcggacgcgtggtcgctcacaaggagagcgatcaagtgcctgaacgaaacggagcccatcagctacagacccgtctgcggttacaaggctgcaaccactgactacagcctgatggccatggccaggtcctacttcctgcggacgctggagccgataggcatacgcgtccagatactcaacatcacggagctgtccgactaccgcaaggactgtcatcccactgtgttc

SEQ ID NO: 70520 - DNA, 220 bp, Zea mays
  Clone ID: LIB3078-034-Q1-K1-E10
acgacgcgtccgctcacacctccgctttagatgcctcagctgatctgatcacactctgatggctttacacaggaactagacggctctcccatggacaaatctaactaccacacgacgcatatccaagccttgaaatcacacatcaactgcatcttatagcccaacctctactatcaatacaactatactataacctacatggacgtagccactaacataa

SEQ ID NO: 70521 - DNA, 424 bp, Zea mays
  Clone ID: LIB3078-034-Q1-K1-E11
aagattgctaatgaaactggaaagccatggctgtggtgggattatgtgcatgatttcgcacttaggtgcccaatgaaggataagaaatacaatcatgactgtgccagcgatgttatcaagtcacttggattggacatcgagaaaataaacaagtgtgttggcgaccctgaagccaatgaggaaaacgtaattttaaaggcagaacaagatgcccaaattggtcatggtaaaaggggagatgtcacaatactaccaacccttgtcatcaacaacaggcaatacagaggtaagctggacaaagttgctgtcctgaaagcgatttgttcaggattcgaggagacaactgagcctgctgtttgtttgagcgaagaggttcaaacaaatgagtgtttggagaacaatgggggttgctggctggacaaag

SEQ ID NO: 70522 - DNA, 388 bp, Zea mays
  Clone ID: LIB3078-034-Q1-K1-E12
aagagtcctaatgaaactcgtaagccatggctgccgtggcattatgtgcatgatcaggactgttttacccaatgaaggataagaaatacaatcatgactgtgccagcgatgttatcaagacacttgcattgaacatccacaaaatcaacaagtatgttggcaaccctgaagccaatgaggaaaacgtaattttaaaggcagaacaagatgcccaaattggtcatggtaaaaggggagatgtcacaatactaccaacccttgtcatcaacaacaggcaatacatatgtaagctggacaaagttgctgtcctgaaagcgatttgttcatgattctaggaaacaactgatcctgctgtttgtttgatcgtaaaagctcaaacaaatgattg

SEQ ID NO: 70523 - DNA, 411 bp, Zea mays
  Clone ID: LIB3078-034-Q1-K1-E2
gcgcgcgtatgcgctccagcagcccatggcctccatggcgttcgccctgtcgggcgcgttcaagggcctatccctggcacccaccaccaccacctctttcttcccgcgctgcgaccgagcctcgctctccgtcggcggcagcagcgggcgtgccggccgtgccggtgccggcgcggcggctcaccatgcagatagcgcacaagaagggagccgggagcaccaagaacggccgcgactccaagggacagcgcctgggggacaagatatacggcgaccagctcgccaagcccggggccatcatcatccgccagcgcggcaccagggtctatcctggaaataacgttggaatgggcatggatcacacactcttcacttcgatagatggactcgtcaagtttgagaagtatgggc

SEQ ID NO: 70524 - DNA, 347 bp, Zea mays
  Clone ID: LIB3078-034-Q1-K1-E3
cggacgcgtgcgctcatccgtcactgctgctctctctcgccgctgtgctgaacctatcgcaggctgtatatcatctacagcagtctgctactaaactgctgcaaacacactatctatatcacaaagttctaaaggtctgttcgaacaataacacctctcgtcatgtggatcactactattatcaacaggccatcgatttctccatcacagattggaaccatactacctctatctattgtacatactatggtcaaactcttcaccaacatgagcctatggcaaattacattaaaacatacgcacacaatcaatgcttaggagcctttcttttctgctattctttctat

SEQ ID NO: 70525 - DNA, 421 bp, Zea mays
  Clone ID: LIB3078-034-Q1-K1-C9
cccacgcgtccgcccacgcgtccggacgggcgtgtcggtgtgggaggcgctggtgctggagatcgtgatgaccttcgggctggtgtacacggtgtacgcgacggcggtggacccgaagaagggcagcctgggcaccatcgcccccattgccatcggcttcatcgtgggggccaacatcctggtgggcggcgccttcgacggcgcgtccatgaaccccgccgtgtccttcggccccgccctcgtcagctgggagtggggctaccagtgggtgtactgggtcggccccctcatcggcggcggcctcgccggcgtcatctacgagctgctcttcatctcccacacccacgagcagctcccctccaccgactactaaaagccgaagccgaccgacccaggggtgcgcagcgcagcgcagctagca

SEQ ID NO: 70526 - DNA, 425 bp, Zea mays
  Clone ID: LIB3078-046-Q1-K1-E5
cccacgcgtccgcccacgcgtccgcccacgcgtccgcccacgcgtccgcccacgcgtccggacggtcaagcccttcgttaacggcggggcctctgggatgctcgcgacctgcgtcatccagcctatcgacatggtcaaggtgaggatccagttgggtgagggctctgctggtcaggtcacaaggaacatgcttgcaaatgagggtgtccgttctttctacaagggtttgtccgccggattgctgaggcaagcgacgtacacgactgctcgtgttggatcctttagggttctaactaacgaagcagttgaaaagaatgaaaggaagccattggctctatttcagaaaggctttattggtctgactgctggtgcaattggtgcttgagttggtagtactgctgatctggcactcattagaatgcaag

SEQ ID NO: 70527 - DNA, 333 bp, Zea mays
  Clone ID: LIB3078-046-Q1-K1-E6
gagcggtacagcgagcagctgatggcgcttgcgtgcaggctcctgggcgtgctctcggaggccatggacctggacacggaggctctggccagggcctgcgtggacatggaccagaacggtggtggtcaacttgtacctgaggtgcccagcatccggacctcactctggggctcaagcgccacactgaccacggcaccatcacgctgctgctgcatgacctcgtcggctgactccaggccacgcgcgactgtggacggacctggatcaccgtgcagcccgtggagggcgccttcatcgtcaacctcagcgaccacggtcacttactgagcaacg

SEQ ID NO: 70528 - DNA, 404 bp, Zea mays
  Clone ID: LIB3078-046-Q1-K1-E7
cccacgcgttcgattggagttcctgatgaagttggccggcttgaggttctccgtattcacgctaagaacatgaagctagctgaagatgttaatttggaactcatttcaaaggatacccatggatacgttggtgctgatcttgctgccctttgcactgaggctgctcttcagtgcattcgtgagaagatggacatcatagatcttgaggatgagacaatagatgcagagatattgaactcgatggctgctacaaatgaccatttcaagactgcgcttggaacaagcaacccatctgctctccgtgaaactgttgctgaagtcccaaatgtctcttgggaggatataggtgggctggagaatgtcaagagagagctccaggagactgttcaatatcctgtggagca

SEQ ID NO: 70529 - DNA, 305 bp, Zea mays
  Clone ID: LIB3078-046-Q1-K1-E8
ctcacgcgtccgcttcagcatgggctgggcgtacccgcgcacgatctacttcaacggcggcgagtgcaagacgccgccgtcggactcgtaccccgacctccccaacgccgcgcccgccgtcggctcgcaactggtcctgtccagccgacgtctcggcgaacatactgctgctgctcctggtggcatgacccggaccgaaccatggacaaggcctgcttgatgaccatgcgtatcgtaccctgtgcaccgtgcatactgtactaggcaaggcatacgatacgagtcctgagaccatgcctgaacac

SEQ ID NO: 70530 - DNA, 355 bp, Zea mays
  Clone ID: LIB3078-046-Q1-K1-E9
aggactcgtgggcggactcgtgggcggactgcccgcgcctggagtggacataccgtacggggctgaggaagacgagcccgacaagaagaagccccggatgatgctcatcgagcggggcaagacgcggaggctcgtgaacacgcctgacgttctactcgggcttggctggttcggcttcgaggtggtcagggcggatccaaggacccactctgacctcgaggagtttgcccgcctagtcgactcgtgtgacgcgatgatgggcgtccacggtgccggtttgaccaacatggtgttcctgaggtcgggcgcagcgctggtgcacgtcgtgccctacggtgtctagttcatggctgac

SEQ ID NO: 70531 - DNA, 433 bp, Zea mays
  Clone ID: LIB3078-046-Q1-K1-F1
gtcaaggacaggatagggtacagtatgataaatgatgctgaacagaagggcttgattactgcgggaaagagtgttttggtggaagcaacaagtggaaacacaggcattggtcttgctttcattgctgcttccaaaggatataagctgatactaacaatgccttcatcaatgagcatggagagaagagtcctccttagagcttttggtgccgaacttgtccttactgatgctgcaaaagggatgaaaggggccttagataaagctacagagattttaaacaagacaccaaattcttacatgcttcaacagttcgataaccctgccaaccctcaggtacattatgagactactggtccagagatctgggaagattcaaaggggaaagtggatatattcattggtggaatttgaacaggggggacaatatctggtg

SEQ ID NO: 70532 - DNA, 450 bp, Zea mays
  Clone ID: LIB3078-046-Q1-K1-F10
cggactcgtgggcgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcggatgagttcaaaaagggtgtcgagggtgcatccaagtttctccttagcaagctgaaggacctccaattctttgttggtgagtccatgaacgatgatgcgtctgtggt

SEQ ID NO: 70533 - DNA, 358 bp, Zea mays
  Clone ID: LIB3078-046-Q1-K1-F11
cccactcgtccgcccacgcgttcggtcagcagttccttcagccccaactccagatgttggtgaagcacaggccccagttgctgaggaggactacgactatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatggccaagctcgaggaagctgttaggagtgtccagatggaagggttgctctggggcgcatccaagcttgtcccagttggatatggtatcaagaagctgcagatcatgatg

SEQ ID NO: 70534 - DNA, 317 bp, Zea mays
  Clone ID: LIB3078-046-Q1-K1-F12
ggcaaatcaacgtctgggcagccgttgcctttgattgagaggtggaagtcaggaggagcgtgtgactgtggcggatgggatgaaggttgcatgctgagtgtcctcactgatgctgccgaagaaaatgatgccgttcatgctaaccaggcataggatggcagccagctatttgaacttactagctcaaggtgcgatcacgagaagataggcatgccttcactatgacttcattcatagagtgtcattatacaatgagcatgcatatcatccattgcattacttcaggcttgtgcaactggtctagtgatactgcatga

SEQ ID NO: 70535 - DNA, 458 bp, Zea mays
  Clone ID: LIB3078-046-Q1-K1-F2
cgagatggtgcttgtactgcatgctaacagtggtaacaaaaatgcattcaaaacactaaggggcgcataatacagcggtgtcaaggttgagttggtgaaggactttcaaatgggtgtctccaacaaaactccagagttcctcaagatgaaccctattgggaagattcctgtcctggagactcctgatggtcctgtttttgagagcaatgcaattgcaagatatgttactcgcttgaaggctgataacccactttatggatcttcactgattgattatgcccatattgagcaatggattgactttgctgcaacagagattgatgcaaacattggaaagtggttgtacccactgatggggttttatccccatgctggtgtggtagaagaatcaactattgctgccttgaagagagcattgggttctctgagcacccatcttgcattaaacacattccttg

SEQ ID NO: 70536 - DNA, 455 bp, Zea mays
  Clone ID: LIB3078-046-Q1-K1-F4
gagctagctagctagtagagaggtcaatcaccaatggcgaggcagctcgttgtgcttgcggggcttttcgtgatcgccggtgtggcgcatggcgcgggggagtgcgggagagcctccgccgacagggtggcgctaaggatggcgccatgcatctcggctgccgacgacccgcagtccacgccgaccagcagctgctgctccgctgtgcacaccatcgggcagagccccagctgcctgtgcgccgtcatgctgtccggcaccgtcagggctgccgggatcaagccggaggtcgccattaccatccccaagcgctgcaacatggccgaccgccccgtcggctacaagtgcggagattacacgctgtcctagctgatgaagacgtcgtcaacgagaccgtgcgagtgaaccagtgcatgaacgaatgccattatgccatgcaacatatgtgcgttgcg

SEQ ID NO: 70537 - DNA, 455 bp, Zea mays
  Clone ID: LIB3078-046-Q1-K1-F5
cccacgcgtacgaaactgaagatgacgtccctatcactaggttaaagaggctaacgagagggcctgcaaagactaacagaaggtgacagaaagtgaaaatacacgccggtgcaatgcttcatttggactggacggattttggacttaacgagactgatgcatgaatcatgatggcatgagaccttcgtttagcacactgccagctataattctctagctattgtgtagtacaatttggaaacatgcgttgctgttggattatgcgtctgtttgtaaataagtgtccctcgcattcaaatgttgcagcttaggccctgtgatccattagctactaatagttagctagctgatacactaaagggcgttagaacgtactagagctaatagttagttgactaagtgaaactagctagctaacaaatatttatctaactattagctaatttgctaaaaat

SEQ ID NO: 70538 - DNA, 437 bp, Zea mays
  Clone ID: LIB3078-046-Q1-K1-F6
accgcgtcaagatcctcatgcagacgcatagcgtgcgggtggctggagagagtgccgaggagggtgttggatttctcgaggctatggcagacattggaaagaaggatgggcttaagggttactggaaaggaaaccttgcacaggtcattcgcattattccttacagtgcaatgcaactcttctcggatgaagtttacaagaaaattttacggacaaaggatggagagctttctgtatttgggagacttgccgctggtgcttgcgcgtgcatgacatctacacttggaacttacccactggatgttctgcggcttaagctaccagctcaatctggacacagcactctatgataggatgctcttaacatgctgagagaagaagggctggactccttctatggaagcattgggccatctattgtagcaattgcaccttac

SEQ ID NO: 70539 - DNA, 447 bp, Zea mays
  Clone ID: LIB3078-046-Q1-K1-E3
ggctcctcgtcggcaacctgcaggtgctgtcgtcgaagcgggcgctcgcgccgctgtccggcggccgcgtcgacacgcgccggccgcggcacgtctgccagtccaagaacgcagtggacgaagttgtggtggcggacgagaagaactgggacgggttggtgatggcgtgcgagacgccggtgctggtggagttctgggcgccgtggtgcgggccgtgccggatgatcgcgccggtgatcgacgagctggccaaggactacgccggcaagatcacgtgctgcaaggtgaacacggactacagtcccaacgtggcgtgcacctacggcatccgcagcattcccaccgtgctcatcttcaagggcggcgagaagaaggagagcgtcatcggcgccgtaccaaagttcacgctcaccaccctcatcgacaagtacatctgtagctcatgag

SEQ ID NO: 70540 - DNA, 267 bp, Zea mays
  Clone ID: LIB3078-046-Q1-K1-C9
cccacgcgtccggcgccgccagacactccgtagtctgtaccccaagcaccggcgcgtcggcggctggtgaccatggcagtcgggaagaacaagaggatctccaagggaaagaagggtggtaagaaaaagaccgtcgatcccttctctaagaaggactggtatgacatcaaggccccatcggtcttcagtgtgctcaacattgggaagactctcgtgtccaggacacagggtaccaggattgcctatgatggtctgaagcacatagtc

SEQ ID NO: 70541 - DNA, 200 bp, Zea mays
  Clone ID: LIB3078-046-Q1-K1-D1
acgcgtccgccaggcgttcgtccacgcgtccgtccacttgttttaactgaagggttttcatgcaccggggacgggttacccaagatcttgatggtcggcaacagataccatgaccctttgcttaaagcgatggaattcctggtgtccagattattgaaaccttgacaaggccttaaggatctagttggaagcccacatta

SEQ ID NO: 70542 - DNA, 393 bp, Zea mays
  Clone ID: LIB3078-046-Q1-K1-D10
gggcaaccggctcgccacctactccgcgccgcatcctggggtaaggtttatggtcaagggatgcccaattgaaatgagacttaagagatgggagcgaaagaagtgtaaaccaaacagtcttcctgtgctgcacaagatgcatgttaggatcggggacacggtacaggttattgcaggccgtgagaaaggaaaggttggagaagtcacacgccttttcaagcacaacagcacggtgatcgtgaaggacctgaacttgaagtcgaatcacaagaaaggcacagacgatgaacccggtgaaatcgtcatgattgaaagccccattcatagctcaaatgtgatgctctactctaaggagaagagtgtggtaagcaaggttggccacaaattcctgga

SEQ ID NO: 70543 - DNA, 428 bp, Zea mays
  unsure at all n locations
  Clone ID: LIB3078-046-Q1-K1-D11
tcggaagatttaggaacaccactctctcggttgttaggacttatacaagatgtgtgcattggggaaagtggaccgcacttggactcgaagcatgcgtatgttattgttaggcatgtgaagtttgcaacaaagaaaggtgggaagaaagctagccaggccatggaagatgcaggaaaaggtaccagcagtgctgtcccatagtcacccgttgatggcagcaataccgaagacatggcagttggacatggtctcgggaaacctgatgatcgtaccatctcagatcgtgttaaggaaacagccacccgtctcttcagagactccnctgcccaaaaagaggggcacgatagagaatttaaaagggagttcaattggccaaaatccaacccaggggctggtggaaacagaaataatcctgccagaggggacca

SEQ ID NO: 70544 - DNA, 431 bp, Zea mays
  unsure at all n locations
  Clone ID: LIB3078-046-Q1-K1-D2
cggacgcgtgggcggacgcgtgggaacaaacctgcagatcccccatggcaggctccacggggcgtcgttccccttcccgtgcgcgcccctccatctcgccaccgcttccacacgtccacgtccgcatccccccgccacctgcgcccctcccctgctacacgcctccgcgctgcccggcgtcggcatcccgacgccgtcgttgtcgtaccagatgcccgcccctgggtcggcgatctatcgggcgccgacgcgtcctaccgggacggaagtgaggaggacgaagacgacgcagatgaagatgaggacgaagacgaagaccgcagcctggacctactggcccggttcctgcactccgtattcaggaaggcctcacgccgngcgcgccgggctgccaggtccgtgctgtcgacttccgtcccgccgagctggtg

SEQ ID NO: 70545 - DNA, 340 bp, Zea mays
  Clone ID: LIB3078-046-Q1-K1-D3
atggaatctgagaggaatcctcaacacgtcttggcatcggatcaaaattcagagatcttggtgcgttgaaagatctaagctgtgaaattaagtacgcagctgatcacttggagcaagcagactcactttaccattgtcccagaataataattagtcacttcaactttctgcgtctgtggagtaaggttgtacgagtgttggggctgtgtcattatgggatttgagctcacttggtttctgtgtaaatgtcagctgctgcggtttttttggtcactggatgactgctgctgttggctggtcaggtttgatatcgagaaatatccattgcattctgcgtttg

SEQ ID NO: 70546 - DNA, 402 bp, Zea mays
  Clone ID: LIB3078-046-Q1-K1-D4
cggacgcgtgggttacggtaacgccgtcgtcgtcctacggttcagatcttcgtcgtcatgttggccggcaacgagcacccaaagatggtggtccttcaaccagatcggttcctgagcgagctgacgtgcatgtacgagcggagcacggagaagggctccgtctgggtcaccatgaagcgatcaactctcaagggcaaggcacagttgcggaagatggagaataaggggcaggaggtagagcacaggtgcctcatccgcgcctccaatggcaagaagaacatctccacctcggtttctctaaaggagtacacaaagttccaagcttcatacgcaacaggtcttaaagcccatatgcatgctctgaagaaaagggagaggaaagacaagaagaatgctgcagat

SEQ ID NO: 70547 - DNA, 398 bp, Zea mays
  Clone ID: LIB3078-046-Q1-K1-D5
gtaagccactccctgaagtccatgaccgggactgtgagtctgattttgaggagatgcatgatactgatgaggagctgaatgacctgtacaatacaagggagtatgttgtgaagaagatcaagagtgatgagttctttaacatggatgacacacagtgggatgccatgatcaatgaagccacagacaagggtcacttaactaacatgaacgagtgcgaggaaatgctcgaggacatgctctactgggacaagctacttgctgatgagatcaagcaaaaggtggagaccaaatgtaatgagttgggagacatgtgtgagacgtgagagatggaacctgagcaagcatatgagatgttcaaagaatgtgaggataagatggtcgctgagtgcactgaatta

SEQ ID NO: 70548 - DNA, 290 bp, Zea mays
  Clone ID: LIB3078-046-Q1-K1-D6
aattgccgggacgaacgactcgtccgacacctcatcaaccgcgacccaataatcgtgcgcctggacacacgcatgatctaaaggcggctcataacgtgccaccagtgaaacttgatgttctaccagatctgacagtgcacgatgctactcgccttgaagatcggcctattccactgctaactccttggctctccatgaaggctaaatctctaaatcggaaacactcatcctacacggacaggcatgcgcgctcgatacatccagcatcgtcgccatatacagggactgaa

SEQ ID NO: 70549 - DNA, 444 bp, Zea mays
  Clone ID: LIB3078-046-Q1-K1-D7
cccacgcgtccgcccacgcgtccggttatatcctgatgactgcaatgcggatgcccaggtggaaattgtgaatgcatgagccaccaacaacgtgaggtatggtggcaccatgtacaccgagaagagcgtcctcttgaggcacggaactcagagagcatgtgcgagttgctcgtgcgccacagggcgacacgtatcagtgcacacacttagcacacagaataaacagcttctacacggcacctaagaagctgttggcatctgattcacggctgaggcctgatagatatgccctcgagaagggtgacatgtctaagtccggggcagagaagagcaggctcgaggaacaacagagagctgagaaacgaactccagaggccaagggcgagcaatttactcctagatggttcaacctgacagatgtggtcttctctacaccgtggggtg

SEQ ID NO: 70550 - DNA, 341 bp, Zea mays
  Clone ID: LIB3078-046-Q1-K1-D8
ccgacgcgtccgctgacgcgtcggcgccttcttcctaccgagctaacagcgtacgttctcgcgtgaaaccatcagcagcagcggatcgtgctacagtgaccctagcattaaagactgcgcttgaaggagtatgacagtctgctacctcgatcatgactcaagaataaggctaactgcaagcctgacttgtaaaagcccaggctcgatacgccgtcatgcgttgccaacgggcaaggttaggaacgaaaatgcttgatacaggatcactggactccaacaactagtcgctccttttggaaagacggacacagcatcggtgctcaatgagaccatcgagtaca

SEQ ID NO: 70551 - DNA, 460 bp, Zea mays
  Clone ID: LIB3078-046-Q1-K1-D9
ggcggctttagtatgggtgctgctactgctctgtactctgcaacttgctttgcccatgggaaatatgggaatggcaaaccattccctgtgaacctaagtcttgccgttggtcttagtggctggcttccatgtgccaggaccttgaagaacagaattgaagcctcaccagagtgttcacaaaaggcttcatcaatacctcttttgctctgtcatggaaaagctgatgatgtggttgcctacaagcacggggagagatctgctggtgccttgaaggcaaatggcttttccaatgtgctcttcaagtcatacaatagtcttgggcactacactgttccagaggagatggatgaagtttgcaaatggatcacaacaaatttggggctcggcactaagtcatcttgattggaaaatgatgcaagaaatactcgcggggacggtttcaaataataccggttttttt

SEQ ID NO: 70552 - DNA, 391 bp, Zea mays
  Clone ID: LIB3078-046-Q1-K1-E10
cccactcgttcgtgcaacctgtggctaggtagaatgtgggctacttgagggcaactggggatcgacaatttgatgcagcacagcaagcttaccatgctgtgccaggagcagccatggcggatttgagcttcaaggagtctatacaggcatatgcaatggaacaaggtttgctatttatgcctagagttggcaagttctataatggcatgccagtgtatgagttcggcacagttagtatttgcatagactctgtgaagcgactactctatgcacaacttcaagagggaatcgacagatggagtcctgtaactcttacacaattgatggacatgaaccgaattggaagaccacactagtagatcgctcctagcccttgacttgcatgatggtt

SEQ ID NO: 70553 - DNA, 234 bp, Zea mays
  Clone ID: LIB3078-046-Q1-K1-E11
gtcgacgagtctatcaaccattcagaatctctgctggagaagctcaagacgatgtcttgtgagattgaggtgaggtctcggggtgctgtggagagagtgatgcatcatgtgaggtccttcatcgcaatcctaaagcatcatgctgcagatgcaaggcagtggtgtacctagtttggggcttgtgctgcttccatgtcttacgttgtttcatcacaatgtgaagggaagcttatc

SEQ ID NO: 70554 - DNA, 425 bp, Zea mays
  unsure at all n locations
  Clone ID: LIB3078-046-Q1-K1-E12
gcgatgatggagccactggtagatacagtggatgcaaatcagattgtcacgaactgccggttactgaagacaatggatatctccaaaatgaccccaggtgactcgtcctttactgtaccattcaagctggtagcagagcggaatgattacattcatgctcttgtcgcatactttgacgtgtcgttcaccaaatgccataagctgatgggcttctcaacaggcccgagatcgaaagccactcactggaagcaaactgttctctacctggaggatgttataactatctgtcagggggaaagcctgagtggttccatgacagtcacacccaataagagtaaccctcgagatatcgacattaagctcaagtactccatanatgggcataggtgtcaggtatcaagaacacagttctacatgatgcggtg

SEQ ID NO: 70555 - DNA, 239 bp, Zea mays
  Clone ID: LIB3078-046-Q1-K1-C8
cggacgcgtgggctgccgcctacgaacacttttgtctactccgcacaggagcctccaccggagtgagtttcctaacagtggtcgaccgtccatcctgacatggcttaacacgacgcacatgcgatgcccgagccacatgacgcacctgcacggctacaagagtccgcgctggacggactcggcatccatacaccagccgtgccgtatcagatgcgacgagatgggtaagtgatctatcg

SEQ ID NO: 70556 - DNA, 460 bp, Zea mays
  unsure at all n locations
  Clone ID: LIB3078-046-Q1-K1-E2
cccacgcgtccgcggacgcgtgggcgccgtcgtcggaccaagctagcagcgtacgttctgggggcaaaccatcgccggcagcggcgcgtgctacagcgacccttgcattaaagactgcgctggaaggagtaggagagtctgctagctcgatcatcaccaagaagaaggcgaacggcgagccggccttgaagaagcccaggctcgagacgccgtctccgttgccaacgttcaaggttaggaaagagaagctaggggacaggatcactgcactccaacaactagtcgctccttttggaaagacggacacagcatcggtgctccatgagaccatcgagtacatcaagttgctccacgaccaagttggtgtccttagtgctgcatacttgaagaacaacggccatcatcaagtgctccgncacttgaagagctcaagtcctgacaagtcgtccaaagacgacca

SEQ ID NO: 70557 - DNA, 458 bp, Zea mays
  Clone ID: LIB3078-046-Q1-K1-A8
gtacgcacgcaccgggacaccagcaacccttaacagcgccactgtccagtgcgcgcgtcaggcgtgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgtcggcgtcaccggaccttctgccgatc

SEQ ID NO: 70558 - DNA, 165 bp, Zea mays
  Clone ID: LIB3078-046-Q1-K1-A9
cccactcgtccgggggatgatggatgtgatgaacggatgcaagaatctgaggaagctggagattatagacagtccatttggtgattttgcactcttgggaaatgttgccaaatatgacacaatgcgatccccttggatgtcatcatgcaatgtcaaattaaaggg

SEQ ID NO: 70559 - DNA, 353 bp, Zea mays
  Clone ID: LIB3078-046-Q1-K1-B1
accggagcaagagctaagtcgcctcgaattcttaccagctagtagcgtgtgccgtacccggtcgctcaaccgggatggcctacaacggcgatccgcccggatctgctgatgagaagaaaactccaatatccgaagggtcttccgacgaacgtcaagggcttcctacagcacgcttttcaaatccttttgattatggttctatgcaaagtttgctcaatgatccatctattaaggagatggcagatcaaattgcaagggatcctggattcaaccggatggctgaccagctacagaaaagggctcaaagcacaagagaacatggcacaccttcaattaattcttaacaattcatg

SEQ ID NO: 70560 - DNA, 143 bp, Zea mays
  Clone ID: LIB3078-046-Q1-K1-B11
tcgctgatgtctaggacaataagcagaaggctttatgcattgagaattacagaaagaaatatggggatttgctgtacaccttatctgatattgatgtttaaaaggaaaaagaatgtgggattttcattgaaatgaacaacaaa

SEQ ID NO: 70561 - DNA, 364 bp, Zea mays
  Clone ID: LIB3078-046-Q1-K1-B12
tcgcagtagtcccctcacgttctcttacttctctagcgccgtctcccaccagactagatggccccgtagaaggtcaaggcccctccttcgtagtctaatccggccaagtccggtggtggcaagctaaagaagaagaagtggagcaagggaaagctaaaggagaatgtaaacaacgcggtgctgttcgaccaggctacctactacaagctgctctcggaggtgcccaagtacaatcatatgaccccttctatcctcttctagcgtctgatgatcaacggctcccttgctcggagggccatcaaggtcttgatggcgcgtggcctcattctgatggtctcggtccactcaagccatcagatctaca

SEQ ID NO: 70562 - DNA, 388 bp, Zea mays
  Clone ID: LIB3078-046-Q1-K1-B2
cgcgtccggtacgcacgcaccgggacaccagcaacctttatcagcgccactgtccagtgcgcgcgtcagtcttgcttatctagccgccatggcctccctcgccgccgtctccgtgaagcccgtggccatcaagggtctcgccggcagctccatcttcggaaggaagctcgccgtctccaggccgtcagcccgctccattcgcaggccccgcgcagccgccgtggtggccaagtacggcgacaagagcgtctacttcgacctcgacgacatctgcaacaccaccggacagtgggacctctacggctctgacgcgccctcggcctacaacccgctacagagcaagatcttcgagacgttcgcggctcctttcaccaagagaggtctgctg

SEQ ID NO: 70563 - DNA, 223 bp, Zea mays
  Clone ID: LIB3078-046-Q1-K1-B7
cggtggcgcaccggacagcgtccacttcttcaggctggctcaggctaactcactgcgatgtctatctccaaaacctcgtgcgggtcaactttcaccggactgttcggtatgcaccggactgaccggtgagccaacggttggtcgaacgatcctcacgagacacctgatctagccaacagccaaaatgatgcacctgactgtccggtgtgcacaagacattgtc

SEQ ID NO: 70564 - DNA, 445 bp, Zea mays
  Clone ID: LIB3078-046-Q1-K1-B8
cccacgcgtccgaggatattctcgaaggcgttttattcctgaagcatgggctggtgctgggcggccattacatcaccacgcctgaacgtgttccaggcctacacgctgaagcggataagggaccccaactgcaaggcgacgccccagtcgccgctgtccaaggagttcgccgacgagaacaagcccgtcagactggtcaagctgaacccggcgagcgagtaccctgacggcctggaagacacgctcatcctcaccatgaaaggcatcgcctgctgcatgcagaacactggctaggcagcttatcttcactcacctgcagagtgcaccgcaataatcagctttcggatggtggcgttttgtcagttttggatggaaatgccgaactggcaacgtctgttttccctatgcatatggaatttcctgcctctttatattcactctttgt

SEQ ID NO: 70565 - DNA, 278 bp, Zea mays
  Clone ID: LIB3078-046-Q1-K1-B9
ctatgtcggcccagctccattgcaagatatgccaatgcaaatagctgcaccctatggccctactgcctatcatatacatcacccgttctcaatggacaaagcattaaccatcattagccacgaagattattcgatcatacaacttgcaaacaatttgaggacagcactgaactgaacaactgataccaacatcactcgagccaatgctaccctgaaatcacattccccttttgtgcacctgtcctccctttcaaaatgcacacttgtggactccaaat

SEQ ID NO: 70566 - DNA, 328 bp, Zea mays
  Clone ID: LIB3078-046-Q1-K1-C1
atgggtcgacgacgcgtccgaccacgcgtccggccacgcgtccgcccacgctttcgcactcgctcggggtcatgcaccgggaccggaagcccgagaacttcctgctcgccaacagggacgatgacctcttggctaaaggccatcgattttcggtctctgtggcttcttcaagcctggtcaagttttcaccgatgtagttggtagcccatattatgtagctccagaagttctgttgaaaagttatggactcgtagcttatgtatggacagccggtgatattctatacattctactgagtggtgtgcctacatggtgagcagcaccacaa

SEQ ID NO: 70567 - DNA, 187 bp, Zea mays
  Clone ID: LIB3078-046-Q1-K1-C10
cccacgcgtccggttcgacggccgggacccggacctgttccgccactacgccgccgtcgggcagaggctcggcgtctacaccaccgtcgactacgccgacctcgtccagttcttcgtcgacaggtggggcgtggcggacctaggccccggcctcaccggcgaggggaggcaggcgcaggactacgtc

SEQ ID NO: 70568 - DNA, 341 bp, Zea mays
  Clone ID: LIB3078-046-Q1-K1-C11
cccacgcgtccgcaaaaccatccacactttcccctttccccttctcttcccaaatcgtagcgagcgcgagaccacgcatgcgtggtggttgaccgcagcgtcgagcgcagaccacgcacgtcgtcatcctctagcggccaaatccatctccggcgtgcggcggacgtttgagtctccgacgagcggtggtggtggtctccagtgagcggtgcgggcatgtctcccaggtgcgcggcgtgggctagttctcctacgagcgcggcgctgatccccctggcgggcggcgctggcggtcccaggcgtgcgacagctatgttcctggccggcagcgctaacggatc

SEQ ID NO: 70569 - DNA, 441 bp, Zea mays
  Clone ID: LIB3078-046-Q1-K1-C12
gtcgatgcgactgaggtcgcggtgatggccagcggcacgtcaaagaagggctgcaagaggaagacacacaaggttctttcctactagctcgtccttagttcttttgagtcctttggttgttcgatgccttctactgattcatgtctcgttcggttatgtgtgtcatcactcgtcatggcgtcggtgaagcggtttcgagtgacagggaaggacaagatcgtgcggcggtgcgccgggaagcaacacttgctcgccaagaagaacaccaagggcaagaagagactctccaagatggtctatcgttggaaatgaagggacatgtcgtttttctgtccaacgagaatagcacttgtcttctgctaatattgccgctggacatacgaactctgtgcttttgtgtgcaagcaatactcgctaatagtctgttccgatttctaatga

SEQ ID NO: 70570 - DNA, 439 bp, Zea mays
  Clone ID: LIB3078-046-Q1-K1-C2
cccacgcgtccgaggatattctcgaaggcgatccattcctgaagcaggggctggtgctgggcggccactacatcaccaccctgaacgtgttccaggcctacacgctgaagcggataagggaccccaacttcaaggcgacgccccagccgccgctgtccaaggagttcgccgacgagaacaagcccgtcggactggtcaagctgaacccggctagcgagtaccctgacggcctggaagacacgctcatcctcaccatgaaaggcatctccggcggcatgcagaacactggctaggcggattatcttcactcacctgcagagtgcaccgcaataatcagctttcggatggtggcgttttgtcagttttggatggaaatgccgaactggcagcgtctgttttccctatgcatatgtcatttcctgcctctttatattcactc

SEQ ID NO: 70571 - DNA, 268 bp, Zea mays
  Clone ID: LIB3078-046-Q1-K1-C3
cccacgccgtccgagcatggtgctcctgacactcggaagacaagtaagtactcttctagagcggggcagccgtgaaggaaacccagctgccccggattcagattacagacccgatagcaagatactatgggatgaagcgtgggcaggtcgtgaagatcacaagagccagtgagactgctggagatacatcacctaccgctacgttgtctgagctttgctacattctcatggcttaagcttccgcaccaagcgaaaatgacctctactt

SEQ ID NO: 70572 - DNA, 434 bp, Zea mays
  Clone ID: LIB3078-046-Q1-K1-C4
cggacgcgtggggtgcagccgacaccgccggtgtactactccgcgcaggagctgcagccggagcagccggcgaagcagtggtcgccgtcgtacctgtacatgccgtacccgcacgcgcaggcggcgccggagccttactaccagcagcaggactactacagcccgcccgggacgcacgcgtcgccgatgcacgacccgtaccgcatcttcgacgacgagaaccccaactcctgcagcgtcatgtgagaggcgagctggtcggcgcggcccggacgccgccggccgccgtgggcagcgagtagtttgggggggaggcggcgccgcgcgctaccgcaacatcagagagagacgtctctgtggctgtataggtagagtagcctgtactggttaccacccctcttccttccatcctatttccacctagtatagaggtc

SEQ ID NO: 70573 - DNA, 95 bp, Zea mays
  Clone ID: LIB3078-046-Q1-K1-C5
actcgtccgatcggtaaccccatcctgatccacgctcatagcatcctctccatctggtactgccaggtggtgttaatggataccttctaggccta

SEQ ID NO: 70574 - DNA, 418 bp, Zea mays
  Clone ID: LIB3078-046-Q1-K1-C6
aaggaaagggttcgtactcatggcgccgtcgcagccaaagtcgggcctcttcgctgggggcaacaagggtcatgtcgtcaccaagcgcgagctgcctccccgtccgtgccaccgcaaggggaaatcaacgaagagggtgtctatggtcaggggcctgatcagagaggttgctgggcttgctccttatgagaagcgtatcactgagcttctgaaggttggcaaggacaagcgtgccctgaagcttgctaagagaaagcttggtactcacaagagggcaaagcagtagatagaggagatggctgtcgtcctcaggaagatgccgtcggctggtacgcacactgacaagaacaaatagagagcatttcaagttcatggagcctggcagagattatgtttcagtgtccgattttccatacat

SEQ ID NO: 70575 - DNA, 386 bp, Zea mays
  Clone ID: LIB3078-046-Q1-K1-A7
cccgggtcgactcgcacgcgtccgaccggagcaagagctaagtcgcctcgaattttttcgagctagtagcgtgtgccgtacccggtcgcttaaccgggatggcggagagtggcgatccgcccggatctgctgatgagaagaaaactccaatatccgaagggtcttacgacgaacgtcaagggcttcctacagcacgcttttcaaatccttttgatcatggttctatgcaaagtttgctcaatgatccatctattaaggagatggcagatcaaattgcacgggatcctgcattcaaccggatggctgaccagctacagaaaagtgctcaaagcacaggagaacatggcacacctccattaaatcctcaacaattcatggaaacaatg

SEQ ID NO: 70576 - DNA, 369 bp, Zea mays
  Clone ID: LIB3078-046-Q1-K1-C7
gccccacgcgtccgcccacgcgtccgcccacgcgtccgctgagtatcagctgattgatatttctgaggatggatgggtgagccttcttacttcagatggcaacactaaggatgatcttagactcccaactgatgagactcttgtggcccagattaaggaagggttcgaaagcggtaaggatcttgttgtgactgtccagtctgcgatgggggaggagcagatctgcacgttgaaggatgttggccccaagtaacttccttggctttggagacggaaccctactgtatctcaacttaaatcggaaaagaagtgtatcaccaaatggatagctaccgatacattcacctggcttgaactggcttttgctat

SEQ ID NO: 70577 - DNA, 386 bp, Zea mays
  unsure at all n locations
  Clone ID: LIB3078-039-Q1-K1-A3
acgcgtccgcgttgcgcaactcctgtcagagcggttaattccttttgttgcccttgatgttagaagggaggcggttgcagttgggcgtgcacttgaccttccggtatattttggggatgctggaagcagagaggtactgcacaaagttggagctgaaagagcttgtgctgctgcaattactttggatacccctggtgcaaactatagagctgtctgggcattgaacaaatatttcccaaatgtgaagacatttgttagagcacatgatgttgatcatggtgttaatttggagaaagctggtgcaacagcggttgtccctgagaccttggagccaagtctttagctagctgctgctgntcttgcacaagcaaaaactcccaatgtca

SEQ ID NO: 70578 - DNA, 416 bp, Zea mays
  Clone ID: LIB3078-039-Q1-K1-A4
atgtttcgacctcatcgagcagtataacctgaacgggcacatccgctggatctcgttccattttaaccgcgtccgcgactgcgagctttaccgctacatctgcgacaccaatggcgccttcgtgcagcctgctttctacgatgctttcgggcttactgtggttgaggccatgacctgcggcctgcccacgtttgccacagcctacggctgtcctgccgagatcatcgtgcacggcgtgtctggctaccacattgacccttaccagggcgacaaggcttttgcccttgctcgtggacttttttgacaagtgccatgcttactcctagccactttgagcaagatcttccatggctggcttcaacttatctaggagaaattcccctggaaactttactcttataagctttttaccctta

SEQ ID NO: 70579 - DNA, 377 bp, Zea mays
  Clone ID: LIB3078-039-Q1-K1-A5
cacgcgtccggcaagatgacgtcgtcgacggcgttcatccaactgttcccttccgccgctgcgggatgccccgtccctcgctgcgtctccctgcagctcttctgcgccagcggtggagttgtccctggatggaggagaagatgccgccgcatggccatggtgcgcgcggccaccgtggatgctgcggcgcccgcctacacctccgattccctcatcctctacttcaaggcggagggcaccatggaggagagggccattcccaagatcacagaatctcttgagggtatggagggagtcaaggacctggaagtgctcattgaagaaagcataaggagcgttgtgttaacaaaagagacaactgtgcaagctactggagt

SEQ ID NO: 70580 - DNA, 444 bp, Zea mays
  Clone ID: LIB3078-039-Q1-K1-A6
gcacactgcagtgttcgtttctgtcgttaagagagagaagaggcagcgacgatggatgagcctccgccacagagcgacgacgaccggaagctgtcggccatggagcacgtcaagaaacgccacgaggagaagggattcctctatgcctgcgccttcatgttctgctgctgcttctgctgctacgaggcctgcgagcactgcctggagtgcttctgctgctgcggcaagaaggacgagtgattaaggccggtccaaccagttccgcccgcccaccaatgatgaatgatcggtttgtaattcgtcgtggatttgatttgtttcggttgtgatttgtgaagaactgcgatcaatctggaactgttcgtcgtgatagaacatgcatgttgatgctgtaaataaatgcgattggtttggagcgttaactctacgttaaccgtacgtact

SEQ ID NO: 70581 - DNA, 362 bp, Zea mays
  Clone ID: LIB3078-039-Q1-K1-A7
cactcactcacctagctagtcatcactactcacgttcgtccaccagagacaacagtggccatggagacgtgcttgagagcgtgggcgctgcacgcccccgctggcagcaaggacaggctcctcgtcggcaacctgcaggtgctgccgtcgaagcgggcgctcgcgccgctgtccgtcggccgcgtcgccacgcgccggccgcggcacgtctgccagtccaagaacgcagtggacgaagttgtggtggcggacgagaagaactgggacgggttggtgatggcgtgcgagacgccggtgctggtggagttctgggcgccatggtgcgggccgtgccggatgatcgcgccagtgatcgacgagct

SEQ ID NO: 70582 - DNA, 286 bp, Zea mays
  Clone ID: LIB3078-039-Q1-K1-A9
cgccgccgcagccatccgcttgttctcttcggttcagttctcgagtttccaggatgagggtaagagctgcctatctgcttgctgttctgggtggaaacacttccccgactgctgatgatgttaagagcattctggaatcagttggtgctgaagctgatgaagaaaaactagagttcctgctcacagaactcaaagacaaggacataacagaagtgattgcagctggaatggaaaggttatcctctgtgccttcaggtggtggtgcaattgacatgggagctccagc

SEQ ID NO: 70583 - DNA, 387 bp, Zea mays
  unsure at all n locations
  Clone ID: LIB3078-039-Q1-K1-B1
aaaaaggatgctgaacaggaaaattgcccgttttggtgggctcggtcgcctgagaaagtacttcagcaggatacttatctagcattggctatcacatttgttattttgaggctgctgtatcgtctttttccaaagattgattcctttgctagatgggcatggaggaggcataatctgtttgcaaacttgatgggggcacatgaatatttcctcacctaccttgagcaaggaagacagaagtttcatcggctatacccttcaagttcgaagcgaggaaatctgcaggagggggcaatgaacgctaccgcttgggccttcaaatcattagcatctngttcgattggagaaccaagtgcgattggaaggacaaactctaccagtgagctt

SEQ ID NO: 70584 - DNA, 434 bp, Zea mays
  Clone ID: LIB3078-039-Q1-K1-B11
tgatgatcagctgcacacagaaagatcaattgaaattgatgaggatatcaaaaagaagactcgggctttagaaataccagcataccaagacaatccccaggatggaatttctggtgaattgcagacagaagaagcagctggtgtttctacaaaaatggtaactagagatattgatatttcgagtgttgtgctggacaacagaacagttggtactgtgtgtcaggaaaaaatggaggtatcaacaaaaaatgaaaatggaagcttgaggagcagcctgaatgactcaacaaacacaatggctccccaagacgatactctaggagaaggacaatcaaagctcgtgctttgaaccttacctgaagacaaaagtgttgatgtactttctgagcaagcaacctttgtgacagaatcaggaatgactgacgcgaatgact

SEQ ID NO: 70585 - DNA, 270 bp, Zea mays
  Clone ID: LIB3078-039-Q1-K1-B12
cggacgcgtgggtgctttttcatgctatccatgtgcaggggacgcaaaataacacacgatggtgtgttgctgctctagtggtcggaggtccgtcagattcttcctttttttttgtcccattgttgagacagcaaccgaggatataagattggatggagatgaggtctctgtttggcttgtgctgatgcctgcatgatgtgctctgcgatgtgcatccagttttgggatcaagctgctccacttttccggagctgcccttgcatggatttt

SEQ ID NO: 70586 - DNA, 430 bp, Zea mays
  Clone ID: LIB3078-039-Q1-K1-B3
cccacgcgtccggggattgccgccccagctggctggttatatattaggctgtcgccggcaaagaaagaaaggcctgcttcttcacctcgcgctccaggttcatgttttgagcgtgtacagtgcatgtggtttcagaaatggggacgctggcgtgcccatggagatctggccacctctttgctttcatcaccttcgccgtgctgttcttctcgacttcatttgccgggagacagtacagtttcttgatggatcaagatgccctacgtcaacaagaaggagagggagcacgaactgagcagaaggaagcgctagtgccactggtgcaagctcggcggctcagcgtcaagacgaacgattacagcagctatgacccttccccgtccatggacaagccacactccaagctcataccgaactgatcaatcatgta

SEQ ID NO: 70587 - DNA, 154 bp, Zea mays
  Clone ID: LIB3078-039-Q1-K1-B4
ctatggtgtctacttatgctcacatgttatgttaagaaacattcgattcatcattccggtgccattctaaggaagttggggaggtaagaattactgactatgatgttattcctgtgaaaggcacaaaaaacaccatcgcggtctttataatact

SEQ ID NO: 70588 - DNA, 428 bp, Zea mays
  Clone ID: LIB3078-039-Q1-K1-B5
gtcccaccgaccgcaatgccggaggacaaggagtacgcgcccgtgccgctcgggcaggcggcggccgaggcggcagcgcctgactccgaggaccctgccaagtcgccgccgcgacccagctcgcccggcacgtccactcgcaaggcattctttgctgttcttcaaagctgggtgtcaagaaaatttatgactggatgtgtagttcttttgccaattgctgtcacattcttcatcacttggtggtttatccaatttgttgatggttttttcagcccactctatgcaaaactggggtttgacatattcggccttgggttcttgacctccctggtgtttatacttcttgttggaatctttgtgtcttcttgggtgggttcaacggtcttctgggttggagaatggtttataaaggaaatgccctttgtaag

SEQ ID NO: 70589 - DNA, 247 bp, Zea mays
  Clone ID: LIB3078-039-Q1-K1-B6
ctatggtgtctacttttgcggacatgtaaggtgaagaaacattcgattcatcattccgtggccatgctaatgaagttgtggaggaaagaattgctgacaatgatgtaattctggtaaaaggcccaaagaccaccaacgcggtcttaatattactaagggccccaaatgcctacttccttgttaagattgaacggtccttgcataatgccctgtccatgtgaaagagaaccttgaaatcaaatatggt

SEQ ID NO: 70590 - DNA, 435 bp, Zea mays
  Clone ID: LIB3078-039-Q1-K1-B7
cccacgcgtccgccgagctggccgtccgccgcgtcgccgcgctcgcgggggaccgctgccgcaacctgtctttccacaagattgatctccgtgacaagggagcactggaaatggtttttgcttctacaagatttgaagctgtcattcacttcgctggattgaaagctgtgggtgaaagcgtacagaagccattactttattatgacaacaacgtcattggcacgataaatcttctagaagttatgtctgttcacggttgcaagaagttggtgttctcatcatcagctgcagtttatggatcacccaaaaactcaccctgcacagaaaattttcctcttactccaaacaatccatatggcaaaacaaagctcgttgttgaagatatttgcccggatatctaccgttcaaattctgaatggaagaacattttactta

SEQ ID NO: 70591 - DNA, 308 bp, Zea mays
  Clone ID: LIB3078-039-Q1-K1-B9
cccacgcgttcgggcgctcgggagggaccgcacttcgtgggagaagccggaggagttgattccgtagctgttcgtgcaggaaccgggcgccgtggacgtccacatgaaaggcaaggacctcatgttcatcccgttcggctccggccggaggatctgccccgggatgaacttcggattcgcgaccattgagatcatgctggccaatctcatgtaccattttgattgggaggttccgggctctgcagcaagggtgtccatggactagtcctttgggctgactctttcactgaaggagaagctttttcttg

SEQ ID NO: 70592 - DNA, 396 bp, Zea mays
  Clone ID: LIB3078-039-Q1-K1-C1
gcagagcatccttgccatctgggcctgccaggtcgtgctcatgggcgccgtcgagggcgtaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgagggaagcgccgccggtgacctttaggtgtccggatgcatgttagcgcacgctggtttt

SEQ ID NO: 70593 - DNA, 334 bp, Zea mays
  unsure at all n locations
  Clone ID: LIB3078-039-Q1-K1-C10
cacgacgttcgtcgagacagtgccattcaagacaatagccatgttcacagtgttccagacaggttacctgttggtctgctttggaatcacatggattccaatagccggagttcttttccctctcatgatcatgctcctggttccagtcaggcagtacatcctccctaagctcttcaaaggtgcacatctaactgacctggatgcagctgaatacgaggaatcaccagctataccattcagccttgctgcgcaagacatcgatgtcgcattgngacgcatccagagtgcagtaatcctagacgacatggtcacgagaaggccgggtgagatccaa

SEQ ID NO: 70594 - DNA, 347 bp, Zea mays
  Clone ID: LIB3078-039-Q1-K1-A10
gtcgctgttgactggtttaaagatgcaaagcgaatggatcatgttgctagaagaaagggctgtgcagttcaagtagcggctgagaaggggctctttgcattggctataaatctacaagttcctggcactacaaactacagtatggttttctactttgttacgaagaaactgataccaaactccttattgcaacgctttgtggatggtgatgacgaatttcggaatagtaggttcaagttgataccatcagttcctaaaggctcatggattgttcgacaaaatggtggcagcactacttgtctattatgaaaaagctgtgacattacctatatacgtagctcaaatta

SEQ ID NO: 70595 - DNA, 349 bp, Zea mays
  Clone ID: LIB3078-038-Q1-K1-G1
tccggtcgacgacgcgttcggcacgcgtacggtcgcatcgtgtgctcagtcagatccccgtgccggatttcctaatgccagttgggggtgaaaaccatgactgcttctgcaactgctggtgtgcaaattgtggctgcacgcccttgcatttcggcctcgccaggaattcttaccgcacgggtagcagtttctaggactgattgcatgctcaataccactggtacattccccaaaatcagctgctcctggcctctaaagtttaagcgcaatgatgttgttgtaagagcaatatccgaagagtgttggccgcaagggctttccattgatctcagaggtaaaaaggcattca

SEQ ID NO: 70596 - DNA, 222 bp, Zea mays
  Clone ID: LIB3078-038-Q1-K1-G11
acgcttgagtacggccattacattcacgctcttatccttcccctatggttaagtactcacaggagccggtctaccctaccaaaggggccaacgccattggaagggacctgagggtccactttaagaacacaagggagacagcttttgcgcttcgcaagctgcctttgaccaaagctaagcgataccttgaagatgttatttctcacaagcaagcaattccct

SEQ ID NO: 70597 - DNA, 284 bp, Zea mays
  Clone ID: LIB3078-038-Q1-K1-G12
cccacgcgtcagttccaagacacggagaaatgcccagatagatgtgttgatgagcgctgtgacccatgctacggtgccagacctttgcgagctgctataatgaggcttctgaaggatagtctggccaagaaaatcctgactgatgaggagaacgaaggagaatctgtcatcgctgatgagtattcacatggcaaggtaatagttactaatggtgagagcagtgttactgaacaactggaacctagtgtaactacctaaccgtggtcaaaatcatgatgggaccg

SEQ ID NO: 70598 - DNA, 405 bp, Zea mays
  Clone ID: LIB3078-038-Q1-K1-G2
cgggctcgactacctcggcaacccgagcctgatccacgcgcagagcatcctggccatctgggcgtgccaggtggtgctcatgggcgccgtcgaggggtaccgcatcgacggtggcccgctcggggaggtggtcgacccgctgtaccccggcggcagcttcgacccgatcgggctcgccgacgacccggaggcgttcgcagagctcaaggtcaaggagatcaagaacggtcgcctcgacatgttctccatgttcggcttcttcgtgcacgccatcgacacctggcagggtcccgttgagaacctcgtcgaccagctcgctgaccctgtcaacaacagcgcctgagcctacgctaccaactttcgtgcccgggcagttagcgacggcgtatacatacttgtatgcgt

SEQ ID NO: 70599 - DNA, 365 bp, Zea mays
  Clone ID: LIB3078-038-Q1-K1-G4
catggcgctgcacgccacgctgtgggacggcagctactgggccaccgagaagggcaaggtgccggtggactggtccgacgcgcccttcgtcgtctcctaccggggctactcggccaacgcctgcgtcagcggcggggcctgcggcggctgctgcgacgacaggtggatgagcaagcaggccgacgacgccgagtggggcaccggtcggtgggccgagagcaactacatgcgctacaactactgcgacgacggctggcggttcccccaaggccttcccgccgagtgcaggcgcagctaactagctgattccgccgggtttcgtacgctcggcggcgttcggtgacgacacacgcccttgttgggtt

SEQ ID NO: 70600 - DNA, 401 bp, Zea mays
  Clone ID: LIB3078-038-Q1-K1-G5
ggaacgccatcgagggcatgaacggcaaggagctggacggccgcaacatcaccgtcaacgaggcccagtcccgcggcggccgtggaggcggcggcggtgggtacggtggtggccgtggaggctgcggctacggcggtggcgggcgccgtgatggctgcggcggctacggcggtggcggcggctacgttggcggcggcggctacggtggtggtggcggcggctacggctgtggcaaccgtggcggcggctacggcaactacgacgggaactggaggaactgagcggtggggcccgcgcggacaagttatgctgatcgctgccgtgatgtttaccctagtccagagggtttatcttcgttcgtctcgtgtttgttgttgcccatctgtgtttttgattgcaag

SEQ ID NO: 70601 - DNA, 468 bp, Zea mays
  unsure at all n locations
  Clone ID: LIB3078-038-Q1-K1-G6
tcggcctgtgcaggtctagttgagcttggagagcttaaaaggctatcgagatcgatgaggaagcttgcaagagagctgagggacacagataaatatgagaacgagcagtaccaggacaaaatgaggcagtcagatgaacggctcctggccctggtcaaggcggccatggacgtggtcgtggccgtcgggcttcttcagctggcgcccaagaaggtcactccgagagtgacaggagcctttgggttcgtcacctcgcttatctcctgctatcagcaacttccttaccgcgctcctgttgccaaagtcaaagtttgagaggtgtcgccgtcctagtaaaaaaaaaagaggcgacgctggaaatcgatctctgcttcaacaatggatcgtaatataattgtattatgcgaatataaggcangctagctatgtattnttttattaaaaaatagtacaacagaatagaacacc

SEQ ID NO: 70602 - DNA, 193 bp, Zea mays
  Clone ID: LIB3078-038-Q1-K1-G7
gcggagctacggcgtcattcctactggagaaaatcctaaaaagcctggagccccacaaaatgggcatctgtattcaattgcatcgactaggtatggatgataactttgatgggcgaaccggtagcttgggtgtcccccgtgcagtttattatgatcctgaaactggccaggaagacccctaaaagaatggtgt

SEQ ID NO: 70603 - DNA, 341 bp, Zea mays
  Clone ID: LIB3078-038-Q1-K1-G8
cgccgcgcccgcagcgtcacggacgacgacctcgacgagctccgcggctgcatcgacctgggcttcggcttcgagccggcgcccgccgccgcgtgcgcctgcgcctgcgccgggaggaaccgcctcctggagacgctgcccgcgctcgacctctactacgccgtccacggcggggcggcagaggcgccgccgtgctcgtgcggcgccgcgtcggaggcgtcctcgtccgaggagtcgccgctcggcagccccatgtccatactctctccaggcgacacgccggagacggtgaagatgcggctgaagcagtgggcgcacgtggttgcgctgtccatgctgag

SEQ ID NO: 70604 - DNA, 200 bp, Zea mays
  Clone ID: LIB3078-038-Q1-K1-G9
cttgctcgcccgcatctctctaaccgccttcgccgtcgccggcgccggccatcgttcacgtgacggcgatgccaccagccttcacgggcaacctgaagaaagcacttgcaggtctgagaagaatcaatttagatcggcttcgatggctcgtattccatgctaagtgtcaggtgctgggacgattggcttcctaattatcc

SEQ ID NO: 70605 - DNA, 166 bp, Zea mays
  Clone ID: LIB3078-038-Q1-K1-H1
gcggagctacggcgtgcttcctcctggagaaaatcctataaagcctggagcctcacaaaatgtgcggctggattcaattgcatcgactaggtatggagataactttgatgggcgaaccgcaagcttgtgtgttcgacgggcaggttattatgattctgagactggc

SEQ ID NO: 70606 - DNA, 443 bp, Zea mays
  Clone ID: LIB3078-038-Q1-K1-H10
atcgacctcacgggtcccatcgtcaaagtcttcctaacattgaaggttgagagtgctccgacggcctctgaagcatcacgagttctcctcgccttcacgcccacagagtttcaacatctctctattgtcaaggccacaagagcggaggggaagcgcaagaagaaggcattcgtacccctctcggtccaagcctctgagctcgccaccaccgctcccgacgcccctcgcctctactctgttctgctcagcactcctctgaaaccgggcgatgcaaccactctagaagtgctatacatgctcactcactctttagagcccttccccgctgagattagccagtcagagtcccagttggtttactaccgtgacagtgcggtgcttctctcgccctaccatgtcctggagcaggttacctacatcaaaatgccaaagcataggatcga

SEQ ID NO: 70607 - DNA, 307 bp, Zea mays
  Clone ID: LIB3078-038-Q1-K1-H11
agctggagaaggtcttcgcggacgaggctttcgcctagttcttcgacaaccctaccttcgcgcgcgttgagaatgccgagctcatcgactagatccccaggtcgcccgagctacaccctcacatgcccaattcaataaacaacttcttatattccactcccacgaagatctctccgtttctcttgccaaatacacttccgagctgtctgaaaagttctcgggctaaaggggtgcctttaacgtcgtgctctttggccgatccctcatttatgcactcaataatcttactgatctctcctacctttat

SEQ ID NO: 70608 - DNA, 367 bp, Zea mays
  Clone ID: LIB3078-038-Q1-K1-H12
gcggttccccaatgttgatatgacctatgaggtccgtgagggtgatgatataagcgctggtgacaatgtaacagtgcaggtaactctggagcgtgacatgactaacgtttcatctgaggttggtccagtccatgcgccaaggtttcccaagcctaaggaagaaggctggtggctggtgattggggacagctccacaaaccagttactggcaatcaaaagagtggcactccagaagagggcgagagtgaaacttgagttctctgctccggcagaggctgggagaaaggactacatgatttacttgatgtcagactcttacttgggctgcgatcaggagtatgaattcaccgttgatgtcaaggatgct

SEQ ID NO: 70609 - DNA, 269 bp, Zea mays
  Clone ID: LIB3078-038-Q1-K1-H2
cacatacctcttccatgagggggtcttgtacgccaagaaggactacaacctggccaagcaccccaagcttgatgtgcccaacttggaggtgattaagctcatgcagagcttcaagtcgaaggagtatgtgagggaaaccttctcatggcagtactactactggtacctcaccaacgatggcattgagcaccttcgcaggtttcttaaccttgccttaaaaggtggggcttattaccttaagaagactttcaaggccccgtctcgcccct

SEQ ID NO: 70610 - DNA, 389 bp, Zea mays
  Clone ID: LIB3078-038-Q1-K1-H3
gcatcggcgaagaagaggccggagagaggatgatactggccgtgctcttcgacaactccgatggaaacatccttgtcgagcgattccatggggttcccgcggaggagaggctccactggcgctccttcctggtgaagctcgggtccgagaacctcaaagggtgcaagaacgaggagctccacgttgcctgccacaagtctgtgtctattgtttataccacggtcggggatgtctgcctctacattgctggcaaggatgaatatgatgagcttgctttggctgaggtgatctttgcaattacatcagcagtcaaggatgtttgtgcgaaacctcctaccgagcgcctcttgcttgacaaatacgggaggatctgcttgtgccttgatgag

SEQ ID NO: 70611 - DNA, 437 bp, Zea mays
  unsure at all n locations
  Clone ID: LIB3078-038-Q1-K1-H6
tcgcggacgcgtgggcggacgcgtgggcttcactcacaaagccaccagatatacgaagtactaggtgggttaaccgagcagttgatggatgaaggatatgaaatagatgtcgatttgacatatactgagtgagggatgtactagatttctacaacttgtcttgaaaatctagccatttagctgacatccctagtcccaacaccatgtctattgcaagcagccacgcgaatcttattcaatgattacaaggttgcacgagctaaagagttcagtttctgcccaggttagaagcgctaagaagtaggcgcaagatgttacattttgggctcgtcatctgatgtgtaagttgatgccttgtcacgaaaagatcatacccggagcattgtgtaacatgaatatacagagttcacagnctagtttcaatattttttggtgag

SEQ ID NO: 70612 - DNA, 187 bp, Zea mays
  Clone ID: LIB3078-038-Q1-K1-F9
acgccgtgactacctctgcaatccgagcctttttttttctcacatcatatcttgccaataagggcatacgtatgaaaataaaacgggctacgtttgtatacacttataccgtgttactatgttagtgaaatagtgaagtaacatcatttgggaaccttgctatgacttatgagcttattctccttct

SEQ ID NO: 70613 - DNA, 258 bp, Zea mays
  Clone ID: LIB3078-038-Q1-K1-H8
gcctggccatatacgacaccaactgctagagggcaccacgaagaaaagaactgctagagagtaacgagcgaacaaggttaccagaaattgggcgatatagatttactaggtctggatctgtaatcctccctgcatagctcttattcgtaactcgctgtcggcacgaaagttggtgtgcgttttagcagaatgctttctgtccgtgaaagtaaacttgaaactgcttattacgactgaaatgatattgtcgttcccccc

SEQ ID NO: 70614 - DNA, 427 bp, Zea mays
  Clone ID: LIB3078-038-Q1-K1-H9
gattcccgaccgacggacgcgtcacgccggtcatagctggaacagccgtgtggtttcggttaaaaaggcaaaggcatggtgcgcgtctaagttgaacatgccgtactgtgagacgtctgctaaggatggaacgaacgtggaagatgccttccagtgtattgtaaagaatgctctgaagaatgaaccggaggaagaattgtatgtgccagataccgtggatgtggtaggtggcaaccgggctcagagatcatctggctgctgttaagacatgaggcatccacgaggcgtggtgatcatcatcggctatgcactgaccaaacaatacctcaacattgctgggccttcatgcgtatctacgtgttcctattccatgtgttacctttccaatcttctgcttattacccaaaggcgcattttccatgctgtc

SEQ ID NO: 70615 - DNA, 296 bp, Zea mays
  unsure at all n locations
  Clone ID: LIB3078-038-Q1-K1-E3
caccaaggcgttggaaaaccctgtagtgacagtccaggaaatgtcaatgcagtcgacgagcaacctgaccatcagatgggcgttgagagggaagcctaagaacccgttgttcgcgagcgtcggaggagacgtcatcgtccgcgtcgagtcacggttcgtcctgaaccagataagcgggcaggtgctggagcaggccgagtcctgggacctctncgnctcgtcccttccttgccaggcctacttctggctgtcccgaaaggtctactccgccgtggagtccgggaaggacgcgatcg

SEQ ID NO: 70616 - DNA, 408 bp, Zea mays
  unsure at all n locations
  Clone ID: LIB3078-038-Q1-K1-E4
cccaccgtccgctttcccttcctgctgcgccgtggaaccctctaagcgatttggatttggatctcacctcgctccttcccgtggcgatacgactcgccgtgactttgatccgtggcggtggctctgcgggtgcaggaaggatgacgggctccatggatctcccggccaagggcgggttcagcttcgacctgtgccgccggaacaacatgctggagaagaacgggctcaaggtcccgggattcaggaagaccgggacaaccatcgtcggcctcgtctttcaggatggggctgttcttggggcagacacaagggcaactgagggccccatagttgctgataagaactgtgagaaaatccactttatggcaccgaatatatactgctgtggagcangaactgctgcggaca

SEQ ID NO: 70617 - DNA, 438 bp, Zea mays
  unsure at all n locations
  Clone ID: LIB3078-038-Q1-K1-E5
agctgaggacggtacagcggcacagaggtgcgacgtacgacgacgacgacgcaggcgccgcacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgctaggcgacggcggngctgaagctggaggcgcgcgactccggcctgcagacgggtgaccccgccggttcaccctcggcgacacgctggcctgcggcgccgtcggncacatnctcggcgtncgcatcgtgctcgggctcaagaaca

SEQ ID NO: 70618 - DNA, 351 bp, Zea mays
  Clone ID: LIB3078-038-Q1-K1-E6
cggacgcgtgggcggacgcgtggtgctagatttggcatctagtcttgatgtggggtctgcggcaccctaagcctcaggggatgcaccttcagatgactgtaatttgagatctgtgctgacaatcgcctttcaattcccttatgagatgcaccttcatgacagcgttgctactatggcccgtcaatatgtgcgtagtgctgattctgctgtgcaaaaggtgtcgatggctatatctccctgccaatcttgtctaaatgctgggcacaggatgctttccggctaccctgaagctgccacacttgctagatgggtttgccagagttatcactaccatctaagtgtgggaatact

SEQ ID NO: 70619 - DNA, 247 bp, Zea mays
  Clone ID: LIB3078-038-Q1-K1-E7
ggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgct

SEQ ID NO: 70620 - DNA, 388 bp, Zea mays
  Clone ID: LIB3078-038-Q1-K1-E8
tgaagatattcacacgaccaactgctggccctcttcgtcccattgttcaatgccagactctcaagtacaacatgaagtcaagggctgggagaggctttacccttgaagagttgaaggctgcggacattccaaataggcttgctccaaccattggcatatctgcggatcaccgccgcaagaacaaatcctttgaggtgctgcatgccaatgtccacatgcttaagacatacaacgccaagctggttatcttcccaaggcgtgctcgcaatgtcaaggctggtgactctactctggacgagcttaccactgctacccaggtacagggtgactacatgccaattactcgcggtgagaagcgctctgtagaggttgtcaaggtcacagatga

SEQ ID NO: 70621 - DNA, 378 bp, Zea mays
  Clone ID: LIB3078-038-Q1-K1-E9
cccacacgtctttccactcgtccgggcgattgccagtatcattcccagtttccacagtgatatgatcatacctgccgggattcagggaatattcatgctggtctctggctacttcagacttccatacgacatcccgaatcccttttggagataccccatgcagtacatcagcttccactactgggcactgcacggccagtgccagaactacatgaaaggcctcatgttcgacaaccagtacccggaccaacccaagatccccggtgacttcatcctcaagtacatcttccagatcaacgtggaccgttccaagtggatcgacctgtcggtcattttcagcatgatcttcatctaccgcatcctcttcttccttatgat

SEQ ID NO: 70622 - DNA, 421 bp, Zea mays
  unsure at all n locations
  Clone ID: LIB3078-038-Q1-K1-F1
cccacgcgtccggtttcgcgtccgcctcagcccgccgcaaggagaggtaagttcaggagacatctgcgagaagctgaaatggctcctaaagctgctcctgccaagaagggtgatgccaagacccaggccttgaaggttgccaaggctgtgaagtctggggcagccaagaagaagaccaagaagatccgcacgtctgtgaacatttcaccgcccacgaccctgaagaaggctagggaccccaagtacccacgaatcagcactaccggaaggaacaagcttgatcagtaccaaattctcaagtacccccttaccacagaatcagcgatgaagaagattgangataacaacactctggtcttcattggtgacctcaaggcagacatgatgaagatcaaagcttgcgtcaagaagatgtatgaca

SEQ ID NO: 70623 - DNA, 382 bp, Zea mays
  Clone ID: LIB3078-038-Q1-K1-F10
ctcagtggggctactattgtggatcagccggtatgcataacttattggggacagcctgaggagacttttaatttctgggacaggccaacttgggaggttgaagaggaaattgaatacacgagttatcaatcatgccagtacaacactactccgcaggaagctcttacagtggctcaagatatcgtgaagacgatgctagcaaaggggtacgtgctcagcaaggacgctttggctaaggctagagcctttgatgagtcccgcggattaacagctgcagctgcagccaaggctgcagagctgagcaagagaattggtttaactgacaaggtcagtgctggtgtccgtgcaatgcgatcggtcgatgagacatatcgcgtaacgg

SEQ ID NO: 70624 - DNA, 439 bp, Zea mays
  Clone ID: LIB3078-038-Q1-K1-F12
atccgattcgatctcgtctacaacacgctgttcaggtgcaccaggcggaagcgggccgagtaccctagcctccatgcctacacgcgcgacatctaccagatgcccaaggtcgccgagacgtgcgacatggaggccatcatggcaggatacttcaagacactcttccccctcaaccccggcgggatccagccacacccgccggccacctgcgatagggagtcgctcttgaggccgcatggtagggaggccttgtcctctgctgctggcacgccgcttgaagcagctgcggtttcataattcattcaggctttgaacaaaacttctgaaactgcagaaagagtttatagttctaccagatactgatgcttcagcttcacaggatcaaatcacatcgcaataactgccatgtgcaaattcttattttgtccatataagtcac

SEQ ID NO: 70625 - DNA, 391 bp, Zea mays
  Clone ID: LIB3078-038-Q1-K1-F2
cggacgcgtgggcttatggccactagcgctacagaagagaaaagaaggccgatgcccccgtgagcctggggaaataggaatcattttgcgcgcgatggggtatacgaaggaaactcagatatatgttgcatcagggcaggtgtatggtgggaacaacagaatggcacccttgaggaatatgttccccaatatggttagcaaagaagatctcgcaagcaaggaagagatggagcctttcaagaagcatgtaaccagccttgctgcgctggacttcctggtatgcctgaagtcggacgtgttcgtcatgacccacggcggcaatttcggcaagctgatcattggctaccgtcgctacatgtgccgacacaggctcaagtcaatcaagccggac

SEQ ID NO: 70626 - DNA, 435 bp, Zea mays
  unsure at all n locations
  Clone ID: LIB3078-038-Q1-K1-F3
tgaagaagctgtgcctggagccgacgtccttcaccgtcaaggcggagggcatcgccaagagcgccgggcccgagttccagaagaccaagctcatgacccgcctcacgtacacgctggacgagatcgagggcccgctcgaggtcggctccgacggcacgctcaagttcgaggagaaggacggcatcgactacgccgccgtcaccgtgcagctcccggggggcgagcgcgtgccgttcctcttcaccgtcaagcagctcgtcgccaccggcaagcccgagagcttcggcgggcccttcctcgtgcccagctaccgtggctcctncttcctcgaccccaagggccgcggcggctccaccggctacgacaacgccgtcgcgctccccgccgggggcagaggtgacgaggaggagctccagaaggagaacatcaagaacg

SEQ ID NO: 70627 - DNA, 386 bp, Zea mays
  Clone ID: LIB3078-038-Q1-K1-F4
ggcgttatcaatgccatgatatcaaacatctcattcacctacaggagcatttattccaaggaagccatgactgacatggatagcaccaacgtgtatgcttacatttcaataattgctctcattgtttgcattccgcctgcagtgatctttgaagggccccggctaatgcagcatggattcagtgatgccattgcaaaagtaggcttgacaaagtttgttagtgacctattcttggttggactgttctaccatctgtacaaccagattgctacgaacaccttggagcgagtggctcctctgacacatgctgtgggcaatgtgttgaagcgtgtgtttgtcattggcttctcaatcggttgtttttggcacagaattagcacacaaac

SEQ ID NO: 70628 - DNA, 444 bp, Zea mays
  unsure at all n locations
  Clone ID: LIB3078-038-Q1-K1-F6
gcttaaatcgtggctgctaggcgaatggtcctactttggtcatcaaatgcaggttagctgaactttttctaatgcattattatttgtggtttccatcaaatgtacgttagcttatcttttagcaaatttgtagctgatgtcaattaactttttagtggaattttatctgctcattcttatattcaggaattccactactatatgtgccacttgaagttgttatgtcaaaataatatggtgaaaacgagcgtctattgggatctattttttatcttgcaaatgatcttcctgaaggagattgatatgtcaagatacgcttgtttcatttgagctcaatgttatctgaaaatatatagactgccttcgtccccttcatcactgctaatgaccgtgacttggagacccgacagcggccctcgacgttgtcgncgncgagcccatgct

SEQ ID NO: 70629 - DNA, 436 bp, Zea mays
  unsure at all n locations
  Clone ID: LIB3078-038-Q1-K1-F8
ctcgcaggtggtgtcgacggcgcgcggcgcaggcctggccgcgttcacgtatgggcgcgtgaacaagacgctcttcgacggcgacaactgggggcggttcgtgtccttcgtcagggctatggccgacggtggcgcgaggccagcgctgccgcggtgtgacacggggcactcggacctgtacgtcgggtttgtcgacgccgccaaggagaggaaggcggcggaggccaagggcgccgccaccaccgcagcattgtaggtggtcatcggtagatgcccatgcatgtgcttgcataatgcatacagacacatgcgccgagctgttgtataacgtacacaggagaactgtataaattcatggccttcaggttgcanaggtttataggctgtaatcgagcaagtagataaggaggcaggcatgtcaaaacttaggctatct

SEQ ID NO: 70630 - DNA, 430 bp, Zea mays
  Clone ID: LIB3078-038-Q1-K1-E12
cagagctatctgttaagcctgtttatgtcaaggatgatttttttgattccctcgctaggggaacatttggacgtggaggaccaaatggaaggggtagaccttctgaacggcgcagagtagatacagaggtttaggaactaccctttccctcccttgatttttctgctagtgctttacccatttttattggcgtgcagacttttggcgaatttccacggcacaggcaaccctaccgtggtggcgcccgaggttaccgtggcggtggacgttcccgaggttcatattatggtggcagaggctatggaaacacagggaccggaggctatggaaacacagggacaggtggccctggaaattcttattctcaccggggctatgggagagattgattatagcagaaatgtgcaagcaaccatacttgtgggtggtg

SEQ ID NO: 70631 - DNA, 414 bp, Zea mays
  Clone ID: LIB3078-051-Q1-K1-D3
cccacgcgtccggctccccaacactggaatctcctattcgagtttcagcatctctctgtgggtcccgtggtggttcaggttcctctgaggagactgtacagttcatgatggtttattcacttctgtcggagtcatacgagagttggctccaacaccgccctgtgtttctacagaggggcatctaccatgcctacatgcaacataggcacgggcggtcgaccctcaagctgtcatcggactcgtcatcatcagcagttcgggcagacgaaagttcatcctctgatacaagtgacaacaagaagctcttcgccatagtccagccgatgctggtgtacaccggcttgattgagcagctacaacagttcttcaagaagggcaaatcgtccagcttgatcaagacggatgagaaagatg

SEQ ID NO: 70632 - DNA, 445 bp, Zea mays
  Clone ID: LIB3078-051-Q1-K1-D4
cccacgcgtccgttagagtatgctcgaggtggacatgcatcaacatgcggggatgtttgacagttttggaatagtacttgtagagatgcttacagggagaaggccaattgatcatgtgtttgtggacgaactaaacattgtcaaattcgtggagaggagcttccctgataaaatattggatgtgattgatgtttcattacgtgatgacttcaagagtgcccaaataaacatggtaacagagagtgagacctaccgatgcttgttttctctactgcaagtagcactttcttgcacacgtgagattcctggtgaacgaacgaccatggaagaagcagctagcagaattggttcaatcaagaccacgtatgctaaaggaattgaaaacgcaagcaggcattgaattgaaaccacctctatgttgagcgaacgtacgtggggatggaca

SEQ ID NO: 70633 - DNA, 447 bp, Zea mays
  Clone ID: LIB3078-051-Q1-K1-D5
gccgacatggacttcgaatcagagtcagtcccatcttacctccaaccagaccaagaacggtgaactcagcttacctgctgcaccaactggccatgcagcagtcccagcaaaccagcagcaggtagtgaaactgttgtgagagaatgacgttagatgttgcgtactttttagtgttgcttttgtttatacccaacatcatggtagttatttggtttcctttagctctgtcatgtgcgctaacaaccagttggcctattgcaacatggggccacgcttttaaattttattatctctaaaataaattagcacgtttcgaatttatcccaatgaacgtcagagaagaaaaatgtgatgaaggagaaggtaaaaaaaaaacttaggatgttctctctttatgggtgtggcagtttataaggtagaataaggtagaagacagaacacctgaat

SEQ ID NO: 70634 - DNA, 449 bp, Zea mays
  Clone ID: LIB3078-051-Q1-K1-D6
gccaggtcgtgctcatgggtgccgtcgagggctaccgcattgccggcgggccgcgtcggggaggtcgtcgacccgctgtaccctggcggcagcttcgaccccctcggcctggccgacgaccccgaggccttcgccgagctcaaggtgaaggagctcaagaacggccgcctcgccatgttttccatgttcggcttcttcgtccaggccatcgtcaccggcaagggcccgctcgagaacctcgctgaccacatcgctgacccagtcaacaacaacgcatgggcctacgccaccaacttcgtccccggcaactaagctcaacggctatgctatgcaacttcattgtctttcggatcggagagggtgtacgtacgtggattgattgatgctgcgagatgcatgtgtgtcttttgtttcacgttgcattgcataggcaagtcgagatgatgagt

SEQ ID NO: 70635 - DNA, 437 bp, Zea mays
  Clone ID: LIB3078-051-Q1-K1-D7
cccacgcgtccgacttgctctccctccaacaagctaattaaggccggtcgtcatgcgggttctagctcgttctattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactctacgagaagcacgaggcgaagaaggacccggagcacgcgcaccgacacatgatcgaggaggaggtcgcggcggcggcggacgtcggctccggcggcttcgccttacacgagcaccacgag

SEQ ID NO: 70636 - DNA, 391 bp, Zea mays
  Clone ID: LIB3078-051-Q1-K1-D9
cccacgcgtccggaagttttggaagtaaccgcattgagatcagtgttcgggttggtgcgcaagttgtctactcgaaatatgcaggcacagaattgaaattcaatgacgccgaccatctcattttgaaagaagatgacataattggtattcttgacagtgatgatgtgaaggatatgaaaccactgaatgatcgcattctgattaaggttgctgaagctgaagaacgaactgctggtggtttgctattgacgcaggcaactaaggagaaaccttctgttggatcagtggtagccgttggcccaaggccgttgggcgaggacggcagcaggaatcccctgtcgatcactcctggaagcaacgtgatgtattccaagtatgcggggagtgagtt

SEQ ID NO: 70637 - DNA, 445 bp, Zea mays
  unsure at all n locations
  Clone ID: LIB3078-051-Q1-K1-E1
cgctgggctgcgtgtttccggagatcctggctaagaacggcgtcaagttcggcgaggcggtgtggttcaaggccggcgcgcagatcttctcggagggcgggctggactacctggggaaccccaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgncgncgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcata

SEQ ID NO: 70638 - DNA, 376 bp, Zea mays
  Clone ID: LIB3078-051-Q1-K1-E10
gttgctactggcatcgccgtgacctcgatcgccttctcctacgtcgacggcgccggccgaacccaatctgctggtcgctggggcggttccggtggagaaactgagccggtgatccagctcggcgactccgaggtgctcacggagctgtccgggacgatcggcaacgtctacggccacaccgtcataacctccatcaagttcgtcacaagcctcaagacctacgggcctttcggagcatggggggacgggagtgacactccgttcgcggtccccgtgcagcaagggagtgccatcgtcggcttctttgcacgagctgggatctacctcgacgcagttggcgtttacgtgcgatccctgtgatgatgactgacgacag

SEQ ID NO: 70639 - DNA, 393 bp, Zea mays
  Clone ID: LIB3078-051-Q1-K1-E11
cccacgcgtccggccgcaaggggcaacggcacaccccaactgacctgacccacgagggatccgcagatgaagatcattccggtcccttgcctggatgacaactatgcctacttaatcgtggacgagagcaccaagaaagcagcggccgttgaccctgtggaaccggagaaggttctcaaggcggccggcgaggtcggcgcctacgtcgactgcgttctcaccacccatcaccactgggatcatgctggtggcaatgagaagatgaggctgcaggtgccagggataaaggtatttggaggatccctggacaatgtgaaaggctgcactgatcaggtggagaatggaatgaagttgtcacttgggaaggacattgagatactatgcctacacacg

SEQ ID NO: 70640 - DNA, 249 bp, Zea mays
  Clone ID: LIB3078-051-Q1-K1-E12
cacccactcgtcctcccactcctccgatcgctttttccaacatcacaccctaactcatcttacgcatcattggaacttttataaagatcatcccgatccctaacctctataacaactattcctacttaatcattaactacatcaccaatacaacatcacccgacaactactactaacccgataaagatctcaaccatatctcctaactcctcacctacttactactccttacccaccacccatcaccac

SEQ ID NO: 70641 - DNA, 62 bp, Zea mays
  Clone ID: LIB3078-051-Q1-K1-E2
cccacgcgtccgtccacgcgtacgctgtgctaaaaaccactggttctgtgtggattcaggag

SEQ ID NO: 70642 - DNA, 428 bp, Zea mays
  Clone ID: LIB3078-051-Q1-K1-E3
cggacgcctggggcgagaaccagaggctagaccgcatccagtggtggggctcggtatgggcgggagccaatgccccctgggcgacgccgctataggcgaggaaaccctaaattaccacggcgatgacgttgagatggccgacgccgactcggataccgaggaagcccgagcagctgaagtctccgctgcaactggaggatccgccggaggtgttaggcacgccgagaaggaccgaccggatggaaagaagaagaggaagaagaggaggaacacagggaagaagaacacagggaggcaagatggggcgcccaccaacatctcggacattaatcgatttgttcttaacacttgcaagcgcttgaaggagaagaagtcgtaccttgtctggaatgctgttggctgccttggtgtcactgctgtcaatgatc

SEQ ID NO: 70643 - DNA, 445 bp, Zea mays
  unsure at all n locations
  Clone ID: LIB3078-051-Q1-K1-E4
tgttgccctgcacccaaagatcaatggaagcttgttgcctgcatcagttattggtatggactgtacatatctgtgctacagtggactctccagtgagccaagggattacgaatgcaatgggcttcacaatcactcaaaagctgtgtcaactggtagccttacattgggacttcttaccacggtcctttctggggtctattctgctgtccgcgctggctcctctgcaactgtgctctcgccaccagactcaccacgtgggaccgacaagccattgcttcccttcagcaaggcagacgaacaagaagataagaaggatgtgccgaggccggtgacatactcctactctntctttcacctcatcttctccctggccagcatgtactcggcaatgctcttgactggctggtcaacttncgttggtgagagcggaaagcttgtggatgtt

SEQ ID NO: 70644 - DNA, 425 bp, Zea mays
  Clone ID: LIB3078-051-Q1-K1-E5
ggaaaccctagccgccatatctcacgatccactcgagcaccaagccgagggaaggtgaggagcgatggcacgcggcgtggtgtccgcgaagggcggcgcggtcgcgggcacgaagaaggggtcggtttccttcacgatcgactgcaccaagccagtggaggacacgatcatggacgtcgcctcgctcgagaagttcctgcaggagcgcatcaaggtcgccgtcggcaacgctggcaacctcggcgactccgtcaccatctctcgcgagaagaccaaggtcaccgtcacctctgacggacccttctacaagaggtacctgaagtacttgaccaagaagtacttgaagaagcacaacgtgcgggattggctacgcgttgttgctgccaacaaggaccgaaacgtctatgagctccgctacttcaaca

SEQ ID NO: 70645 - DNA, 399 bp, Zea mays
  Clone ID: LIB3078-051-Q1-K1-E6
cccacgcgtccgcatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatc

SEQ ID NO: 70646 - DNA, 426 bp, Zea mays
  Clone ID: LIB3078-051-Q1-K1-E7
gacccacgcgtccggggtcacaaagatcatacaacgctataacaaggttattgtctgtgtggaagacggggcgagttttgtcgcagacgctgctatagtaaccgtccctctcggggtactcaaggcaaacatcatcaagtttgagcctgagctaccgaaagagaagctctcggcgatcgccgaccttggcgtcggtatcgagaacaagatagctctcaagttcgacactgtgttttggcccgacgttgaagtgataggtagggtggccccgacgtcaaacgcctgtggctactttctcaaccttaacaaagccacaggaaacccggtcctggtgtgcatggtggccggaaggttcgcgtacgagatcgagaagctgtcggacgaagagtccgtgaacttcgtcatgtcccagctcaggaacatgct

SEQ ID NO: 70647 - DNA, 452 bp, Zea mays
  Clone ID: LIB3078-051-Q1-K1-D2
cccacgcgtccgcccacgcgtccgggcatttcggccagaggcaaggagctcagcaagtggtgcttgaaggggtaaaccgccgtgtttgggagaacacatggggtgacttctgcttggacctgcacctcatgtcatgtggtgcagctcaagcaatggtgcatgcatggctcctgaacgtgcgctctattgtttttgaaggtcgagctatgcctgagtttttaagcattctgacaggctggggaaagcatagcaagatagctggatcaagcacccttcgtcgagtcattgaagcgctgctcctttcaattggagcgccgtttcaggccgagcgcttcaacatcgggaggtttgtgtcacccagtgccttggtgtctgcctggctgagagagtccggcaccattaacatcctccttcttcgcaacgagcgagcgcaacatgcaaacacgttcaat

SEQ ID NO: 70648 - DNA, 287 bp, Zea mays
  Clone ID: LIB3078-051-Q1-K1-B8
gccggcgtgaccattccaaatctttcgcacccatctctcgccgcctcgcctgcacgcggggactggccctagtgcccgcgcgcctgcgaggtatcgaacacccaaagatggcaatggcaaccttcacatcatccccagttctctgcagcttcaggaccatcgaacagaagaaggcccctctgctgaacaacagcacataacggccgcttcacttgggcttcccaaagagcgtgccgacgtcgccgagcttgagagagaggctagacctgcgcgtcgccgctgtctac

SEQ ID NO: 70649 - DNA, 415 bp, Zea mays
  Clone ID: LIB3078-051-Q1-K1-B9
gtccagatcgcgtgattccgcatcccgttcgcgagcgcgacacacgctgacagctcagggctgaccttcccgacggcctccagctccatcttgattcttgaggcgaagccccggtgcgtaagagtctgccatggccagcgagaataaggtctttgggttcgaggaagtcgccaagcacaacgtcaccaaggactgctggatcatcatcgccggcaaggtgtatgacgtcactccgtttatggatgagcatcctggtggagacgaggttttgctagctgtaaccgggaaagatgctacagctgatttcgaagatattggccacagtgattccgcaagggacatgatggagaagtaccacatcgggcagatagatgcttcaacaatcccagcaaagcgtgctcatgtgcaggcccag

SEQ ID NO: 70650 - DNA, 419 bp, Zea mays
  Clone ID: LIB3078-051-Q1-K1-C1
ttttgtcacgactttgttaatgagccagctcaagtcgagctcgagccagctcgttagctcgaacgagcaaaccatttgtctgcaaaacaaagcctgcacttgtgttggatgaactaataaatgataaactgtgttaatttggtgttgaattgacgtggtatgtgaaattatgagtattattactcttttctagtgtaagattggtctagaattaactagtaattgattatattgttatatatgtatattatttttttgttgtggctcgcgagctaaacgagccagctcgagctcgcaaacgagccgagctgattctctagctcggtttcttaacgaaccgagccatcttgttacattaatgagccagctcgccgagccggctcaatatctagccctatcaggcacacatggttaggatc

SEQ ID NO: 70651 - DNA, 389 bp, Zea mays
  unsure at all n locations
  Clone ID: LIB3078-051-Q1-K1-C10
gactagttctagatcgcgggcggccgccctttttttttttttttttaaggggcagtgcgggctcactgaattaacatgtgttcatcggataaacaacttcggcaatgaagagtcttagcaattacagttctcaaaattttaaattgcaatttttcagaaacctcggcagccaactttttgttttcatgtaacaaaattaggtccctaacaaaacgaaggagctagcatcacatgatcactcttcctcttcgtcgtcaccgcctccaccagaagccttcttttggttctttctcttcacccttccaggttctccaccaccaagtgggctggtaagagagaagtcgatgtgcttctctgagtcaactctcaccatgaatganggaatgttg

SEQ ID NO: 70652 - DNA, 389 bp, Zea mays
  Clone ID: LIB3078-051-Q1-K1-C11
caggaagatgccggcggggcacgggctgcggtcgcggacccgcgacctgttcgctcgggccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacggaggagttccgcttgaggaaagccaagaatgaccagctcaaggcggatgccaaggcccgcggtgaggtgatcagca

SEQ ID NO: 70653 - DNA, 389 bp, Zea mays
  unsure at all n locations
  Clone ID: LIB3078-051-Q1-K1-C12
gcagaagttgcggttgtacttttcttcctccgccgtcggctcagatctgtgcgtgcgggctagcgatggcgtcgttctcggaggctcccccagggaacccgaaggcgggcgagaagatcttcaagaccaagtgcgcgcagtgccacacagtcgagaagggcgccggccacaagcaaggtccaaacttgaatggtctttttgggaggcagtcgggtaccaccacaggctactcctattccgcgggaaacaaaaacaaggctgtgatctgggaggagaacactctgtatgactacctgcttaaccctaagaagtacattcctggaaccaagatggtcttccctggggctgagaagcccgaagaacgtgctgatctcatngcgtaccctgag

SEQ ID NO: 70654 - DNA, 337 bp, Zea mays
  unsure at all n locations
  Clone ID: LIB3078-051-Q1-K1-C2
cgcgttccagtcgctgccctcgggcacgctcaactcgctgtcggaccaggacaagaacgcgctggtgcagtaccacgtggtgtccgccgccatccccatgtcgcagttcgacaccgtcagcaacccgctccgcacgcaggccggcagcgcctcgccgggggagttcccactcaacgtcacctcctccgagggccagcaggtcaacgtcaccacgggcgtcgtcaccgncaccgtcgacaactccctctactcgggcgacagcctcgtcgtctaccaggtcaacaaggtgctgcttcccatgaagctcttcggcgccgcggatgcgcccgcgcccgcg

SEQ ID NO: 70655 - DNA, 408 bp, Zea mays
  Clone ID: LIB3078-051-Q1-K1-C3
tttccttttcactgcagtggtcactgccgtatttggtttgcttagcgccttctcgcccgactgcgcatccttactcacccttcgctttgttgttggtctgggattgggtgctggccatgtgctatctacttggttcatagagtttgtccctgctgccaaaagaggtacctggatggttgttttccatgcttgttggactgtgggaacaatattggaggctcttcttgcgtgggctatcatgccagtacttggatggaggtggttgcttgcattgtcctcagcgccatgctttgttcttctcattttcttccctctaacacctgaatcaccaaggtatctttgctcgagaggtaagactatggatgctacagttatcttggaaagaatagcaaggatgaacaaagggac

SEQ ID NO: 70656 - DNA, 445 bp, Zea mays
  Clone ID: LIB3078-051-Q1-K1-C4
gccgagaagcgctttagccgtagccgtagccgtagcgataagagtgagctagctggtgcgacaccggcatggcggccacggcgtactccgtggcgctcctcggcggcgcgcgcctccccgccgctccgcgctccgccctcctccctcggcgcagcgtctgccagcttcgcttccaagatgcaccgaggctctccctgctccgtgcgaaggccgcttccgaggacacatcggcctccggcgacgagttgatcgaggacctcaaagcgaagtgggacgccgttgaggacaagcccaccgtcctcttgtacggcggcggcgccgtcgtcgccctctggctgacgtccgtggtcgtgggcgccatcaacgccgtgccgctgctccccaagatcctggagctcgttgggctcggctacaccggctggttcgtgtaccgctaccttctctt

SEQ ID NO: 70657 - DNA, 335 bp, Zea mays
  Clone ID: LIB3078-051-Q1-K1-C6
gcccccggccctgcagcccggaagagcatatggagcagagggcagtgctgtggtgcatggttccatcagaacagtaggaagaagcgacctcgcagatcacgagatgggcctacgtcagtggcagctgtcatccagcggtgggctgagcgcaacaagcatttggagtatgaggaatctgaggaggcaaagcgaccaagaaaagcacctgcaaagggttcaaagaaaggctgtatgaagggaaaaggggggcctgacaatactcaatgtggataccgtggagtgaggcagcgtacttgggggaagtgggttgctgaaataagagagccaaatcgtgt

SEQ ID NO: 70658 - DNA, 447 bp, Zea mays
  Clone ID: LIB3078-051-Q1-K1-C7
ggcgccggcgtgctcgtgatctcaacccaaggcgtgcctccgctccggtcacccgtcggtccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtctgccctcagggcgcttgctcgttccgggatgaaaatcgg

SEQ ID NO: 70659 - DNA, 446 bp, Zea mays
  Clone ID: LIB3078-051-Q1-K1-C8
cggacgcgtgggtggtgatccgttcaggaaaggtgttgaacagggcccgcagatggaggacgagcaattcaaaaagatcttgcgctacattaggtatggtgttgacggtggagctacccttgtgacgggtggtgataggttgggtgacaagggtttctacatccagccaacgattttctcagatgtccaggacggcatgaagattgctcaggaggagatatttgggcctgtgcagtcgatcctcaagttcaaagacctcaatgaggttatcaagagggcaaacgcgagccagtatggattggccgccggcgtgttcaccaacagcctggacacggtcaacaccctgacgcgcgcgctcagggccgggactgtctgggtgaactgcttcgacgtcttcgatgctgcgattccgtttggcgggtacaagatgagcggcatggggaggg

SEQ ID NO: 70660 - DNA, 230 bp, Zea mays
  Clone ID: LIB3078-051-Q1-K1-C9
tcccactcttactctgactttctctcatcttcgcacgatgacctttatcgtgattatcgagaatattctactaacactacgacttaaaaactctaatacacagcacaaccgcaacacaacatcattatatatcctcactaccaccttatcacaaacatctataatatacacatcccagattttatccatcatccatacattaacaccttctactagttaccttacattca

SEQ ID NO: 70661 - DNA, 442 bp, Zea mays
  unsure at all n locations
  Clone ID: LIB3078-051-Q1-K1-D1
ggcggtgtgttgctaccaaaatctgctgttaagtttgagagatatctgatgggtgagagtctatcgatcggtgctgaagtcagtgaagttgaggctgggaagaaggttctcttctcagacatcaatgcttatgaggtggagcttggtaccgatgatgagaagcactgcttctgccgtgagtcagacttgttagctgtagttgaatgaattttaccatgaaaatttcggacttacctgggaatgctccaacggcatgaacttatcttgcccccactttggtgtatgccatttgaacgttcgtgaattcagcttctaggtgattgttagttaccgttgatttttggtcgctataaactggaattgtgttaatgcccattttctttacagaggctcttgctcacgtnggaaacacgaaactgtgaaccgaatttgaatgcttaca

SEQ ID NO: 70662 - DNA, 433 bp, Zea mays
  Clone ID: LIB3078-051-Q1-K1-D10
tgatagcttgctccaggacgtacgtacgtacgtagatcgatccatcgagcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgatgtgccgagcggcgtcgacgcctccaagatctcgcaggaggagtacctcaacgcgcc

SEQ ID NO: 70663 - DNA, 357 bp, Zea mays
  unsure at all n locations
  Clone ID: LIB3078-051-Q1-K1-D11
tgaagactaccaacctcagatatcagattttgggcttgcaaagtggctggctgacaaggtgacccatcatgttgtgtatcccattgaaggcacattcggcgagcatctatgcgttcgggttactaggacatgggacttctatgatcctggagatgataaaaaacttctgcattctgatcttgtactgctcgatgaggaggttcataaagcatggttaccaccttggctagcggcacaatatgctcattacgtggattgagggagaggaagcaaaaatgactttatgggagaatatgcagaaagctgaagcagaagcagccatacaaaagctngtgataaaacttgaaaagaaaaggc

SEQ ID NO: 70664 - DNA, 432 bp, Zea mays
  Clone ID: LIB3078-051-Q1-K1-B7
gtgaaaccatgcaacaggatgagagggcagcctcaccgcctgctggaacatcattctgttcaaccccaccacccacacaattttcatcgcccccaccacacacgcaattctcgtcaccaatgcaatcaacaatccatcggcaatctagtatggcgaacatctccaccccttaccagagttccggggtatcatcattaagcagcgacacctcattctcaaaatcacgagccgcatcctggagtggaacatactctgagcagttcagtgcttttgcgggcacaagatcacctgatggacagacggtgcgctcaccactcatgcctggcaaaccatcacacagtcgttccaacagcaactcatcagtgcagctcaatggattgacagaggatcttcatgaggtcgagctctaattggcggctgctcagcatgact

SEQ ID NO: 70665 - DNA, 432 bp, Zea mays
  unsure at all n locations
  Clone ID: LIB3078-051-Q1-K1-A12
gccgcggcggcggcagcgggcggttggtcgccgtgcggtccagcgggccggccacgccgtcggagatctccgacaaggtgtctgagagcatcaagcaggcggaggagacgtgcgcggacgaccagaagggcgacgccgagtgcgcggcggcgtgggacgaggtggaggagctcagcgccacggccagccacgcccgcgacagcctcaaggagaccaacgccaacgacccgctcgagaagtactgcaaggagaacccggactccgaggagtgccgcatctacgacaactagctatagtcgtagctatatagggcgtggaatgatactctcgatcggcgcgtcatacgtggaatgaacttgtatgaagctatacctcaatgcttctctacctgccgncgncgncgcagcagcaccccgtatgatatgatacaca

SEQ ID NO: 70666 - DNA, 396 bp, Zea mays
  Clone ID: LIB3078-051-Q1-K1-A2
gcgccactgtccagtgcgcgcgtcaagcttgcttagctagccgccatggcctccctcggcggcgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcg

SEQ ID NO: 70667 - DNA, 385 bp, Zea mays
  Clone ID: LIB3078-051-Q1-K1-A3
cccacgcgtccggggcgtgccaggtggtgctcatgggcgccgtcgaggggtaccgcggggccggcggcccgctcggggaggtggtcgacccgctgtaccctggcggcagcttcgacccgctcgggctcgccgacgacccggaggcgttcgccgagctcaaggtgaaggagatcaagaacggccgcctcgccatgttctccatgttcggcttcttcgcgcaggctatcgtcaccggcaagggccccctcgagaacctcgccgaccacatcgccgaccccgtcaacaacaacgcctgggcttacgccaccaacttcgtccgctgcaagtgagcgagggcatgatgcttgcatgcgtgtaccgtagacgtaccgtattcctacgtact

SEQ ID NO: 70668 - DNA, 285 bp, Zea mays
  Clone ID: LIB3078-051-Q1-K1-A4
ggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcgacggcggggctgaagctggaggcgcgcgactccggcctgcagacgggtgaccccgccgggttcaccctcgccgacacgctggcctgc

SEQ ID NO: 70669 - DNA, 457 bp, Zea mays
  Clone ID: LIB3078-051-Q1-K1-A5
agccacgcgtccgcaggggttcgcttcatgccagttcgtgtccacctcgctcatcaaagcaaaagcggccgttggctcctcagttctaggtccactgaagatcatccaggatgctggcgagatggatttggtgtcatggggagtcgccatctctgcgttcgtgaagcatggcttgggtcaagaggcactgtctctcttcaactcgtgcagagttgactgcccagagaagcctgatgagttcatcctgggcaccatcctgaatgcatgtgcaaacgccgcgttgataaggcagtgcagatgcatccattcgctcgttgtcaggacaggacacagcaagcacttgtgcgtgtccagtgctttggttgatgcctatgcgaaatgcggtgacatcactgctgccaaaggcgctttcgctacgggttcgaccaaggacgccatagtgtacaacaccatgctg

SEQ ID NO: 70670 - DNA, 430 bp, Zea mays
  Clone ID: LIB3078-051-Q1-K1-A7
cgcagccgcgcccttctgcttggctatggccaccgtcgtgccgaggatttgtggatcgctctgtgttcggcctcgacagaaactctggacgctcggacctcgccgtggacgctgatcgcctctgtttttctctggtgcgcgcccctgtgcttgggtccttgctagcagccgagcagctccttcgcgccgcagtgctacctcgtgtgcgcgccctgccgaagccccttacgactgtcggcaactccccatcctctagttgtgctcgctgctggccctgtggtgagctccctgcttcatcctcgccatggacgccatctagcacgcgcgcgccggatgtatttcctccttcgcgcagtgccttggtgactgtcgagtagcacaccaggcctgcgcagcctcgtcgcgtctgtatagccccagttgcaatgca

SEQ ID NO: 70671 - DNA, 447 bp, Zea mays
  Clone ID: LIB3078-051-Q1-K1-A8
cctggactcacattaggctttggagttggagctggatgtggtgtgggaattggctttggttatgggttgggcaaaggaattgcatatgatgaaaagaaaaaatactccaatgttggcaagatgttccaggaagctccacattttcctatggacactgtcggtgctttatttgacgagctggttataaacaccaagaagcttgtgacatcaacatcaaaaggaatcgaaaaatggcgttgagcggcagcactgcattgttgtctctataatcgccttgaattgtatcaacggagattgcgagcagcagttatcttgaacaggcaggacctggccctagaatgcagcctgttgcatgtcgtgactttctttctattgttcgtcagctagtagctttgtatttaggtaggatcctgagataatacatattatttctggtcgatatttatt

SEQ ID NO: 70672 - DNA, 384 bp, Zea mays
  unsure at all n locations
  Clone ID: LIB3078-051-Q1-K1-A9
cttccgatgttcgacacgtttgagtgctgtcttagaggggatggactacttgtggcaactggtgcttatggtaatagatttcgtgttttcggtcgtcctccgggaagcatagaggcaacaactttggaagcaagtaggaacccaatgaggcgtcagattgcaaatccagcaaggcccacacggacactaacttcttttgcccgtggtgttcggagaggtggagaaaatcaaggcgttgatgctaatgggaattcactcgacttctcaacgaagctgctccacctcgcatggcacccgaccgagaattctattgcatgtgctgctgcanatagcttgtatatgtattatgcgtanagaatgccctacagaaaaatntgttttttg

SEQ ID NO: 70673 - DNA, 389 bp, Zea mays
  Clone ID: LIB3078-051-Q1-K1-B1
ggcggacctgccggaggagctcatcttccacatcaactacctcggcgccgaccagccgaccttgaccctcaacttctccaaaggttccagccaggttattgcacagtactaccagctgatccgccttggctttgaaggttacaagaacatcatggagaactgccaggagaacgcgacggttctgaagcaaggtctggagaagacggggaagttcaacatcgtgtccaaggacaacggcgtgccgctggtggccttctccctcaaggacagcagccggcacaacgagttcgagatctccgacttcctgcgccgcttcgggtggatcgtgccggcctacacgatgccccccgacgcgcagcccgtgaccgtgctccgcgtggtcatccgcg

SEQ ID NO: 70674 - DNA, 340 bp, Zea mays
  Clone ID: LIB3078-051-Q1-K1-B10
cgctggcggagcagatggagaaggccgcactgtttgacttcaacctgacgctcccggcgatcgcgaccgagttcctgctgctcatggtggcgctggacaagctctacttcacgccgctaggcaagttcatggatgagcgggacgccaagatccgcggtgagctcggcgatgtcaagggcgcctccgaggaggtgaagcagctggaggaccaggcggcggccatcatgaaggcggcgcgcgccgagatcgcggcggcgcttaacaagatgaagaaggagaccaccgcggagctggaggccaagctggacgagggacgcagccgtgtggaggccgagctcgt

SEQ ID NO: 70675 - DNA, 337 bp, Zea mays
  Clone ID: LIB3078-051-Q1-K1-B11
cggcaagcagtactacgccgtgtccgtgctcaccaggacggcggacggcgacgagggcggcaagcaccagctcatcgcggccaccgtctccgacggcaagctctacatctgcaaggcgcaggccggcgacaagaggtggttcaagggcgccaggaagggagtcgagaaggccgcctcctccttcagcgtcgcatgatgatgtaattttatttcttcgatgggatgggatgcacgcactacgtagagagcttggctaggccaggcctggctgagcacgcttgtgtgttccttcgactgtacatgagaacaaagactaaggagagctccattcccgtac

SEQ ID NO: 70676 - DNA, 355 bp, Zea mays
  Clone ID: LIB3078-051-Q1-K1-B12
cggacgcgtggggcggcgtccgggagcccgtggtacggccccgaccgcgggctgtaccggggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagcttctcgcccgcaacggcgtcaagttcggcgaggccgtgtggttcaaggccggctcccagatcttcagcgagggcgggctggactacctcgggaacccgagcctcatccacgcgcagagca

SEQ ID NO: 70677 - DNA, 245 bp, Zea mays
  Clone ID: LIB3078-051-Q1-K1-B2
gcgacgcatacggcgacgcatgcgagcacgcgtgactattagtacagatattgtcacagctgagattcagtacctacaactgatgactaacagcagatagcagcactcacagacatatgagatctcgattatagctactggatcctgggccattgaggtcaccgattgaagctcacacggacctgattctatcagaatgctatatctaacggagattgatgatgctgacaagctgactggagtta

SEQ ID NO: 70678 - DNA, 363 bp, Zea mays
  unsure at all n locations
  Clone ID: LIB3078-051-Q1-K1-B4
cggcccgtccgcgggcggcgacagcggtgcgggcgcgtcctcgtccacggcgccgtcgaaggcccccaacgccgccgtgcccgcggccggcgtgtccgcgcccgcgctacttgcgctcgcgctggtggggtttttggcggcggtatggtgacgcgtgaatggtggagccatcatcccggcgaaggtggcggcggcgggctggggacgaaatatcgcgcctgtttctttgtattggggttcgtttttaagctttgtttttggccgtgaaatagaaatagttgctgtacttgttgagcctgtgtttggtagagtcatagtgacganttattattactagcagtaccgagtctgtgatcatggccg

SEQ ID NO: 70679 - DNA, 391 bp, Zea mays
  Clone ID: LIB3078-051-Q1-K1-B6
cggacgcgtgggcggacgcgtgggcgcaacgctctatctctttcgccgagctccgtgggaccctatgagcgtgcttgaccggcggcggcgaggtgatggcgatggaccctgacgcggtagcgaaggccttcgtggagcattactaccgaacgttcgacaccaaccgcgcggcgctggttgggctgtaccaggagacctccatgctcaccttcgagggccagaagttccagggcccctccgccattgccggcaagctcggatctctccctttccaggcctgcgagcatcagatcgtcaccgtagactgccagccatcgggtccccagggaggcatgctcgtcttcgtctccggttccatacgcaccggccccgaggagcaccccatcaagtt

SEQ ID NO: 70680 - DNA, 344 bp, Zea mays
  Clone ID: LIB3078-051-Q1-K1-A11
gacccacgcgtccggccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagcttctcgcccgcaacggcgtcaagttcggcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcgagggcta

SEQ ID NO: 70681 - DNA, 438 bp, Zea mays
  Clone ID: LIB3078-045-Q1-K1-B10
cggacgcgtgggatcttccccagcaacaagctcaccggcaccgacgtcgggtaccctgggggcctgtggtttgacccgctcggctggggcgccggctcgccggagaagatcaaggagctgcgcaccaaggagatcaagaacggacgcctcgccatgctcgccgtcatgggcgcttggttccaggccgagtacaccggcaccggacccatcgacaacctcttcgcccacctcgccgaccctggccacgccaccatcttccaggccttcacccccaaatgaggagctctgatgaacttagcagttcgaggagtgctaccacacatgcatgcattgttaggtttgatggccgatatggaacttcattttttttgttgcgggcggactactgggtagactgtcaatgatgatgatgatgaaatgttcgtggtgcgatgcatg

SEQ ID NO: 70682 - DNA, 329 bp, Zea mays
  Clone ID: LIB3078-045-Q1-K1-B11
ggtcgaccacgcgtccgtgatgtcgacgacaagaagcagaaggccttatgcatgtagaattacagaaagaaataggaggatgggcggtacaccttatctgatattgatgttgagagggaagaggagtgtgggatttgcatggagatgaacagcaaagttgtgttgcccaactgcacccatgctatgtgtatcagatgttaccaggactggagttcaagatcgcagtcctgcccattctgccgtgacaacctgaagaagacctgtcctggtgacctgtggatctatgctgaggaccaagatgtggttgacatggagacggtgtctagcga

SEQ ID NO: 70683 - DNA, 430 bp, Zea mays
  Clone ID: LIB3078-045-Q1-K1-B12
caacttcctccccatcgaagagctccaggacagaaacgtcattgttcttgctaacctcagaccaaggaacatgcgtggcatcaagtcaaatggcatgctcatggctgcctctgatgcttcccatgagaatgtggagctgctcatcccttcagaaggttcctttcctggtgaaagagtatggttcggttccgaagaagaaaagaaccgtcaatctgaccctgcatcaccaaatcaggtccaaaagaagaagatctgggaagctgttcagcctcatcttagaacaacagataactgcattgcggttcttggtgataaacaaatgcgtacctctgcaggcctagttttctgcaaatcgcttcagggtgcaagagtgtcataaatctttatggccaacatctttcttggatcatggaatcgtgtgtcatgtatc

SEQ ID NO: 70684 - DNA, 417 bp, Zea mays
  Clone ID: LIB3078-045-Q1-K1-B2
cttcttgccacagctcttttggtgttcgcttcgttggtgagctttaagcgcttggattgagtaagatacacatctgcgctatcagttgccctggcagtagtttttgtcagtaattactgctgggattgccatcatcaaactcttcaatggaactgtagcgatgcccaaactttttccagaattagatggtcttaattctatctggaatctttttacagctgtccctgttcttgttacggcctatatctgccactataacgttcacagcattgacaatgaacttgaagacagaacacagatcaagccgattgtgcgaacatcgctgttcctgtgctccaatgtttacattgccacaagtttctttgcttatcttctcttcggggaaagcacactggacgacgtgcttgcaactttgac

SEQ ID NO: 70685 - DNA, 434 bp, Zea mays
  Clone ID: LIB3078-045-Q1-K1-B4
gtcggtctccccaagcgagcgcctatcaatggcacgctcctcaagcttctctttccagtcgccctgtgccatggtattggtcacatcactagcaatgtgtccttcgctgctgttgcagtctcatttgctcacactatcaaagctctggagcccttcttcagcgcagcggctactcagtttatccttggacagcaagttcccttctctctgtggctttctcttgcccctgtggtcattggtgtttcaatggcatcccttactgagctttcattcaactggactggcttcatcaatgccatgatatcaaacatctcattcacttacaggagcatttattccaagaaagctatgactgacatggatagcaccaaacgtgtatgcttacatctcaataatcgctctaattgtttgcattccacctgcattgatctttg

SEQ ID NO: 70686 - DNA, 443 bp, Zea mays
  Clone ID: LIB3078-045-Q1-K1-B5
gctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaataatatcgattcatacagaggaaaaagttctctattgatgcaaacgctgtacctagaggatagggatagaggaagagggaaaaatcgaaatgaaataaataaagaatatagccaaaaaaataagtccaagatagaagagcccagattcaaaatgaaaaaatggaaactctaaaaggatccttctgattctcaaagaattgaggggcaaggtgattgatacc

SEQ ID NO: 70687 - DNA, 396 bp, Zea mays
  Clone ID: LIB3078-045-Q1-K1-B6
cccacgcgtccggacaaatcgtgcgtctggcacgcttctgactttgcggatggcgaactgaaggaggagatgtttgccatcaggtttggttcggtagaaaactgcaagaagttcaaggagttggttgaggagattgctgagtcacttacagagaacgaggacaaggaaggtcaagatggctcttccacggccggattgctggagaagctcactgtgagcgagggcaaatctgaggaaagtggcaagtcggagtccactgattctggcaaagtgaccgaaaccaaagccgatgcagcctcagccgagtagttggtgtggttgcacgcagatcctccccgtgctgaatcagttcctctgccctttagccattaaatattgttgctaatttttttgggg

SEQ ID NO: 70688 - DNA, 334 bp, Zea mays
  Clone ID: LIB3078-045-Q1-K1-B7
gttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcattacataattttgatgctatatatatat

SEQ ID NO: 70689 - DNA, 468 bp, Zea mays
  Clone ID: LIB3078-045-Q1-K1-B8
gcccgcacgacacgacaccaagtcgaggagctcgagagggcaccaataatggccggcgtgaactccagcgtcgtggggctcaagcccgccgcggcagtgccgcaggccgccgccgtctcatcgccggcgaagcgggtgcagctggccgcgcccgagggccgtcgcgccgatctgctcggcctggcggccgtcttcgtcgtcacggccaccaccgggtcggccaaggccacgatcttcgatgagtacctcgagaagagcaaggccaacaaggagctgaacgacaagaagaggctggccaccagtggagccaactttgcgcgcgcctacaccgtggagttcggcagctgccagttcccctacaacttcactgggtgccaggacctctccaagcgaagaaagtccccttcatcagcgactacctcgagaatgagtgcaaggggaaagagaagttcaagtgcggttccaacg

SEQ ID NO: 70690 - DNA, 395 bp, Zea mays
  Clone ID: LIB3078-045-Q1-K1-B9
cccacgcgtccgcaaggaaggagatcccttgaaaccagctgtgacaggcgtcttagtgtgcgtttccgctccagatccaattggcaacaagtactatcttggccctgctcctttgcaggatatggcaaggcaaattgctacagccaatggccctactggctataatagggattacctgttctcaatggagaaggcattagccagcattagccacgaagatgattcgatcatagagcttgcaaacgaggtgaggaaggtgctcaacagaacataggagaccaagatcactggtgccaatgcttccctgaaatcacatgcccctcttgtgcacctgtccgcgctttcagaaggcacccgtgtggactcgagataacgagagccttggacgttggacc

SEQ ID NO: 70691 - DNA, 396 bp, Zea mays
  Clone ID: LIB3078-045-Q1-K1-C1
cccacgcgtccgcccacgcgtccggatcctgcctggacctggagcgctggacagcagcagcagcagcgtcgagctcgaggccgctccgccaccccgcactcgcctgtcgcctcttctcgctttcgccaccggggcagcgatccgccatggctggacctgctgttctcaatgagcgtatcctttcttccatgtcccagaaacatgttgctgctcacccatggcatgatttggagataggaccaggggctcctgaattcttcaattgtgtggttgagattcctagaagcagcaaggttaagtacgagttggacaaggcatctgggctgatcaaggtggaccgtgttctttaatcctctggttgttacccacataactatgggcttattccacgcacac

SEQ ID NO: 70692 - DNA, 396 bp, Zea mays
  Clone ID: LIB3078-045-Q1-K1-C10
cacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggcggtgctgaagctggaggcgcgcgactccggcctgcagacgggtgaccccgtcgggttcaccctcgccgacacgct

SEQ ID NO: 70693 - DNA, 179 bp, Zea mays
  Clone ID: LIB3078-045-Q1-K1-C11
tcagcctcatcgaactctacctgcctttctctcttccctggctgcatctgcaggatctcggattatacttccaggactggttaaccatatgaacccagcacagaccatgcacgtctacatcatctatctgacacactcatgtacgacgtacctctcacatttgattgtcatactaacga

SEQ ID NO: 70694 - DNA, 379 bp, Zea mays
  Clone ID: LIB3078-045-Q1-K1-C12
cggagatcctggccaagaacggcgtcaagttcggcgaggcggtgtggttcaaggccggggcgcagagcttctcggagggcgggctggactacctggggaaccccaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgtcgccgagctcaaggtgaaggagctcaagaacggccgccttgccatgttctccatgttcggcttcttcgtgcaggccatcgtcaccggcaagggccccatcgagaa

SEQ ID NO: 70695 - DNA, 367 bp, Zea mays
  Clone ID: LIB3078-045-Q1-K1-C3
caggagagctcttacatggatccaaatcatagtctttgccttggagcactatttaacatggcagcagcaaatggcctagacatgggcagaagattatgcatctttggcttttgccgttctattgaaatgttaagcgatgtagtggaagatacggtattggagcatggcggtgaggttgtcactgcagagaaggcaagcagtaacggcctccaggagaagctaaccatgtctgttgcagtaccattgctgtggggcgttcctccagcatcagagaccctccatgtcgcggtgcggatcggtggaggtattgtcgataagatctattggcagtgggacttattctagatgtccagcattaacaaaattg

SEQ ID NO: 70696 - DNA, 393 bp, Zea mays
  Clone ID: LIB3078-045-Q1-K1-B1
cacgcgaccacgcccccgctcctctcgtctctttcttcgcctcttccatcgcaggattcggcggccatgggcggcggcaacggccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccaccttaagaattagtaagcagcataagcatatgatctgctcagctaaaagacaagtactacatatatatatatacgctgtgtggtcaattaaagggttgtaggctgc

SEQ ID NO: 70697 - DNA, 407 bp, Zea mays
  Clone ID: LIB3078-040-Q1-K1-H12
acgcccacgcgtccgcgctctgccaaggttcgcatggctgtattcaatcagcatcatgttgatggggttgatttgacggtgaatcccgttttgtacatgatgaagtgctatccgggtgtgccggagcagacgttgagggctcatctgggttcgtttggtgtttcggtaagccttgacctccaatctatgtacactttatcaggtggtcagaagagtagggttgcattcgcgaaaataaccttgaagatgccgcacatcattctccttgacgagccttctaaccatctcgatctggacgctgctgaggcgctcatacagggtctactcatttttcatgaaggtgtgctgatggtgagtcacgatgagcatcttatgactggaagcgtggacgagcttagcgttggtgt

SEQ ID NO: 70698 - DNA, 235 bp, Zea mays
  Clone ID: LIB3078-040-Q1-K1-H2
ccggatcacccggttacacctgctgattcacgttcaggagctatcacagctagcggcgactccttttcagatgatatcatctcttacaccatcctacaagtactactgtagctccagcatgatcctgctgcagctcatgcaactgcatgagccctaacctggagaccgtcgtcgtcagcaacatcaaaaccactgtcctcgccgcgccgaccaccaaggccagctccctctgttt

SEQ ID NO: 70699 - DNA, 193 bp, Zea mays
  Clone ID: LIB3078-040-Q1-K1-H3
ctacactacaccacaccacacactcattaccgctatcacacacaccctataccagcgagttatttccatcgtagaccgagactcaacaagctataagctatgccaacacaggaataatagatggcggcgtccaccgagacgaccgtctgtgacctgaagactaccactatcatataggctgctgctgctgcca

SEQ ID NO: 70700 - DNA, 399 bp, Zea mays
  Clone ID: LIB3078-040-Q1-K1-H4
cggtaatgcaagtgagtgccaggaaaccatgtatcatgtgagatcatgtgagtttaacatgggcattttgtatacctttttattcagcctaggtataaatatttattcttttgggttttaattttttttcattagtgggtactgcatataaaggtccttgcgccaaactggtttaatgtcggataaaaaaaattatagattgtaaagtaatatgcactttgcacgaaagataaattttgttttgaatctatagaaaaattgtgatatcatggaccatggttagtttacatagatagtagacttatgtttgcgattggagaagtaagaattagttagacttatgtttgtgattggaggagaactaaaaatcagttcatattccttgctacttgaaacggt

SEQ ID NO: 70701 - DNA, 307 bp, Zea mays
  Clone ID: LIB3078-040-Q1-K1-H5
gcggcaccaacatggtcgactacgccatggacatccacagtccctctacgaccgacgacgtgcccgaggacatggtgaagcgccgtgccaggtcgctccaggctcaggtcgctcgaggaggccgaccccgctcgtcgccttctccgaacccgcgctcgtcaggagtcaggcccgacaacagtcaacatccacatgctcagagcgatccagatcggcctgacagatggagctctgatcagtatgccaattcagtttgagtgtggtaactactcatgggctgctgattacctttaccagtattgtgctt

SEQ ID NO: 70702 - DNA, 315 bp, Zea mays
  unsure at all n locations
  Clone ID: LIB3078-040-Q1-K1-H6
cgggatgaccgggtacgagctgctgaagcacgtgaaggagtcgtcggcgctgcgggcgattcccgtggtgatcatgtcgtcggagaacgtccccacccgcatcagccggtgcctggaggagggcgccgaggacttcctnctcaagcccgtccgccccgccgacgtctcccgcctctgcagccggatccggtgaccgcccgcgcaaggatggagggtctggttgcgcgctctgacttaattagaggagttgttaggatccattttttgtgttcgttcgttcggtcctttccttctttcttcttggacataaaattt

SEQ ID NO: 70703 - DNA, 313 bp, Zea mays
  Clone ID: LIB3078-040-Q1-K1-H7
cccactcgtccgcccacgcctacgcccacgcgttcgctgaacactacagctacccagagagggtatcgtggtggctgtgaaagtcctgtggcgcgatccgcgtgagaagctctgtcaagttatccatgataccccgctgagctgctcggttataggaagcaggggccttggcaagctcaagagggtgctcttgtgaagtgtcagcgactatgctgtgaacaatgcaacctgccctgtcaccgtcgtcaagtcaacatgcacctgacgttgatcttatcgcctagatgcctggatgtgatgctggaataaagat

SEQ ID NO: 70704 - DNA, 205 bp, Zea mays
  Clone ID: LIB3078-040-Q1-K1-H8
cggactcgtgggctgacacctgctgattgactttatagtaaagctcgcgctcgcacggagagagtctcggagacgcttagtgagatggcacacaccatggcgtccatgaccagcctgctgcaggtcgccctgcccattctgctcgccgtcctcaagaacaggaacgtcttacacttgtttaatctcgtctaagaacatttctttc

SEQ ID NO: 70705 - DNA, 336 bp, Zea mays
  Clone ID: LIB3078-040-Q1-K1-H9
cggtctgaattcccggtccgtcgactctttagggcgcgtacgtgctgctgtccaacatctacgcttagaagggtgactggggcgcggtggcgattgttcggctgaagatgcgggggaggcgcgtcaagaaggaggtcgggttcagctgggtggacgcgggcggcgccaacgattccctgcacctgcacaagttctcgtcggacgactctacgcacccgcagagggaagagatataccgagtggcctaggggctaggctgggagatgaagtttttcaagaactgtcttcatgtctagatggaatttctcgattgatgtctcgatcaaattattcttg

SEQ ID NO: 70706 - DNA, 369 bp, Zea mays
  Clone ID: LIB3078-045-Q1-K1-A10
gccgctgagcccgaggctgctgctgcggatgaggagcccgcggcggccgagccggccggtgaggaggccgagaaggccgagccggccgctgaggtggccgagaaggccagcgagtgaggccgtgcgccgtgcgcgcactgcggcggcggacagcgggtcgggagatcgatggctcagcgcgcgcgcgcctacatggcacgggcttgctgttcagtacaacgcgaacgtgacggtttctctccatctctgtgtgtgtgacagtgtgtcgtagctatagcagtggctgtcgcgtggactgcccggtgcggactgcgagtgacatgggctaaataaagtgtgcgtcgtctggtctggtggtggtagtggggc

SEQ ID NO: 70707 - DNA, 439 bp, Zea mays
  Clone ID: LIB3078-045-Q1-K1-A11
cccactcgtccgcccactcgtccggtgcacagactctggcacggctcaagcggagcaggggagactactgcatgcgattgacgtgttcttccaggagtcgggcaggagacaacatcaacatgctacagctcgacaagagacagtgccaggggattatggaccaagacagggcagcagggcccgtcgccccaaagagaatatatccggtccaggatggatccggatccggcactagtgagcctacgcctacgcctgcgctcgtgaccgatgcctgccgtgcccaggttgctgctggcttgtgttcggagcttccacgcttgatttgtggggaattccggcgatcagctccgacgctcccatcttacgagtcacgaactacatccgcttccaaagaaacatgatatcttgaatcctaagtcatgaatcctgagtcagaaac

SEQ ID NO: 70708 - DNA, 382 bp, Zea mays
  Clone ID: LIB3078-045-Q1-K1-A2
cccacgcgtccgcccacgcgtccgcaagcacaagcagcacctcggcgaggccggcgccatggccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccggccggcgcgcgaccgagctagctagctccggcgcacacaaccacacacctggttaattctgtactgcatgcgtgtgtaatttgatggttcacaataatga

SEQ ID NO: 70709 - DNA, 352 bp, Zea mays
  Clone ID: LIB3078-045-Q1-K1-A4
agagaattccttcagtccatgggtacacatcatgattaaagcttgaacaatttatatttgatgtatggaactattctccttcaacagctctttttgaggttttgcgtgaggaggaatttgcgccagtgaagaatgctaatggtgcaacttatgacactcctgacagtgccagattaatgctgcttcggctacatagccgctgggtggttgctgcaggtggcttcttgactcattctgtgcccttgtatatgacaggagttgaagtttctccgctttgctcttatgctggagagaatctataagctatatgcaagtggaagaacatttcatgcaccaagtgagatttcattct

SEQ ID NO: 70710 - DNA, 325 bp, Zea mays
  Clone ID: LIB3078-045-Q1-K1-A5
cggacgcgtgggcggacgcgtgggctctggcggtggcgcctcagggcctgccgcccctgggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcgggggaaccactgggcttttgatctggggcggtacccttgc

SEQ ID NO: 70711 - DNA, 347 bp, Zea mays
  Clone ID: LIB3078-045-Q1-K1-A6
ggtgggttggcttctcctccccctccggttcgggttcgggttcgtgaggttctccggggttcgggttcgtgggtgagcggatcgagatggcggcgtcggatgttgagtaccgctgcttcgtcagcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgc

SEQ ID NO: 70712 - DNA, 363 bp, Zea mays
  Clone ID: LIB3078-045-Q1-K1-A7
gcgaacgcgatctgttccccaacctccgcagccgctccaccgtcctccactccggctgccgaatcgacccgccccgatccagatcaggagctgagggatggacgcgaacaggcgccagagtgggatccagcagttgctggctgcggagcaggaggctcagcaaattgtgaatgccgctagagctgccaagtcagcgaggctcaggcaagcaaaagaggaggctgagcgggaaatagccgaataccgtgcccagatggaggctgagtttcagaggaaggttgcagagagcagcggcgactccggtgcatacgtcaagcgtctcgaggaagaaaacggcggctaagatcgagcaacctacccagc

SEQ ID NO: 70713 - DNA, 400 bp, Zea mays
  unsure at all n locations
  Clone ID: LIB3078-045-Q1-K1-A8
ccgcgcgccaaaccatgccgacgcagcaagcatgttctgctgcggcagcattgagatcgcggcggccttcccctgcatccacgacgacgacctcccggcagctgcggctgcgtccgcctcgtgccgccaccgcgggcgtgcggctgacggtgtcggacgcggagctggagtcccgcgggttcgctgtgcggcgcacggcggagggcatcgacgtggcggcgctgaacgaggtgttcgtgcgcgtgggcttcccgcggcgtcaggaggagcggctgcggcgcgcgctggagcacagccgtgtggtgtggctgtcggccggngaggaagaagggcggcccgtggcgttcgcgcgcgcggccggtgacggcgtgttcaacgccgtggtgtgggacgtggtggt

SEQ ID NO: 70714 - DNA, 160 bp, Zea mays
  Clone ID: LIB3078-045-Q1-K1-A9
tcccactcgtcctggggatgatggatgtgttgaacggatgcaagaatctgaggaagcttgagattattgacagtccatttggtgattttgcactcttgggaaatgttgccaaatatgacacaatgcgatccctttggatgtcatcatgcaatgtcacatt

SEQ ID NO: 70715 - DNA, 463 bp, Zea mays
  Clone ID: LIB3078-040-Q1-K1-H11
tgcccgctcttacagatcgttctatcgttcttccgttcgttcgtccaaataatcttcttcctgtcgttatgctcccagaattcttatcaatcgttcgttccatcgttcatcgttcgatcatagttcctatccatccttcatcgttcattcataccaactattcaccatcactatttacccttactatttaccgctactatttaccgctactttttacctatactttctaccgttactttttaccgttactatttaccgttactatttaccgttactttttacctttactttttaccgttactatttaccgttactttttaccgttactttttactgttactatttaccgttactctttaccgttactttttaccgtattttttaccgttactatttacctttactttttacctttcctttttatcttttctattttacctatactttttaactctacttttta

SEQ ID NO: 70716 - DNA, 413 bp, Zea mays
  Clone ID: LIB3078-040-Q1-K1-F4
ctctatggaggaaggttgttcatgatgttgcagcgttttcctgtagaatcaaagggaagacgaaagaaattgcaggaggttgggtatgtgactaccatatgcttttcttgtttcttgatcagatgcgtcatgatgtgccttaatgcgtttgataaagcagcagatcttgatgttctgaaccatccaatcctgaacttcttctattacctgctggttgagatagtgccttcagctctggtgctcttcattctacggaaactgcctccaaagcgtgggatcacacaataccacccgatccattagagagcaggccttgggaacaggcaaaggttttctggtggatagtgttacacaacgtggtaaatacagaaaggagagtgaaaagtaccactcgagctttgcccagcttttta

SEQ ID NO: 70717 - DNA, 308 bp, Zea mays
  Clone ID: LIB3078-040-Q1-K1-F5
cccacgcgtccgattagaatgcttcgccaaaatggccccttcttagttattcatttacgatgtgagatggatatgcttgccttctctggctgtactcaaggctgcactcctaaagaaaccgaggagcttacaaggatgaggtatgcttacccatggtggaaagagaaagtaataaactcttttgtgaaaagaaaagatggtctttgccctttgacgccagaggaggttgctattgttcttagagcattggatatcgacaaaagtatgcaaatctacattgcagcttgggagatatatggtggaaaacg

SEQ ID NO: 70718 - DNA, 379 bp, Zea mays
  Clone ID: LIB3078-040-Q1-K1-F6
cagggttcaacttccaactgggagcccactcaagagtatagtcatggtgtttgttgcctcgtataagaagagaggagtggcggttcctgctgatagcacactgttgtttgaagggaatgaatcaagcagcattgtgccgaacaaaattgaacacactgacgaattcaggtgcttagataaggctgctgtcgttgtagaggaccaagagatgaaggacagccatcgcccatggctattatgtacggtaacccaggtggaggaagtgaagattctgatccggatgcttccgatatggttcacctgtgtcttctattcggctgcaatgagccagactgctaccactttcgtccagcaggggaacgcgatgaacactaagatc

SEQ ID NO: 70719 - DNA, 375 bp, Zea mays
  Clone ID: LIB3078-040-Q1-K1-F7
gcatcttcatcgatgtagcatcggtcgtcaacctcgccgtggcagctctcaaactaggagtgttggtgcaaaaccgtcgtcaccccgtcattgcaggtcgctgcgctatcgtttgcttatgtttcatcatctacgccatggcacttgttattgtccctagtttaattctatgtgtggttaatggtcgaagtgtagattgcaaatgccaattttaatgaagggtatgtgtaggcatatatgtgatgagctgtcgaattaatgatatgtaagataggtctagtgtttctatcggctagttgtcatattcgactagaattatgtgagccaattatatggatacaatgatgacttgctttagaaattgtcgtgtcgatg

SEQ ID NO: 70720 - DNA, 392 bp, Zea mays
  Clone ID: LIB3078-040-Q1-K1-F9
tgcccgctcttacgcaaaacctgaccgatggcggcccggtgctccacagctgcctccgtgtccgtggtcagaacagcgtcgcgttaccaatccccctccgtttccttcacagccgcggcgctcccctcggcgcgtctgaggccggtaggagcgtgggtccgcggtggagggtacacctgcaggctccgtgccgtccgcgccatgggctccgcgccgtcgtcgtcccaatccccgtcgctgcacacgccttcaggacaaacccaagggaaagcagattataaatcactgagtgaagaggagtggaagaagcgcctgactgaagagcagtattatgttactcggcagaagggcactgaaagagcattcactggggaatactggaatactaaaac

SEQ ID NO: 70721 - DNA, 296 bp, Zea mays
  Clone ID: LIB3078-040-Q1-K1-G1
caagatcaggatctacgatgtctggatgaagaggaagggtgttgatgagttcgggtactgcgtgcaccttgtctcttgggagaaggagaatgtctccagtgaggcgctcgaggctgcccgcattgcctgcaacaagtacatgaccaagtctgcaggaaaggatgccttccaccttagggtccgggtacacccgttccatgtcctccgtatcaacaagatgctttcctgtgccgtcactgataggctccagactggaatgaggggtgcctctggcaagcctcaagacacctgttcta

SEQ ID NO: 70722 - DNA, 280 bp, Zea mays
  Clone ID: LIB3078-040-Q1-K1-G12
tcttacacccactcgtgcgctcacactacgtacatccctttagcctgcgacacccttcctatctacctccgaccacttcaaacacgcaagtaacaatccacattaacgtctacaccactaatgctcctcaacaacccctgctacttgaccgacaatcatcactccagcaagatctagacttctgccgctaccccatacgagctacagctccaccttgcagctgcctacacctcaatccactctacctactacttccaaccttacttctccatttccaccc

SEQ ID NO: 70723 - DNA, 337 bp, Zea mays
  Clone ID: LIB3078-040-Q1-K1-G2
cgcgtgcgaaccaagcagaccacaacatgaagaagcgtagtcgtcgccggaaggaaaggcgcggagcaagatgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatctcaggaaagaagggcact

SEQ ID NO: 70724 - DNA, 370 bp, Zea mays
  Clone ID: LIB3078-040-Q1-K1-G3
acttctacgtcgtccttgagcgtgctgggtaccgtgtcgcccgtcgccgcaggtgcaagtcccgtgttgggatccagcacagggtcactaaggaagacgccatgaagtggttccaggtcaagtacgagggtgtgatcctcaacaaggcccaagccaacacctcctaagcctaagcgtcaccataagatattagaccctcttggtctcttctagtgcttcgagttaatggagtatatctggcggtgggatttgtattagaagaaaatcagatgcattatcatttttgcctgtactggtcctactggagttagttggatccatgtttttgtgtgtgtcgaatacattgatgttactactgttctacctcgac

SEQ ID NO: 70725 - DNA, 414 bp, Zea mays
  Clone ID: LIB3078-040-Q1-K1-G4
cccacgcgtccggggcagtgtaaagatacctcttggtcttgtcggttctcctatgcagatggtgctccaaaatataaaacctttgactaggttaccacttatcgggccgctattgactcctcccgtcagtgctgcctccgtggggaaggtcgctgtgagagcagcgacggatccggtgtttcctcctggcatcgttgatgtctacgggatcatgcgttacagcgagcaaaactaagctgcctcattcaccgggcagtatatacatgccgctgtacttttgttacagctgtttctttgtttgttttacatgtactggtatccttctttaactcacttgtttacgagacgataaacattcaataaatatgtattttagcgacatgtctgtggtactgttttttttttaaaatattt

SEQ ID NO: 70726 - DNA, 345 bp, Zea mays
  Clone ID: LIB3078-040-Q1-K1-G5
gagatcggcgcgtcgtccaggcgtcctcggtgttcatcccgcatggccccggagcgggcgcgacatcgccacgcagatccggacggcctcctgcaggatcctctgtcgccaaacactaagctgcctgcctgctgtgccgctgctgctgctgaagaacaccatcccactattatatatataatataatgatgatcttggtaccagagtgatgcttgtctatattgttcatcactcatcgtcaccatctgctaggatggctatctttatgcttggggattggagaaaaccttatctaaccttttagggaaccggtaatatatatataatgcagcatgagtttgcagt

SEQ ID NO: 70727 - DNA, 354 bp, Zea mays
  Clone ID: LIB3078-040-Q1-K1-G6
gagatcggctcgtcgtccaaggcgttctcggttttcatcccgcatggcccctgagcggggcgctacatcgccacgcatatccgcgacggcctactgcagggatcctctgtcgccaaacactaagctgcctgcctgctgttgccgctgctgctgctgaagaacaccaccaccactattatatatataatataatgatgatcttggtaccagagtgattcttgtctatattgttcatcactcatcgtcaccatctgctaggatggctatctttatgcttggggattgttgaaaaccttatctatacctttatggtacctgttttatatatataatgcaccttgtgtttgctgttta

SEQ ID NO: 70728 - DNA, 344 bp, Zea mays
  unsure at all n locations
  Clone ID: LIB3078-040-Q1-K1-G7
cggacgcgtgggtggcgatgctcaagtccgcggtgctgtggcgcaagcgcttcggcatcacctcgctcctcgacgccgacctcggcctgacggagctggagaacgtggtgttctaccgcggcacggaccgcgaaggccaccccgtgtgctacaacgtctacggcgagttccaggacaaggatctctacgagaaggccttcngcgacgatgaagagagggaagcgcttctcaagtggcgcattcagctgctggagcgcggcattctgtcgaagctggacttctcgcccagcggcatctgctccatggttcaggttaccgacctcaagaactcgccgcccatgctc

SEQ ID NO: 70729 - DNA, 398 bp, Zea mays
  Clone ID: LIB3078-040-Q1-K1-G8
cccacgcgtccgcccacgcgtccgcccacgcgtccgcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataag

SEQ ID NO: 70730 - DNA, 459 bp, Zea mays
  unsure at all n locations
  Clone ID: LIB3078-040-Q1-K1-G9
tcggccggctcgtacgctccgagcctcagttcgcatccacgcgcgccgtcgccgcctcgcagctcgacgctcaccgctcgtccatttctgaacagactgagaaggctttcctcaagcagccaaaggttttcctcagctcaaagaaatccggcaaaggtaagaagcctggcaagggcggcaaccgattctggaagagcattggccttggcttcaagactcccagggaagcaattgaagggacctacattgacaagaaatgcccattcactggaactgtttctatcagaggcagaattattgctgggacatgccacagtgctaagatgaacagaactatcattgttcgcaggaactaccttcactntgtaaagaaataccagaggtatgagaagaggcactccaacattcctgctcacatcttcccatgcttccgtgtgaaggaaggtgaccatgtcatca

SEQ ID NO: 70731 - DNA, 367 bp, Zea mays
  Clone ID: LIB3078-040-Q1-K1-H10
gccgcgcttacgcccacgcgtccgggaaagaaagaacaggggcaggcgaagcgactgtcgcgaggcaaggccatggtccgccatgacgctctccctctccacctctttcctctccatccccgccgccgcgaggaccaccgcccgcaccctacgctccgtcgtcccctcccaggggatgcgctgctcgatgcgcaagaaggggttgcacccggagatctacgaggacgcgaaggtgtactgcaacggcgagctggtgctggtgacggggggcacaaagccggagtacacggtggacgtgtggtccggaaaccacccctactatgtctgcgacaccttggcgctcgtggtcatggacagccagatcgag

SEQ ID NO: 70732 - DNA, 328 bp, Zea mays
  Clone ID: LIB3078-040-Q1-K1-F3
gtgaagagagacgtgaaagcattgaatgagatcaaatcttcactaggctggagagcggtatactcatgggtcggcgatgatccttgtgggcatggtgatctatcccactggtctggtgtgacatgttctcagcaaggggattacagagttgtgacggaactggaagtctatgctgaatcaatagttggccctttcccaacagcagtaactaacctgttggatctaagaagattggatctccacaattacaagttgacaggaccaattcctccacagattgtactgttgaaacatatcatgatattgaacctgaagtggaataagcttt

SEQ ID NO: 70733 - DNA, 431 bp, Zea mays
  Clone ID: LIB3078-033-Q1-K1-F10
gcgagaaccagcccaccccacctgctcgatcggcgcaccgtcccgcaggccgcggggcggtcgtcagccatgatgcagctcctgttctcgctgctggccgcggaggcggcgctggtgctggcgctgctcttccccacgcccgtgcgccgcctggctctgctcgccatcgatcgcgccaagagggggcgcggacccgtcatggccaagaccatcgcgggcaccatgctcctcgtactagtctctgctttctacagcgtcgctaagatccgccgccgcgagggggagctcggacagctcacgcccaccgaccaggtgctcgccagtcgccaccttctcgaggcgtcgctcatgggatactctctgattcttggattaattattgaccgattacatcactatattagagagttgagaatgttgaggaaagacat

SEQ ID NO: 70734 - DNA, 318 bp, Zea mays
  Clone ID: LIB3078-033-Q1-K1-F12
cggacgcgtgggcggacgcgtgggcggactcgtgggcggacgcgtgaatcgaggcactggtacagttctagatcgagctggcgtgcattagacgtttcaaacttacctacttaacaattttacacaatagctagtctataaagacatgtctgattcatatatttgacgaatctttcaatacttatatttaatgaatggacttcttaaatgacttctattgtgtaacatcttatttgtttaattttagttactttttttacatctacttattttattatctcttttgtcttcattttttgcacatacaatgccttttat

SEQ ID NO: 70735 - DNA, 467 bp, Zea mays
  Clone ID: LIB3078-033-Q1-K1-F2
aagggggtcaccaagggctaccgctacatgatgaggtttgtctacgcccatttccccagcaacgcgtccatcaccaactccaacaccgccatcgagataaggaacttcctcggcgagaagaaggtcagaaaggtggacatgcttgacggcgtgaccatcctccgctccgagaaggtcaaggacgagcttattctcgatggcaacgacgtcgagttagtctctcgctccgccgccctcatcaaccagaaatgccatgtcaagaagaaggatatcaggaagtttttggatggtatctatgtgagcgacaagggtgtgatcgaagaggagcagtgagggacaattagttgttatcgcttgagttggaattattgtttggtttgcaattttctcaaggtgaactttgtaatcggttaggatgtgttgtggaccattatcgtatcctacaatattatccgatctgtttaagg

SEQ ID NO: 70736 - DNA, 436 bp, Zea mays
  Clone ID: LIB3078-033-Q1-K1-F3
gagcacttcaagagggtggagaaggagcttaagcacaaggagcgccttggcaaggtgggcgccgtgtaggacggcgcctatgctgtgtacgaggggcaccgtgcgaagacggacccggcgaacgctcagatgcacaagatcgaggccggcgttacatcagccgcggcactgggcgcctacggctacgcgtaccacgagcaccgagggcagaacgagggccactacgtgagcaagcatcacgagcacatggtgccgcacggtcacgagcacgggcacggttactcatactactgatactgagacgactgatcattcgatcgatcgagatatgcatgcagaactcggtatatatacagtcgctatcgccggacacttgcgtgcatgtgagttaatcagagcatacgtcgagacctatgagctgctcgatcactacttc

SEQ ID NO: 70737 - DNA, 472 bp, Zea mays
  Clone ID: LIB3078-033-Q1-K1-F4
cgccatgcccttctcctccgtctggcactaggtcaacaagcaggaggtgcccatcaacgccgtctggctctcggctctcgtcgcgctctgcatggcgctgccgtctctgggcagcctggtggcgttccaggccatggtttccatcgcgacgatcgggctgtacatctcgtacgcgctgccgatcctgttccgggtgacgctggcgcgcaagtacttcgtgccggggccattcaacctgggccgctacggcgtcctggtcggctgggtcgccgtgctctgggtggccaccatcaccgtgctcttctcgctgccggtcacgtacccggtcaccaaggacacgctcaactacacccccgtcgccgtcggcggcctcctcttcctcgtcctcgcgtcctggctgctcagcgccaggcactggttcaagggccctgtcaccaatctggactgatgaatatgtataattggacatgtt

SEQ ID NO: 70738 - DNA, 436 bp, Zea mays
  Clone ID: LIB3078-033-Q1-K1-F5
cgaagtattcaaaccgaaaacattggatccggtgcggactgatcgtgtgcgtgaccggggctagcggcttcgtcgcgtcggatctggcgaagctcatcctctcacggtgccaatacgcggtccgtggcaccgtgcgcgaccctggtgctagcaagaatgcctatctcaaggtgctcgaaggagctgaggaaaggttgcagcttctcaaggctgatctgatggactacaacatcattgcatcagcagttgactgctgtgagggtgtcttccatgtagccagtactgtccttaccgatccacccttcaaccctgaggtggacgtcatagctcccgctgtaataggtacaaccaatgagttaaaggcttgctatgatgcagatgttaggccagctgaggaagcgacttcatgtggagctgagtatgctaatcctattta

SEQ ID NO: 70739 - DNA, 419 bp, Zea mays
  Clone ID: LIB3078-033-Q1-K1-F7
gttattgcctattgcatgatgctgtcactatatgccaggaatgacaggtggactgacgcgtacgatctgctggaagaaatgaaaacaaatcgtgctagtagtacacatcaagtaattgcttccctaatcaaaggggaatatgatgatagctccaactggcaaatggttgaatatgtcctcgaaaacagtaccatggaaggctgtgactatagtttccgattctttaatgctctccttggtgtgctttggtggtttggtcagaagggccgagctgctagagttctggatcaagcagtaaaatttgggctgttccctgagttatatcgtgacaccaaactggtttggtcactagatgtacataggatgtcgatgggtggagcactggtggctgtgtcagtatggctcaataagctttatga

SEQ ID NO: 70740 - DNA, 461 bp, Zea mays
  unsure at all n locations
  Clone ID: LIB3078-033-Q1-K1-F8
ctccatggccatggcgctccctgcctcgcccatagccctgcagcaagctcggctctggtgctgcgcgcgcgagggagatccctccatggccgcgtccaaggtagacggccagccaaactccctcctgcgcgatctcggccagagcgccgctcgctggcctctctgttcgtgagaaggctgtgaacgtgaggtagaagaagaccccatgagcctatgacaggaccgagagatgacgctcatgcaagtggcgtggtgccaaccacaagatgcagttggtggacgacctgaagaatggtggaattaaccagtggatgctcgccaagcgagtatctnccccagcaaacactacctaagtgttaaattaaaggaccgagagatgacactcatgcaagtggcgtggtgccaaccacaagatgcagtttgtggacgacctgaagaatggtggaattaaccaatggatg

SEQ ID NO: 70741 - DNA, 341 bp, Zea mays
  Clone ID: LIB3078-033-Q1-K1-F9
gggcggatcatcgaacatgtcgttgcagaggctctgtgatgcgctcgtcgaaggcgcggtgcacccgggaaagtgatgcccacagagttcaatcaggaggctctgtccaccagccatccaatggtgtacatgtattctgttatgagttctctgtttttagagcaagttaaataatattttttatgagttctctatataatgctcaaataatttatctaacataaatattatagcgataattattttagaatatagacagtatatttcttctattttaaaataaatattgtatttggcttcgtgctcatcatattttcagatttataaaaaaaatgttaacc

SEQ ID NO: 70742 - DNA, 457 bp, Zea mays
  Clone ID: LIB3078-033-Q1-K1-G1
ccgccgtcgctgcagccgcaggcgccagtgcagtctgtcgttgccgcgtcggctcccagcccatgtatggaaatcagtagctctgtggactgtggtcaggaaaaagaacagccaacaaataaacgtccaaggtcagaaagtactacagaatcaagcacaaaagcatccagggagaaaattagaagggacaagctgaacgagaggtatgttccctggtgagacaagacaatggttgcattttagtttgcagtttaatctttttttctcttcatattatcgtattcgtcaactaccactgtacttatgatattctctgtgttagattcttggaattgggtgccattttggagccagggaaaactcctaaaatggacaaaacagctatattgagtgatgctattcgtgtagtatgtgaattgcgtagtgaagcaaaaaagctcaaggattcaaatgagaa

SEQ ID NO: 70743 - DNA, 365 bp, Zea mays
  Clone ID: LIB3078-033-Q1-K1-G10
gacccacgcgtccgggcctacgagctgatccatgccagatgggccatgctcggtgccggtggcgctgtcatcccagaggcgtgcaacaagttcggcgctaactgcggccccgaggccgtctggttcaagaccggcgccctgctcctggacggcaacaccctcagctatttcggcaacagcatccccatcaacctggtggtcgccgtgatcgcggaggtcgtcctcgtcggcggcgccgagtactaccggatcatcaacggactggacctcgaggacaagctgcaccccggtggccccttcgaccccctgggcttggccagcgaccccgaccaggccgtcatcctcaaggtgaaggagatcaagaa

SEQ ID NO: 70744 - DNA, 417 bp, Zea mays
  unsure at all n locations
  Clone ID: LIB3078-033-Q1-K1-G11
cgcagctgacggacgactgaaccaccgacagacaacatggccgcctccgcctccaccgtgtccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccactttcccacgcccncgcccgtcacctcccagttctggctgtggctagtgacgtggcacctgggcctgttcatcgtgctc

SEQ ID NO: 70745 - DNA, 460 bp, Zea mays
  Clone ID: LIB3078-033-Q1-K1-G12
ggagcagccgcagtcccaccgaccccgccgccggtcgccctccatctcctcgccgctgcctctcgtttctctttccaataatcaagatgagccgtggtggtagtgccggtggtggtcaaagttctctgggttatctttttggaagcggtgagccccccaaaccagcagtggcaccagctgcaagtgctccacctgttgagaaaccatctgctgcaaagactgatgcgaccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgctcaccaaagtatccttccccgcctgctgcatgctatgtctgaatcgtgaacaccggtgt

SEQ ID NO: 70746 - DNA, 456 bp, Zea mays
  Clone ID: LIB3078-033-Q1-K1-G2
cgttcggaactcgacggcactagtcacgcgtcccctccatggttatggcgctccctgtctcgtccatagcccagcagcaagctctggtcttgggctacacgcgcgagggatatccctccatggccgcgtccaaggtagacggccagccaaactccctcctgcgcgatctctgccagagcgccgctcgctggcctctctgttcgtgagaaggctgtgaacgtgaggtagaagaagaccccatgagcctatgacaggaccgagagatgacgctcatgcaagtggcgtggtgccaaccacaagatgcagttggtggacgacctgaagaatggtggaattaaccagtggatgctcgccaagcgagtatctcccccagcaaacactacctaagtgttaaattaaaggaccgagagatgacactcatgcaagtggcgtggtgccaaccacaagatgcagttg

SEQ ID NO: 70747 - DNA, 391 bp, Zea mays
  Clone ID: LIB3078-033-Q1-K1-G3
gcaggacgtacgtacgtacatagatcgatccatcgatcgctagctagctgacgaccatggcttggctacaatctgccggcggcaggggccgttaatgtaaggtcgttcgacgacgcgcaggtgtcaaaactgaagtactgtcactcgtgcggtgcctgtctaactagggccactagacaatgcagtccaggcctgtgatgcatggtgccgttgccgcttgtgcgtcatgatcaatagaccgttgctcatgctacatcgcctgcacctagcgagcctgtcaaactactcgtggtctataccatcatactcttattcatacatctacttttcatacaaggatgtattcaacttacatattggattagggtgcaatgaacgagtaacatgttca

SEQ ID NO: 70748 - DNA, 434 bp, Zea mays
  Clone ID: LIB3078-033-Q1-K1-F1
cccacgcgtccgcccacgcgtccgctcaaccctatcacctcgctctactatgtcgcgccgtgctgcttctgcttcctcctcgtgccctgggccttcgtcgagctgcccaggctgcgcgccgtcggtaccttccaaccggattttttcgtctttgggacgaactcactctgcgcctttgcgctcaaccttgccgtcttcctgctggtcggcaagacctcggcgctgaccatgaacgtcgcgggagtagtcaaggactggctgttgattgccttctcgtggtctgtgatccgtgacaccgtcacaccgatcaacctgttcgggtacgggatcgcgtttttaggggtgggctactacaatcatgtcaagctgcaggcgctcaaggctaaggaggcacagaagaaagccacacaggctgatgaagaggccgggtcgct

SEQ ID NO: 70749 - DNA, 368 bp, Zea mays
  Clone ID: LIB3078-033-Q1-K1-D7
tcaaatcacaatgatggcctcggcgacttgtgaatcttaccctcgccaaggtgtcaatggaatctacaagtttaagcaatgagaatgtactagtcaaagttctggactcgattaacatcaccctgtctgctgcagattaactgaaggattctattacactggttcgcccacataatgctaccttccatgtgatcacttgattcaggctgtacattagcacaatttacactaacgaccattatggaactacacctatagatgtcaaccacgctattctcactattctctactgtatcgaacatcgtgatcactactggctcatctagaactcatggagcgctttcttgtgtgatgatacgatacttaat

SEQ ID NO: 70750 - DNA, 461 bp, Zea mays
  Clone ID: LIB3078-033-Q1-K1-D8
cggacgcgtgggggaagttcatccgttggatttcaccactaactgtggtaagatcagggtctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtaccttgcaaggaagctggctggtgatccgaaccttcactttgttgaagctgttgctcttaagcctccggaagttaccatcgacatggctatgcagc

SEQ ID NO: 70751 - DNA, 225 bp, Zea mays
  Clone ID: LIB3078-033-Q1-K1-D9
taatggactggtacattaatatagttaccctttcatacacacacatgatcactcacatatcaattttgctggaccaaactcttctacttaaatttttataacatcactacacttcatcaatcatcatatagcctaatattatcatgcacatactcgatcagaattctccaactatttattaatcaatgttgattggcgaatttacacatacagatccgtaattac

SEQ ID NO: 70752 - DNA, 454 bp, Zea mays
  Clone ID: LIB3078-033-Q1-K1-E1
cccacgcgtccgcttccatcccaggcctttgaatacatcaaatacaatggtggccttgacactgaggaatcttacccttaccaaggtgtcaatggaatctgcaagtttaagaatgagaatgttggagtcaaggttttggactcggttaacatcaccctgggtgctgaggatgaactgaaggatgctgttggtctggttcgcccagttagtgttgccttcgaggtgatcactggtttcaggctgtacaagagcggagtttacactagcgaccattgtggaactacaccgatggatgtgaaccacgctgttctggctgttggctacggtgtcgaagatggtgtcccctactggctcatcaagaactcatggggcgctgactggggtgatgatggttacttcaagatggaaatgggcaagaacatgtgcggtgttgctacgtgtgcattctacccta

SEQ ID NO: 70753 - DNA, 462 bp, Zea mays
  Clone ID: LIB3078-033-Q1-K1-E10
ctaatgcatacttttcactcttcatggccctgggaaacatacttggatatgccaccggagcatacagtggatggtattcgatatttcctttcactgttacagagtcctgcggcatcagttgtgccaaccttaagtctgcctttcttcttgacattattgttctggtcatcacaacgtacactactgtaacatccgtgcaagaacctcaaacttttggaagtgatgaagcacaaaatccaggtgctgaacaggaagctttcctctgggaactttttgggtcattaagatacttcaccctaccaatttggatggtcttaattgtcactgcccttacttggatggcatggtttccttttaccctctttgatactgattggatgggccgagaaatctatcgaggaagcccagacaacccaggagagacccaaaggtaccatgatggtgtgagaatgggttcttttg

SEQ ID NO: 70754 - DNA, 463 bp, Zea mays
  unsure at all n locations
  Clone ID: LIB3078-033-Q1-K1-E11
gtgctcatgggcgccgtcgaggggtaccgcgtcgccggcggcccgctcggggaggtgggggacccgctgtaccctggcggcagcttcgacccgctcgggctcgccgacgacccggaggcgttcgccgagctcaaggtgaaggagatcaagaacggccgcctcgccatgttctccatgttcggcttcttcgtgcaggctatcgtcaccggcaagggccccctcgagaacctcgccgaccacatcgtcgaccccgtcaacaacaacgcctgggcttacgccaccaacttcgtccccggcaagtgagcgagggcatgatgcttgcatgcgtgtaccgtagacgtaccgtattcctacgtactgcaggttgcaccagtatttgtgaagggagctgtgcgtgggagccagagatggtaccgctagtgtatnnttgtatgcacgccgtggagctgatcaatgaaatatg

SEQ ID NO: 70755 - DNA, 184 bp, Zea mays
  Clone ID: LIB3078-033-Q1-K1-E12
acgtgaaccccaactaataactaaaacgatggatcggatcatctgcatgcatgcatatgcagtatgctgcttgcctagctgcctgtaacgaatatgaatgcataaaataacgcccctgctgctcccatatgcatcagcagtgtgtaccactatatatgttatatactgtatttcgctaccgaat

SEQ ID NO: 70756 - DNA, 437 bp, Zea mays
  Clone ID: LIB3078-033-Q1-K1-E2
gacaaaattcatattatcaaccactaaatgactaatgtcagtgtctactgctagaatgcccaagctcatgaaaagtacggaggccttatgcatgaatactatatccatactcagtgtgcaatcatcatgttagatgtaacctcaatgcttacttacaagaatgttcctacgtggcatatggacctgtgcagggtctgtgaaaacatccacattgtcctctgccgtaataaggttgatgtgaataacacgcaagtcaaagccaagcatgttactttccacaggaagaagaatctgcattactatcaaatttctgccaagagcaactacaactttgagaaacctttcctgtaccttgcaaggaagctggcttgtgatcccaaccttcactttgtataaactgttgctcttaagccttcggaagttaccatcgacatgct

SEQ ID NO: 70757 - DNA, 259 bp, Zea mays
  Clone ID: LIB3078-033-Q1-K1-E3
cgctaagatggaggtttccaccaaccattttcctgacgcccatcaagcaagacaccaacggggtcgtccttccatactacgggtacagcattaactggaactatgggatactcccatatacatgggaagacccaacctctgcaaattctgaggttgaaggagcatctggcgataatgatcccgttgatgttaatgccattggtgtacggactgctaatacacagcatcgactcatgaccctgacttaagcatagtaccc

SEQ ID NO: 70758 - DNA, 471 bp, Zea mays
  Clone ID: LIB3078-033-Q1-K1-E4
attagtgcaaattttacattggcaaatacaaatatttgcaatggtcttattggcgaagaaattttaccagaactagattctccaaactccttcagaaaaattatttcatctccatcaatgtcaagattggactcgttctctacctcacaaggcagtcctgtgtcaactgagagctcaatatttgagatcagtaaaaatatttggaggtccagtgccccaacaactgtatcatccaattttctgactaatacagaggtgaaaatggctggcggagctgctggagaggatagagtccaagctgtgtgctcagagaaaaatggatggctgatttgtgggatatatgatgggtttaatgggagggatgcagctgattttcttgcggtaactctatatgataacatagtatattacttatacctgctggagaatcggataaggcaacaaaatggtttgtacaattcatcagaaagc

SEQ ID NO: 70759 - DNA, 389 bp, Zea mays
  Clone ID: LIB3078-033-Q1-K1-E5
cccacgcgtccgcggacgcgtgtgctgaaatggaggctagcagccgccgccgcgtctggcttgtgccactgctggtggtgatcatcgggtgctgtgcctgccgcgcccagatcccgatcccggcgaggacggacgggttcgtgtacggcgggaagccgccggcgtggggcgagacggcggtggtagaggcgttcttggacccagtgtgccccgacagccgtgactcgtggccggctctcaagaaggtcgtcgagcactatagctcacgcgtgtacgacgtcgttcaccttttaccgctgtcttaccacagctatgccttcattgcgtgccggtcaattcatgcggtgaacaaactaaatccgtcgttcgtgtaccctttgctggagaag

SEQ ID NO: 70760 - DNA, 400 bp, Zea mays
  Clone ID: LIB3078-033-Q1-K1-E6
gctagtcatcactagtcacgttcgtccaccagagacaacaatggccatggagacgtgcttcagagcgtgggcgctgcacgcccccgctggcagcaaggacaggctcctcgtctgcaacctggggctgccgtcgaagcgggcgctcgcgccgctgtccgtgggccgagttgacactcgccggccgcggcacgtctgccaatgcaagaacgcagtggaccaagttgaggcggctgactagctgatccgggactggttggtgatggcgtaccagacgccgatgctggaggagatcctggctcctcagagcaggccgtaccgcatgatcgcgccatatatcgacgagctaatcaaaggcttccccgtcatgatcacgtgctgcctggataacacggcctacagt

SEQ ID NO: 70761 - DNA, 435 bp, Zea mays
  Clone ID: LIB3078-033-Q1-K1-E7
cccacgcgtccgcccacgcgttcgcggacgcgtgggccgccgcaaggagaggtaagttgaggagacatcttcgagaagctgaaatggctcctaaagtttcattagctgctcctgccaagaagggtgatgccaagacccaggccttgaaggttgccaaggctgtgaagtctggggcagccaagaagaagaccaagaagatccgcacgtctgtgacatttcaccgacccacgaccctgaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcaaggctgccgtcaagaagatgtatgaca

SEQ ID NO: 70762 - DNA, 447 bp, Zea mays
  Clone ID: LIB3078-033-Q1-K1-E8
cccacgcgtccgaacgaacacaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcattgacttcactgccgcctggtgcggtccatgccgcgccatcgccccactgttcgtcgaacacgccaagaagttcactcaggtcgtgttcctgaaggtggacgtggacgaagtgaaggaagtcaccgcggcctacgaggtcgaggcgatgccgaccttccacttcgtcaagaacggcaagacggtcgcgaccatcgtgggtgccaggaaggacgagctcctggcccagatcgagaagcatgccgcgcctgcgcctgcgtctgcgtctgcctaaaggagatcagatcagtcg

SEQ ID NO: 70763 - DNA, 437 bp, Zea mays
  Clone ID: LIB3078-033-Q1-K1-E9
tgtagctgctgtgggagtctcgttcatgcagtttgccaacaagaactcgatgaggaacagctatgtcatcggactctcgttgttccttggcatctcggtccctcaatacttcaacggatacacttcttcagctggcggccacggacctgcccggacaaatgctggatggttcaacgacattataaacaccgtgtttgcttccgggccgacggtggcgctaattgtcgcttctgtcctggacaacacgctggagttcaggggctacgaggccgaccgggggctctcgtggttccagccgatcctgcgccgccataagggatactcggaccccagaaacgaggagttctacagcttcccaatcagcgtctatgacgtcatcccagaccgatttcggcgctgactccaaatgaccgctgttaccccgcagctgtgcatgt

SEQ ID NO: 70764 - DNA, 435 bp, Zea mays
  Clone ID: LIB3078-033-Q1-K1-D5
cggacgcgtgggcggacgcgtgggcggacgcgtgggcgccgactctgccgtctccctggcctctttcccctcgtctcgtctgcatccgcctgcgccgccccaagacctcatcacctccccttcgccgtgaaccctaaccccgcgcccctcgccccctccttctcgtcgtcatcgccgcccgcttttccgggcccacatcggctcttctcttccacgagtggttcaagcatggtggtcgtgggctccgcggactccttcaacagcatcttttccaaggtgcaagatgaaaagctaccagctggcttttactacacggcggtgtggtgtggaccatgtaaggcgatcgcacctctagtatcatagctgagcagccagtatcccaagataccggtgtacaaagttgacattgaattggaggactgggaaacaaactcc

SEQ ID NO: 70765 - DNA, 436 bp, Zea mays
  Clone ID: LIB3078-033-Q1-K1-C2
attggctcactgaaaatatgcgtacaaattacttcaccgtatcagctatgcacggtgacatgccgcaacaagaaagggatgccattatgggtgagttcaggtctggcgcaactcgtgtgctaataactacagatgtttgggctcgaggactggacgttcagcaggtttcacttgtcataaattatgatctcccaaataatcgtgagctttacatccatcgcattggtcgttctggtcgttttgggcgcaagggtgtggcgatcaatttcgtgcgcaaggatgacatccgtatactgagagatatagagcagtactacagcacacaaattgacgagatgccaatgaatgttgctgatcttatttgagcagcaagaggatcgggaggtgagcttcttgtgttggcttgaggcccttggcgctagtgtggctgtggact

SEQ ID NO: 70766 - DNA, 449 bp, Zea mays
  Clone ID: LIB3078-033-Q1-K1-C3
cggacgcgtgggccgtcactccagctatttcctacgcggcaaaggtggcccaagcagcgacagagaaacccgtgctcgccaacggagtcgctaagaccggttagctggaccgtccaactgatgctccatagctagccgcgagcgacggtcgacgtccccaagagctcgactgaattgctgtacaagggaactattgaccaaccaaggcaggctgtggaactgggcaggcatggcgccctagagcgttgcggctccatctcgtcgctgccggagagcagctggctagctgttagcgttttccctagtttctctctctccctctctctctgtcgctgtgttccccgtttcagtttccttatagcccgaagacttttctgctgtagtattggaatgccagagacctttggccggacaaaagggatttgcgaaggccgtctggctgttggtgt

SEQ ID NO: 70767 - DNA, 411 bp, Zea mays
  unsure at all n locations
  Clone ID: LIB3078-033-Q1-K1-C4
ccacgcgttcgcggacgcctgggcgccgtcgtcgcccaccagcacgccgtgcccttcggcggcggtcagcttcggcggcaagtgccccaagaacgcgctgaaactgggcgtgtgtgccaacgtgctgggcctcgtcaaggtgtccatcggcaaggtgcccaccgacttgtgctgcccactgctggacgggcttgccgacctagaggccgtcgtctggctctgcaccgcgctcaagggcaacgtgctcggcattaaccttgacgtccccgtcaagcttaccctggttctcaactactgcggcaagagcgttccttagggcttcctgtgcgcctaatatatatactagtggctagttcgtcactagcttcacagttgccatatgcatatttgngattcttcttctttccttct

SEQ ID NO: 70768 - DNA, 459 bp, Zea mays
  Clone ID: LIB3078-033-Q1-K1-C5
gcgcatcctattgccctcgcgccaccgtcgccgccgctgcagcgagccaccggcctgccgtcgcctgaggtagacaccaagccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgcttgtcaagagcgtgactggtagcaagatcctccgcatcctcaaggcccatgggttggcgccggagatcccggaagatctctacttcctcattaagaaggccgtggcgattaagaagcatctggagaggaacaggaaggacaaggactccaaattcagactcattcttgttgagagcaggatccacc

SEQ ID NO: 70769 - DNA, 460 bp, Zea mays
  Clone ID: LIB3078-033-Q1-K1-C6
ctccgattccctcatcctctacttcaaggcggagggcaccatggaggatagggccattcccaagatcacagaatctcttgagggtatggagggagtcaaggacctgtaggtgctcattgaagaaggcatcaaaagcgttgtgttaacataggagacaactgtgcaagctactgttgtagcctggaacctcgtgcaagctatccatggagctcggttcaagctgcaaactgtaaacttggtcttcgatgatctcgacgagccagcataaggagccgtaggcattgaccaatgcagcgagtgagctaatacgtggtgccaaatgcatataattcggtctactgattatgtttactctgctacttacctttgatttcccaagcacgatcttgatcctttttttggcaaatgtgccagaaattaatcaatacatctatcgaaaaacatctacggaatttggctt

SEQ ID NO: 70770 - DNA, 436 bp, Zea mays
  Clone ID: LIB3078-033-Q1-K1-C7
gtcggatcaagcctccgggggccccttggatcgatccgatctccgttcgcgctgaagcctgatctccagcgggttcgcagcaggggcgcaggacctcgatcacgaggaggcaggggagcagcatccacaaccacaagccatggcggggagggccaacattcccactaacaactccgccctcatcgcaatcatcgccgacgaggacaccgtcactggcttcttgatggccggcgttggcaatgttgatctgcgcaagaaaaccaactacctcctcgtcgacaacaagacgacagttaaacacatcgaggatgcgttcaaagaatttactaccagggaggatattgctattgtgctcatcagtcagtatattgccaacatgataaggtttctggtggatagctacaacaagcacgtgcctgctattctggagatccca

SEQ ID NO: 70771 - DNA, 250 bp, Zea mays
  Clone ID: LIB3078-033-Q1-K1-C8
aataacactcttaaactggacagagtctaccaaccaccttgactctcgtcaaggtgtcccttcgcaactagcccacctactctcgccgtcctcttctagaacgactacacgacctaaaggtcttcgattgtctacgcacccagcttacatccaacctgctcggccttcaacctgacgttccactataactcaccatgctcctgaactactgctgccagcacggtctctactgcttcctagtgctccttat

SEQ ID NO: 70772 - DNA, 464 bp, Zea mays
  Clone ID: LIB3078-033-Q1-K1-C9
gcactcgtccggctggcctgaactgctatacttctcaacgtgttggaattgtatttcagtttcctgagagggatttcttagcggatactgtgcttgaagaagttacttttggatggcctaggcaaaaggcagacctcctattaaaagaacagctcgctttaaatcttcaaaatgcttttaactcggttggtctgacaaccatctcattagatgaaaatccgcaagctctaagtggtggatttaagaggcgacttgctttggcaattcaactggttcaaattcctgatctgttgctgcttgatgagccacttgctggtctagattggaaggctcgagctgatgttgtgaatctcctaaaggacctgaagaaacatcatactatactggttgtaagtcacgatctaagggaactatatccactagtggatcgctcatggcgaatggaaatggggggaagtttgaag

SEQ ID NO: 70773 - DNA, 427 bp, Zea mays
  Clone ID: LIB3078-033-Q1-K1-D1
cccacgcgtgcgcccacgcgtccgcgagttcgcggagccgccgcgcgtgaccagcctgcagaacaccgtgcctctcgcgaccttcagcgacttcggcgacgacgtctacttcgtcgccgaccagcggggctacgaggccggcgtctactacctctccggccagtacctcaagaccgacgataagtctggaaagatcgtcgacccgtgcctgcagctcaacaaggtggtgcgagagatcaagtattccccgggtggcgtcaccgtcaagacagaggacaactcggtgcacagcgcagactacgtcatggtttctgctagcctgggtgtactgcaatccgatctcattcagctcaagcccaagctacctacatggaaggttagggcgatctaccaattggacatggccgtgtacaccaagatcttactc

SEQ ID NO: 70774 - DNA, 305 bp, Zea mays
  Clone ID: LIB3078-033-Q1-K1-D10
gccgcaaacgttatcatccagcgcccgggctgtacttacccggagaagcctgacgttcaggtagtgcaaaactgaggcacgtcatgagagggactgttataggcacacttaattgttaaccagtgcgtggttcggtgtctacacaccctgtattcttccgaggcttctcttctgatccggccaatatttttgccgtgaaatttgtgttctgcaactatggacgtctcctttgttgctgtataaggcatgatttgccatcattctgttgcttccgtgatgcttgcaatgcaatgagaatgtgttgg

SEQ ID NO: 70775 - DNA, 415 bp, Zea mays
  Clone ID: LIB3078-033-Q1-K1-D11
aactggtgctgctgttcctcctccctttgccttcttgggctcaggaaatgaaggaacgcaggcacgccaagcttctaatggacttgaaggggaacatggtgaaccaggcatacacagggatgatgacgtccatataaatttggctggacccgagcaggctgcggaggctttgagagctgtgatgcagatgcttgggccacagatgggtcaacatgagggtgcacctagaggaccaggttaagcgtgggaggtaggaaaatgtgttacgtggcgtattgtggtctgcaggagtcttatacgggacattattttgtcttctccatcctgacgaagaatggagattctcgtgcgccttattattatagcagcatatctgtgtgctacaacaattccaccgtaatggttaccggcgttc

SEQ ID NO: 70776 - DNA, 428 bp, Zea mays
  unsure at all n locations
  Clone ID: LIB3078-033-Q1-K1-D12
acgcaaagagaaggaaaggcaaaatgccttataagagattatctactgttgggttacatataggttcatggaaaatgacatatatatgacacctgcattatcaccagggggtggccctgtacgtgacatatccgtgttgcctaatcaagaagacaaattgcgaaacatacactccgcagacgcctttgagatgatacaaaaccatctcaatcttatcatgggagaaaagatagcatcaccgaccgatactgttgttgagatcagcaacttgaatcttggaaagctgtatgcagcatccatcatgtatggttactttctgaagagagtggatgagcgattccaacttgagaaaactatgaagactctnccaccaaagcccaaccagcagatagtatttgaaaacctacagcctaatccattctgggata

SEQ ID NO: 70777 - DNA, 432 bp, Zea mays
  Clone ID: LIB3078-033-Q1-K1-D2
aaataaactaaattgtagctgaccatatttatatgcatctaaactgtttgctttgtgtgccatggagaagtatagactctaccttaaacggctaagtgctgtggcatcacaacaggctagcattgttgctgctttgggaggcaacgacccctttatgcggatgagtgcatttgaaggactccatggttatcaatcttttgtctcttcagcagctctgccatctttcagtccacagggactgttaaatagaaataatccagcatcatttgcgattcaaggggtgtctgcttccaggccaattcagattgcaaccggcaataccacaatgagtcattccattggcgatccaaatgataaatatcaccttagcttaccaggcactagttgcctacaaggaaatctagcataaggtttgccaactccagttgggca

SEQ ID NO: 70778 - DNA, 442 bp, Zea mays
  Clone ID: LIB3078-033-Q1-K1-D3
tgtgaatcctagcccatacatggcgtatgtacaggcaagaggctgtgtattggttgcgtctagtgctgaaattcttacacgagtcagtaaggggaagattattaatcgaccacttgctggaactgttcgaaggggcaagacagagaaggaagatcaaatgcaagagcagcaactgttaagtgatgaaaaacagtgtgccgagcacataatgcttgtggacttgggaaggaatgatgttggcaaggtattcaaaccaggatcagtgaaggtggagaagttgatgaacattgagagatactcccatgttatgcacatcagctcaacggttagtggacagttggatgatcatctccagagttgggatgccttgagagctgccttgcccgttggaacagtcagtggtgcaccaaatgtgaatgccatggacttgattgataagttg

SEQ ID NO: 70779 - DNA, 467 bp, Zea mays
  unsure at all n locations
  Clone ID: LIB3078-033-Q1-K1-D4
cggttcggaactcgaggcacgcgtccgncggcgcctgagcttttatcccaggccatcgaatacatcaaatacattggtggcctttgcgactggggaatcttacccttgccaaggtgtcaatgaaatctgcaagtctaagactgagaatgtttgagtcaaggctttggactctcttaacatcacactgggcgctgaggatgaactgaaggatgctgctactctggttcgcccagttagcgttgccttcgaggtgatcactggtttcaggctgtacaagagcggagtttacactaacgaccattgcggaactacaccgattgatgtgaaccacgctgttctggctgattgctacggtgtctaagatggtagccactactggctcatcaagaactcatgtagcgctgactgaagcgatgatggttacttcacgattgcaatggtcaagaacatgttctgaattgctacgt

SEQ ID NO: 70780 - DNA, 454 bp, Zea mays
  Clone ID: LIB3078-033-Q1-K1-C12
gtcatccccgagaagagccgccgtcgcgcaaagccgcttcgacgccgtcactcgtcggggcgcaaccatggtggccgcaaagaagacgaagaagtccacggacaacatcaacaacaagcttcagcttgtgatgaagagcggcaagtacacgctcggctacaagactgtcctcaggaccctcaggaattctaagtcaaagctagtgatcattgctaacaactgtcctccgcttcggaagtctgaaattgagtactatgctatgctggctaaggtgacagtccaccacttccatggaaacaatgttgaccttggaacagcctgtggaaaatacttccgtgtctgctgcctcagcattatcgatcctggtgattctgatatcatcaagactacaccgggcgagcagtaaggatgccacaacagctgtactcggcatctgaattcttaatagctgatg

SEQ ID NO: 70781 - DNA, 451 bp, Zea mays
  Clone ID: LIB3078-023-Q1-K1-B6
cccacgcgtccgcggacgcgtgggcgggctatggccggactacgacgactggacctggccgtcgtgctgccgccgcacccaattcgagatggacaagatattgccactgaaggaggtgcttgacaagtactggccgtccctctactgctccaaatctggaacatgcttcagcggcaagggactcttctgggctcacgagtgggagaaacatggaacctgctctgcccctgtggttcaggatgaattacagtatttcacccttgcccttgacctctactccaagtataacgttacggaaatgctgtcaagtggagggatacaggtttcaaatggtaaggaatatgcactgagcgatgtcatcgataccatcaaacatgcttttgggggatcgccacatattgtttgcaagaggggttcaatcgaagaacttaggttatgcttcgacaaagaa

SEQ ID NO: 70782 - DNA, 441 bp, Zea mays
  Clone ID: LIB3078-023-Q1-K1-B7
gttcaaagttatattgacaagggattcagagcgatcgaaaagctgttggaaggatgtgagagtaaatatgctactggagatgatgtccaattggcagatgtgttccttgaaccacagatacatgccggcataaatcgcttccaaatcgatatgtcgatgtacccaatcttggagaggctccatgatgcatacatgcaaattcccgcattccaagccgcgcttcctaaaaatcaaccagacgcaccttcatcataatcatcaagattatctcaataatttgcatgtcattttgtaataatttggatagggagccactgcttcctccatcccgttgtggatcaaaagggtgaacgattggcacttacctgcatggtccaatacctattatatttcttaaacagatactatttacggctattgtaatttaagcccaatacctgc

SEQ ID NO: 70783 - DNA, 349 bp, Zea mays
  unsure at all n locations
  Clone ID: LIB3078-023-Q1-K1-B8
cccacgcgttcgtccacgcgtgtcgtcacgcgtncgggataagagggccgcaatcaaaggtgtctccatctttccggagtcagtaagctcagcatcacatggtaaacccgacctcgtgctgaagaggcggaacataaaagctggagccgctacagcactgatggcaggcagggtgaagccgtcctcgtggcagagcgccagttccacgagctcaaggactcggatgcctgttctggcagcacgcaagtaggcagctcgttgcctcaggctttgtgtgggaaatagggggcttgtgaaatatggacttgcccgtaatattgctatgtttctttggttgtactatactcac

SEQ ID NO: 70784 - DNA, 466 bp, Zea mays
  Clone ID: LIB3078-023-Q1-K1-B9
ggtgatcgggaaggtgcggtcgacgatcgggctggacaagtcggacccgagcgtggccgacgcggtggcggagctccgggacctgtccaactcgtgggtggccaagtaccggcgggagaagtcgctgctggggcgtccgtcgttccgggagatgtactcggcgctcaacgccgtgtcgggccactacatcagcttcggccccacggcgcccatcccggccaagcgccgcgcccgcatcctcgaggagatggacaccgccgagaaggcgctccaacggggcaggtaggccaaatcccagcgaagctggcccgttgcaggaacgcgagtgcccagctcggcgacaacgctaccattttgtttttgtaactactgcgatgcattcgtcgtcgttgttttcgcggctgggagcgtgtgttgtgactgtggagtaaaaagttaccgagcttttgagctgagtttgcgactt

SEQ ID NO: 70785 - DNA, 404 bp, Zea mays
  Clone ID: LIB3078-023-Q1-K1-C1
gaagatgtcaagcagttcttcgagcccttgaaccttcacttcgggaagaaatggcttttcatgtgtaaaacattcactatttctcctgaggattacttgattattagtgataaaggaaatgtctgtcttgggcttctcaacggaacggagattaatcatgggtcaactatcatagtaggagatgtttctctgcgcggcaagttggttgtgtacgacaatcagcggaagcagattggatgggcagattcagactgcaccaaaccttaatcacaaaagggctttcctttctttctctgacgaagcatcactctctacataatacatgtgtaaagcgtaaatagtgaacgccattgtattgtagaatacattattaagtggagactgcctttgtgtatgggtatatc

SEQ ID NO: 70786 - DNA, 465 bp, Zea mays
  Clone ID: LIB3078-023-Q1-K1-C10
cggacgcgtgggatcaaggtgggctccttcggcgagggccgcatcaccatgcgcaagacggtgggcaagcccaaggtggcggcgtccggcagcccctggtacggccccgaccgcgtcaagtacctcggccccttctccggcgagcccccgagctacctcaccggcgagttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtc

SEQ ID NO: 70787 - DNA, 459 bp, Zea mays
  Clone ID: LIB3078-023-Q1-K1-C11
cgtcgctccaggtcttctgcaagcagcaatcggagcgttctctacaggcgttcctgactgccaggagaggattgctaggcatgaagctgctcatttcctagtcgcctatttgattggcctccctatccttggatattctttggacatcggaaaggagcatgttaatttgatagatgagcaattacaaaagctaatatacagtgggcagcttgatggaaaggaactagacaggttagctgtagtttcaatggcaggactggctgctgaaggtctagaatatgacaaagttgtaggtcaatcagcagaccttttcacccttcagaggttcataaacagaactaagccgcaactaagcaaagatcagcaacaaaaccttaccagatgggcagtcctgtttgctgcatcacttctgaagaacaacaaagcagcccatgaggcgcttatgtcagcgatgtccca

SEQ ID NO: 70788 - DNA, 404 bp, Zea mays
  Clone ID: LIB3078-023-Q1-K1-C12
ggcacacatgctttagagttctgatgaaccctttcgtcatatatccactgatggcatgtgcaaaatggagatctctaaaaaatgtgtgtggctcaaacgcttgtccctgatgaacaagacatagaagcttcaatttcggtgaaccggttggtacataataatggttccttgtatatttttgaccgaagtagaggtatcaactggttgtttgttgtaaacagcgctgttgtagtactctgaacagagtccatatcgtacatgtaaattctctgtgtcactgttctcatatgcagttgctgttgaaatctgtgcgttactgcagcctgtaagggataggccaaatggaaacttttgctgatataaatatcatgtacagatctgtcgtgaaaaacagataaatacat

SEQ ID NO: 70789 - DNA, 292 bp, Zea mays
  Clone ID: LIB3078-023-Q1-K1-C2
agcgccactgtgcagtgcgcgcagcaagcttgcttagctagccgccatagactgcctcgggggcgtaatacataaactcgtggtcatgaagggtactggcgtctgatccatctacggaaggaatctcgtcggcttcagaacgtcacgccgattcatcctgaggcacctctcatacgacgagatggcaatgtcggcgacaagatgcgttactactgacctcgaccacatgcagatcacctgcgcacagtgagacctctacagatctgactcgcccatgggctacaatccgtta

SEQ ID NO: 70790 - DNA, 235 bp, Zea mays
  Clone ID: LIB3078-023-Q1-K1-C4
gtggattgctacattccagtgccacagcggtagaccgacctaacgatcttactcgctggggaagatgtcttgttcatcaccggtcctggtacagatgccactggtcgtatcgagcgtgtctacggccatattgctgacacagttgatatcgttgaaatctgggacaccacgcactgctccgtgactggcgtcgaaatgttccagaagaccatggacgataccatggctgtagaca

SEQ ID NO: 70791 - DNA, 446 bp, Zea mays
  Clone ID: LIB3078-023-Q1-K1-C5
cgacaaatccacacgaatcctctgattcagagcagggtgttggcattgatcagacgcctgccatggcggatcagttcgtggattcggcgaacaatgtgatcattgaggaggtgaacaagggcctgaacccaggaatggtggttctgcttgtggttgcaagcttcctgctgctcttctttgtggggaactatgcgatgtatgtgtatgcgcagaagacgctcccgccaaagaagaagaagccggtgtcgaagaagaagctgaagagggaaaagctgaagcagggggtctctgcgccgggagagtaaacggccatgctgccgatccttccgtccagagctcctattcacatgattattaaagaaaaaaatttatatatatataccagctggagccgtagtgttggagtaactttgttctgtagatgctctgtctttaatggtacatct

SEQ ID NO: 70792 - DNA, 411 bp, Zea mays
  Clone ID: LIB3078-023-Q1-K1-C6
cccacgcgtccgcccacgcgtccggtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttccggctaggcttacaggagtacagggcgactagcatgggagtagtgcaatacttttgggagcaatagataacgaggatcctggtctttcgaatagtattgttaatgaaatttttcgttcggttgtgtttctgatgtaatcgttgtactgagtagaccttctggataccggattctgagtagacctttgaatccttgatggatcagccaatctcggaaaggaagtttcgtattttgttgttccgttaac

SEQ ID NO: 70793 - DNA, 452 bp, Zea mays
  unsure at all n locations
  Clone ID: LIB3078-023-Q1-K1-C7
tttcactgctccagcgaaggcacagccgccaccgtttcttgatctcccatcttcatcttgttcgtagcgccggcgctccatcttccgctccctcccttagtcgcgctcggcacgcgggtgacggcggcagtggcggcactcaggatcgggctctcagcgacggcatcagcggtttcccctcccgcttctctccagtcgcctcgcgccctcgcctccggtcctccgcacaccagccggtgaccctccatatagggtgtgagactaccaaaactcgaaaatgaacaagggaaagatttttaagctagccaagggattcagaggaagggcgaaaaattgcataaggatagcaagagagagggtggagaaggcgctgcaatattcatatagggatcgacgcaacaagaagagagacatgcggtctctntggattgagcgcatcaatgctggtacac

SEQ ID NO: 70794 - DNA, 449 bp, Zea mays
  Clone ID: LIB3078-023-Q1-K1-C8
caagaaccgggagctggaggtgatccactcccgctgggccatgctgggcgcgctcggctgcgtcttcccggagcttctcgcccgcaacggcgtcaagttcggcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacc

SEQ ID NO: 70795 - DNA, 388 bp, Zea mays
  Clone ID: LIB3078-023-Q1-K1-C9
tggacttcatctacgcagtttcgggtgctttcaactgagagtcatgtgtgtttgttgggggttccttggtactccctccgtttcgttttagttgtccctggatagtgcatatatgaactattcagcgacctctaacgttaaaccgagatattatcatcaacaccatgtacgtgttccctactaccgctactaggcttgcttttctgagcatgagattcagaaagttcatcttgtattacaacacaatgcacggctgctaactgatgccgtaacccgtgaatgcaacactcaacgctacagcagatgtacgagcctccatttataggatgcagtcttaagaactctcaacttcgacatcattcgattgctataccagaacctctaatac

SEQ ID NO: 70796 - DNA, 449 bp, Zea mays
  Clone ID: LIB3078-023-Q1-K1-B5
cgtcgtcgggctcaagcccgccgttgcagtgccgcaggccgccgccgcctcatcggcggggaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgaggagttcggcagctgccagttcccctacaacttcactgggtgccaggacctcgccaagcagaagaaagtccccttcatcagcgacgacctctagattgagtgctaggtgaacgagaagttcaagtgcggcttcaacgttctctggaagtggcgaatcaactagcagcagcgtttgatgggaatgg

SEQ ID NO: 70797 - DNA, 461 bp, Zea mays
  Clone ID: LIB3078-023-Q1-K1-A12
gctaaacgcctgtctgcaatccatgcacattattgcacactggaacagggggatattgagggcactaatagaaagttggaggatatactcaattcctcttcactagatgatgcttgtgacaagatcaacagcttagccaaggctaaagaacttgattcatctctaattcttctcattaacagagcttggactgctgcaaaacaatctacaactatgaatgataaggtcaaggacataatgtatcatatttatacaactacaaaagaaagcctcaagagcatctcacctcctgagatgaagctgctgaagtatttgctgaatattgaagagcctgaacagagatttcatgctcttgcaactgctttctctcccggagatgggcgtgaagctaacgatgaatatgctatatacacgaatcccatcgaactctacatatggatcataatgcttctcgactcata

SEQ ID NO: 70798 - DNA, 407 bp, Zea mays
  unsure at all n locations
  Clone ID: LIB3078-023-Q1-K1-A2
tggacttttacgtcgttctggaacgagctggttatcgtgttgcacgtcggcgcangtgcaagtcccgtgttggcatccagcacagggtgaccaaagaagacgccatgaagtggttccaggtgaagtacgagggtgtcatcctcaacaaggcccaaaacacctcgtaatcattgatagtcatcaaacgacttgcccttaattctgtgtactatgaacaaaacaccccgtgtttggttcaagtataatctgtgtactatgaattctgtgtttgttggataccaaatgcactgccagttttgcgtctgtgcccgtaattccatcttgataatcagactagcagttaggaacaaataactgttgttttgattgtgttaatttgagctcgccagcaaaatctaaggaacatc

SEQ ID NO: 70799 - DNA, 444 bp, Zea mays
  Clone ID: LIB3078-023-Q1-K1-A3
ctacaacatgcgcaacacgatcaaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgaggacgcccctgccggcagcggcggccctggccccaagatcgaggaggtggactaagcggtttgttgtcagtcttgagtgtgctgcagttgctggctggcccagttgctgccgagagttatcgtcagttggtgcggtgtgtccgcttaaactttatttggggatggttggtacttttgtggtggttatttttttggacctcgtga

SEQ ID NO: 70800 - DNA, 429 bp, Zea mays
  unsure at all n locations
  Clone ID: LIB3078-023-Q1-K1-A5
cccacgcgtccgggaggcccccgtcgagaagacggagttcgacgtgatgatcgaagaggtgcccagcagcgcgcgtatcgccactatcaaggtggtgcgcgcgctcaccagcctcgcgctcaaggaggccaaggaccttatcgagggtctccccaagaaggtcaaggaggccgtcagcaaggacgaggccgaggacgccaagaagcagctcgaggaggtcggcgccaaggtgtctatcgcgtgacactaggtatacgaggactccttttttttttctttagtttcttttgtttgcatccccaatctcttgtatccccactatcgttcgtaaggaattgcntgttcatgatatgagatctgtgtatgtgtcgattcactagcttatatgtgtgtgatatatctctgccttgaattggcagtgaatgtgat

SEQ ID NO: 70801 - DNA, 450 bp, Zea mays
  unsure at all n locations
  Clone ID: LIB3078-023-Q1-K1-A6
agcttctggtaaactcagatactcctcaggaggttgaagccgggaaggaaatcatatttagctatgatgtaggcttcgaggagagtgatatcaagtgggcttctcgctgggacacctacttgttaatgatagatgatcaaattcactggttttctattgtgaactctctcatgatcgtactcttcttatctgggatggtggcaatgattatgctccgcaccctgtatagagatatctctaggtacaatcagcttgaaactgaagaagaaacccaagaagagacaggatggaagcttgttcatggagactgtattccgccttctgcaaactctgacttactctgtgtctgtgttgggactggtgttcagttcttcggtatgctgctagtaaccatgatncttgctgntctgggtttccttttaccatcaaaccggngaggactgatgactg

SEQ ID NO: 70802 - DNA, 440 bp, Zea mays
  Clone ID: LIB3078-023-Q1-K1-A7
cccacgcgtccggcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggctagcggcgagaagaagcaccaccacctcttcggctgaccgtagtaccggccggcgcgcgaccgagctagctagctccggcgcacacaaccacacacctggttaattctgtactgcatgcgtgtgt

SEQ ID NO: 70803 - DNA, 365 bp, Zea mays
  Clone ID: LIB3078-023-Q1-K1-A9
cccacgcgtccggggaaagagctgcaaatagaggctgaggctgatactggcacaaaccgggtgctctgtaattccaccggaggtctatccagagcccttatactagctttggttatcacagatagctgtcccatttgtcttaagcaaatgcgttagcatgatgtctactacacaccctaatatctattgtctcatcagcgtgatcattatgtagacaacctcgagaaattctttagcatctcaattagttgtgattcagattaattgtgtgacagtctgtttttgtatgcatcagacgtttatgttttgtgtttctatgtggttaattggttaccctttggaatgaaaaaaaggactacaaaact

SEQ ID NO: 70804 - DNA, 432 bp, Zea mays
  Clone ID: LIB3078-023-Q1-K1-B1
gcgaggcgatcggagcatcccgtcccaagatgagaaactccgggcggcgacgcggcggaagatggggaagacgccggtgcggatgaaggcggtggtgtacgcgctgtcgcccttgcagcagaaggtgatgccggagctgttgaaggacatcaccaccgagatccaccacaaggtcaccgagaactggatctacgacacgctcctcctcaccctcgtcgtcggcacctaccaatacgccatgtggtacaaagagcaggagaagctttcccacagatactaaatgggatgttctccaagatgctgcggcttgtcgcagttgaattttccatgatgggttgcataatctgtcaatgtcatttctttggtcagttttaggtcaacccattttcacctttacatatgcatatacgtgatctgtgcctgcaaacatat

SEQ ID NO: 70805 - DNA, 402 bp, Zea mays
  Clone ID: LIB3078-023-Q1-K1-B10
gcgggtggatttcaccactcactgtggtaagatcaggttctactgctgggagaccgcagggggagagaagtttggtggcctcagggatggatactatatccatggccagtgtgcgatcatcatgtttgatgtaacctcaaggcttacttacaagaatgttcctacatggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttactgtaccttgcaaggaagctggctggtgatccgaaccttcactctgttgaagctggagctct

SEQ ID NO: 70806 - DNA, 411 bp, Zea mays
  Clone ID: LIB3078-023-Q1-K1-B11
aacacttctcaacccaatgggcttgttgttccagatgcaagcttgcaggcagttaagtggacatctgatgtattagacttgatggagattggacaagcaaatagagcagttggttcaacagcgctaaatgaacgaagtagtcggtcacacagtattctaactgtacatgttcgagggatggatttgaagaatggatcaacctctaggggttgtttgcatcttattgatcttgctggtagtgagagggtagagaagtctgaagtatccggcgatagattaaaagaagctcaattcattaacaaatcactctatgcgttaggtgatgttatatactgctttgcacatagaagtgcccatgtgccttatagaaacagttagcttacacaagttcgtcaaagttctctatgtgga

SEQ ID NO: 70807 - DNA, 463 bp, Zea mays
  Clone ID: LIB3078-023-Q1-K1-B12
cccacgcgtccgcccacgcgtccgggcaccacacctcttcttcttcttgctcctcctccgagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaactgcacccgccattatcgatccatggtcgctcctggg

SEQ ID NO: 70808 - DNA, 417 bp, Zea mays
  Clone ID: LIB3078-023-Q1-K1-B2
gctttgcgggcatgaaaaagaagaagaagatacatgtggaacttgattcttctcttaccgagaccggagatgttgatgacacaggagacgatcaagttagagaggatgaagaaggagaagggattgtgctcgctggtgccgctgccaccagatacccttgggaaggaactgacagagattataagtatgaagagctgcttggcagagtattcaacattttgcgtgagaacaacccggatcttgctggtgatagaagaagaactgttatgaggccccctcaagtcctcagggaaggaacaaagaagacagtttttgtgaacttcatggacttgtgcaaaacaatgcataggcaaccagaacatgtgatgatgttcttgcttgctgagatgggaacaagtggatccctggatgggcaac

SEQ ID NO: 70809 - DNA, 451 bp, Zea mays
  Clone ID: LIB3078-023-Q1-K1-B3
gcttgcttctcagatttgcagacgattcttatttggacagctatatcagcacaattgggggtgatttcaaaattcgcacagtggagcaagatgggaagaccataaaacttcaaatttgggatactgctgggcaagagcgcttcaggacaatcactagcagctactaccgcggagctcatggaatcattattgtatatgacgtgacagaccaagaaagcttcaataatgtgaagcaatggttgaacgagatagaccgttatgcaagtgataatgttaacaagctccttgttgggaacaagagtgaccttactgccaacaaagttgtggcaactgagacagcaaaggcgtttgctgatgagatgggcatcccattcatggagacgagtgccaaaaacgccatcaacgtggagcaggccttcatggctatggctgcatccatcaaggataggat

SEQ ID NO: 70810 - DNA, 380 bp, Zea mays
  unsure at all n locations
  Clone ID: LIB3078-023-Q1-K1-B4
ctgcccttctcctgccgtgcggggtcctgctcctcctgcgccggcaaggtcgtttctgggtccgtcgaccagtccgaccagagcttcctaaacgacaaccaggttcgcgacggttgggtgctcacctgcgctgcgtaccccacctccgacgtcgtcatcgagacgcacaaggaggatgacctcctataattctagctagctatacaccgncagggcccgtcgtcttgtgccaccacatgcagtaccgaccgcgcacgagatgagacgtgtcgtctcaataattctagctatatatatatatatgcatgcatgcatgtacttttccctgttccaaactgagtatattctaaattacaagatttaatcacaaggtttagagc

SEQ ID NO: 70811 - DNA, 466 bp, Zea mays
  unsure at all n locations
  Clone ID: LIB3078-023-Q1-K1-A11
gctaaacgcctgtctgcaattcatgcacatgattgcacactggaacagtgggatattgggtctgctcagttgaagtgggatgatatactgaattcctcttcactagatggtgcttgtgacaagatcaaaagcttagccaaggctaaagaacttgattcatctctaattcttctcattaacagagcttgggctgctgcaaaagaatctacaactatgaatgataaggtcaaggacataatgtatcatatttatacaactacaaaagaaagcctcaagagcatctcacctccggagatgaagctgctgaagtatttgctgaatattgaagagcctgaagagagatttggtgctcttgcaactgctttctctcccggagatgggcgtgaagctaaggatgaagatgctctatacacgactcccagcgaactccacanatggatcaaaatgcttctcgactcataccatc

SEQ ID NO: 70812 - DNA, 275 bp, Zea mays
  Clone ID: LIB3078-022-Q1-K1-G8
gcgccgtgcgtaaacgttaatagccttgctttttattctaataagctccaacaaccgataggtgtctttaacatgggagctggcattctactgatacatatagacagtacttctcagacacaattcactctgacacaattctaagatagctggtcacaggataacctacaatcacaataccgcttactatccaagatctttacccccaggatatctcgttcccataacaatcccgaaaccaacttattatcgtgtggaccacattatcctcttag

SEQ ID NO: 70813 - DNA, 477 bp, Zea mays
  Clone ID: LIB3078-022-Q1-K1-G9
ggcagcttctcatcaaatcagaccctggtgaagttgttaaacctgaccaattcaaggcgagtaacgattaggggatgccaatttaccagaggcctttcatgaaggggaagctgtacatccatttcacggtggagttccccgactcgctggcaccagagcagtgcaaggctctcgagacagtacttccaccaaggccttcatccaagctgacatacatggagatagatgaatgcgaggagactactatgcatgatgtgaacaacatctaagaagagatgcgcaggaagcaagctcacgctgcccaagaggcgtacgaggaggacgactagatgccgtgcggagcccagagagtgcagtgcgcgcaacagtgagcagactatcatcaaggcaattgggaggcgtggtgcccttaaagcatgggagtgatctctggttttgctgtcgccgagcttggaaatatgaagctgaatcgacctc

SEQ ID NO: 70814 - DNA, 359 bp, Zea mays
  Clone ID: LIB3078-022-Q1-K1-H1
gctgaagtaactgcaattagagaggcttgcaaaaagcttgggaaaattgagctctcagactgcgaaatttacgcgtcctgcgagccatgcccaatgtgctttggtgcagttcatctctcccgaatcaagaggctggtttatggggccaaggcagaggctgccatcgccattggatttgatgacttcattgcagatgctctgagaggcactgggttctaccagaaggccaacttggagatcaagaaagctgacggcaatggtgcattgatcgctgagcaagtctttgaaaagactaaagagaagttccagatgtactgatgctgagcagaagagagatctcagatttgtacaatgcttac

SEQ ID NO: 70815 - DNA, 463 bp, Zea mays
  Clone ID: LIB3078-022-Q1-K1-H10
cccacgcgtccggcccgccggcgagtacgggtactccgagaccgaggtggtcaccgccagcggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggctagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatga

SEQ ID NO: 70816 - DNA, 470 bp, Zea mays
  Clone ID: LIB3078-022-Q1-K1-H11
cccacgcgttcggaccgtcggcgagtacttttactccgagacctatgtggtcaccgcctcgagcgtattcgactacgagaggtacaacatggaggataacgagtacaagcacaagcagcatctcagcgaggccgtcgccatcagacgcggctccttctcactctaccagaaacactaggcgaagaaggacccttagcacgcgcacagtcacaagatcaccgacgacgtcgctgcctctgcggccgtctgcgcctgcggctacgtattccacgagcaccactagatgaagaatgaccacaatgactccgatgaggctagctgcgagaataatcaccaccacctcttcggctgaccgtagtaccggacgtcgcgcgaccgagctagctagctttctcgcacacaaccacacacctgtttaattctgtactgcatgcgtgtgtaatttgatggttcacattaatgagtcccta

SEQ ID NO: 70817 - DNA, 422 bp, Zea mays
  Clone ID: LIB3078-022-Q1-K1-H2
ctgataacctggagaacctcaagaggcttgctgagcatttccagaagcaggtacctggggccggggccagcgccagtgcagctgcacaggatgatgacgatgtccctgagcttgtcccaggagagacatttgaggaggctgcggaggtgaaggaggtgcctgaagcggaaccggaagagaagaaagactcgtaattttgttgcgtgtcatatccattgtttgtgaagggtcgttgtgtgtttaccatacaccatgggagagacctggtcatctatgaacccctgatgttcctcattcgtttacatgtgctccagtttcagtttcttatttacctgggttttggtccaaacctgacaactcagcatttggtttggcgtcaattgtgctttatgttccaaaaaaacattactgcagtatggatt

SEQ ID NO: 70818 - DNA, 414 bp, Zea mays
  unsure at all n locations
  Clone ID: LIB3078-022-Q1-K1-H3
cccacgcgtccgcccacgcgtccggtcccgcaccacgcccgcgagcacacggtggtggccggctacgacgtccccgccggtgcgcgcgtgctggtgaacgtgtgggccatcgctcgcgaccccgcgtcatggcctgacgcgcctgacgcgttccggccggagcggttcttgaacggcagctccggcgccagcgtcgacgtgcgcggcgcgcactttgagctgctgccgttcggggccgggcggcggatgtgccccgcgcacggcctcgcgatgaagctggtgaccgctggcgtggcgaacctggtgcacgggttcgcgtggcggctgccggacggtatggcgccggaggatgtgagcatggaagagctatttgggctttccacgcgccggaaggttccgctcgtcgncgtcgcg

SEQ ID NO: 70819 - DNA, 415 bp, Zea mays
  Clone ID: LIB3078-022-Q1-K1-H4
cccacgcgtccgcggacgcgtgggctgacgctggcgtcaccgaggtctatgttcatcagccaggtgattggcaccggaatggggtgtgtcatcgggccctgcatcttctggctcttctacaaggcgttcggtgacattggcgagagcggcaccgagtacccggcgccctatgccatcgtgtaccgcaacatggccatcctcggcgtggatggcttcggctcgctcccgaaaaactgcctcaccctctgctacattttctttgcggcagcgatcactatcaaccttgtcagggacctgaccccctacaaggtgtcgaggttcatcccgctgccaatggcaatggcgattccgttctacatcgggtcctacttcgccattgacatgtttctgggcagcgcgatcctcttcgtgtggg

SEQ ID NO: 70820 - DNA, 365 bp, Zea mays
  unsure at all n locations
  Clone ID: LIB3078-022-Q1-K1-H5
cccacgcgtccgcccacgcgtccggttcaaggccggcgcgcagatcttctcggagggcgggctggactacctggggagccccaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgncgccgagctcatggtgaaggagctcaagaacggccgccttgccatgttctccatgttctgcttcttagtgcacgccatcggtcaccgcaagggccccatcgagaacctcttcg

SEQ ID NO: 70821 - DNA, 324 bp, Zea mays
  Clone ID: LIB3078-022-Q1-K1-H6
gaatacccggctggacgccacgcgtgcgcccgctcgtccgcccacgcgtgcttttctttgccggcgcgcagatcttctcggggggctgtctgatctacctgggggacggcaacctggtgcacgcacagagcatcctggccatctgggcgtgccaggtggtgctcatgggcttcatcgagggctaccgcgtcggccgcggcccgatcaaagaatggctcgacaagttgtacccctacggatccttcgacccgctgggcctcgtctactacctggacaccggcgacgagctcatcatgaatgagctcaagaacggccgccttgcca

SEQ ID NO: 70822 - DNA, 434 bp, Zea mays
  unsure at all n locations
  Clone ID: LIB3078-022-Q1-K1-H7
tctgcgaggagtacagcagcagcaccgacgccgtcaaggtcaggaaggcggcgtcctgggacctcgcccgggcgctgccccgcgcgcacggcggcaagcagtaccggtacttatctatctgtcactgtgcctatctatctgtcactgtgccctttgtttatcactgctctgctccgctctccgtctaatccgagaacatgatgcatgcttgcacgtacacacacaggcaccttgagggcgcgtcgtccctgccagcgttcgcgccgacggcgttcctgttctgatcatggcgtcggcgacggcggcgactcgtcgtcatccaccacgacgacgacggcggtgaagacaataagaaccaaccaaaaccactacacgaagcatatatacagattactgtcaacgtattgtagaaccaaggatctatngatatatat

SEQ ID NO: 70823 - DNA, 477 bp, Zea mays
  Clone ID: LIB3078-022-Q1-K1-H9
atcgctcgatcctagcttgccttccaagaatcgcagcgcccatggccatgtccacgcaagcgtcctccggcacgcgccacctgctggccgacgactgggcgcctgcggcgaagccgcggcagctgagctcgcagctcgcgctgccgtcgtcgtcctcccgcgggccggccccgctccgcgcgttcaccgatgaggcagtggaggcgcccaaggggttcgtggccccgcagctggaccccagcacgccgtacgcgatcttctgaggcagcacgggcaggctgctccgaaaggcccaagtggaggagttcatacgtcatcacgtggacgtccaccaaggagcaagggttcgagatgcccaccggcggcgccgccatcatgcgggagggcccgaacctcttgaagctggcgcgcaaggagcaatgcctggtgctcggtaccaggttgcgctacaagtacaagatcagctaccagatctac

SEQ ID NO: 70824 - DNA, 291 bp, Zea mays
  unsure at all n locations
  Clone ID: LIB3078-023-Q1-K1-A1
gcgcggcgccgtcgtacttacgctccagggcgccggagatgggcgcgtnctactacccgcgcaagtgcggttacggtcgctcttgaggagcacgatggcgacagagcggtggcgcctgctcgccagttccgaggagcctgcgatgggcaacaagatgtacgctcacggatttggggagggatcacctgcacgtaaagcggcgatcaagctgccgcacttctttaactacatcgatgtcaacagtgtcctagcacagcttgagagttacaatacggaagcgtacttggagct

SEQ ID NO: 70825 - DNA, 444 bp, Zea mays
  Clone ID: LIB3078-023-Q1-K1-A10
cccacgcgtccgtttagaaactatgacagcaaatggatttgaaattgatgttgtcacatgtggaacactcattaatggtctatgcaaggctggtaggactcaggttgctttgaagcttttaagaggcatgcgaattaaagggattagacctactccaaaagcttacaacccggtgatacagtctttgtttagactgaataatttaagagatgctcttagtcttttcagggagatgactgaggtgggtgagcctcctgatgccctcacatataagattgttttccgtggtctgtgtcgtggtggagggcctatcaaagaagcttttgatttcttggtggagatggtgaataagggtttcatgcctgagttttcatcctttcgaatgctagctgaaggtctattgaatctgggcatggatgattatcttattagtgctattgaact

SEQ ID NO: 70826 - DNA, 448 bp, Zea mays
  unsure at all n locations
  Clone ID: LIB3078-022-Q1-K1-G7
gtggtgagcgagggtgaagaaccgcgtgagtctttggaagaggtgcaaaccttgagatcgagcatggaacggaggaaagttcagtggacagatacatgtggaaaggatctttttgagataagggagtttgaaacaagcgacgagagtctgtcagatgatgacccagaaaatgaaggtttccggaaatgtgagtgtgtgattcagtagatttcttgtgtgcacaacaagcctgacaggaacatctcctcatgggaagcccatgtcctgctgagaaggatatgccgtatgttcttctgggaaggatatgccacacccagtgatttcattgcaactgggacgatcgatgacagtcaaaacatagcaaacggtgatgagtcgatattgtgctagattatntgntggttctacgcttaactagtctgctcggcagggttatagtttcgatgcc

SEQ ID NO: 70827 - DNA, 454 bp, Zea mays
  Clone ID: LIB3078-020-Q1-K1-F4
gtttgaggagaactgcctgcccctgctccctcttccgctcctccccgcgccccgctcggcatccggagacttcatttcaggccgggatggacgactacgcccgggagatgatggagctcaagacgctcgtcacccgcaccctcgagaagaagggcgtcctcgccaagattagggctgagctaagagcaagcgtgtttgaagccattgaagaggaggatcgggtggagaatgatgatggagggaaccctgctttgcttggtagctgtaatgaccgagctaagcaactgcatgcttcaccttcaggtaggttactaactgcacttgtatgcgaatacttggagtgggcgcaactaagtcacacaatgaaagtttacttgccagagtgtaaccttgccaaagacttctggaagaatgaactgaaagacttctctaacaaaagtggagctgaagggag

SEQ ID NO: 70828 - DNA, 409 bp, Zea mays
  Clone ID: LIB3078-020-Q1-K1-F5
gctgctgctcctggcctgctacgacctgacggtcacctctgtactgtaccactagactaggtgcatctagcgcctgtttccctcgccgacgacccctatccgagagcgacgagcatggcgcactccctcgccgactacttctcgccggccgccgcgcggcgccaggcgacaaatgcgatttcaagccggagctcggatgccttccatgagccacaggatgacttctgtatccatgacgtgtcaagaccaagctctgtacggatcatgatctgcatgtcaggtacgaatgagactgtcgacaaggtctgaagtatagtgaacgagcagctgactcttccagatgggactgctatcactggtgaatcagaattcgccgaacttggtgctgattcactggatactgttgaaa

SEQ ID NO: 70829 - DNA, 460 bp, Zea mays
  Clone ID: LIB3078-020-Q1-K1-F7
attaacaacactaacttagtgttatcccaggcaagccccggtgcatttgccacctccttggtgtttttaaaacttttatcacttatatgctgcattaggtgataggagttgagtgatgaaacagttgatgcattaccattccttggaatttgattatcctccttgatacctgttttacaaaaagaactaatgaggcttagccctgcctagaaaattaaaacttgttcctttttaaaagaatattatgtaacactggatatgggttttataaaaaagaaacttgcagtaatgaaggcatcactcgcgatgatgaattcattattcaagtattgtacctctgtcaggtacatggtttgggtgttaaataataagatgagaccagacgttgagcaggaaaagtcgcccgtctgtgtcgcttaaggaccgttccgattgttggcctgctgatctaggacccttt

SEQ ID NO: 70830 - DNA, 461 bp, Zea mays
  Clone ID: LIB3078-020-Q1-K1-F8
attaacaacactaacttagtgttatcccacgcaagccccggtgcatttgccaccttctgggtgtttttaaaacttttatcacttatatgctgcattaggtgatacgagttgagtgatgaaacagttgatgcattaccattccttggaatatgattatcctccttgatacctgttttacaaaaagaactaatgaggcttagccctgcctacaaaattaaaacttgttcctttttaaaagaatattatgtgacactggatatgggttctataaaaaagaaacttgcagtaatgaaggcatcactcgcgatgatgaattcattattcaagtattgtacctctgtcaggtacatggtttgggtgttaaatcataagatgagaccagacgttgagcatgaaaagtcgcccgtctgtgtcgcttaaggaccgttccgattgttggcctgctgatctaagacccttta

SEQ ID NO: 70831 - DNA, 362 bp, Zea mays
  Clone ID: LIB3078-020-Q1-K1-F9
agatcgcgagcgtccgccctttttttttttttttgacaggtgaacgagcaggcaggtttggtcgaagcaaaaggtgcagccaattcccaccatactaggaaccaggccagcgctgcccaaaaacgctcaaacaaggaaaaaaaacgagaaggaaccaaagttcttggaaaccaagtacacataactccaatacacgactaacaatgcgaattgcggtgaaacagatcgaaatgcaggcgatggttctccggcctgggcttcttcttcttcttctttccccgtactaatcgaaggacagcggaacctggcttgccaggctacggtacttcagggcgtagaacatctcgatgtagcggcgggtc

SEQ ID NO: 70832 - DNA, 362 bp, Zea mays
  Clone ID: LIB3078-020-Q1-K1-G1
cccacgcgtccggatctacctaccacggcatcatcatgaactaccctgatcagattgacggtatcggtgcactagatcaggactgccgcacctcacacatagatgtcaagccagctgaactcgttaccaagattgatctgcgatccgtcaaggagctggagaaagagcccaaatttctcaggagctgcgatgctggtatggtgaagatagttcacactaagcccatgatggtggagacctaatctcagtatactcctttagttcaatttagctgccatgacatgatgcatactgtgactggcggattcatcaagagtgtagaaaagaatgacgcaactggatccaaggtgacgaaagctgct

SEQ ID NO: 70833 - DNA, 439 bp, Zea mays
  Clone ID: LIB3078-020-Q1-K1-G10
cccacgcgtacgcggacgcgtgggctaccagcgactcagcgagcgagagcagcagacacgcagctagctaggagcagcagcagcggcggcggcgatggcggtctccatgatctcctcgtcagctctggcggtggcgcctcagggcctgccgcccctcggccgccgcgcctcctgcttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggc

SEQ ID NO: 70834 - DNA, 329 bp, Zea mays
  Clone ID: LIB3078-020-Q1-K1-G11
ctctcagcgacggcgtcagcggcttcccctcccgcctctcgctagtcgagtcgcgccctggcatccgttccttcgcacaccggcgggtgaccctgagtttcgttcttgttaactattcaagaagtaggaaatgatgagcaacttccaagccactacttgcaagcctcacagtaggatcattgtgaagaaacctatagcaagtcttggaagcacatgtcagtatccattatattcacatgctctcggattccacaagctgcaagagaaggtgtacccaaggctagttctcatttctgctagccacaaaaggcttacttctgtatgtgcct

SEQ ID NO: 70835 - DNA, 446 bp, Zea mays
  Clone ID: LIB3078-020-Q1-K1-G12
gggccattgagatcgtcatcataaagaccacaggagacatgatcttggacaaaccccttgcagacattggaggcaagggtttattcaccaaggagatagatgatgcgctcttgcagggaaggattgatatcgctgttcactctatgaaagatgttccaacatatctacctgaaggcacaatattgccctgtaacctaccacgagaagatgtcagagacgcattcatatgtttgactgcaaattcgcttgcagagcttcctgctggcagtgttattggaagtgcttctctgcggagacaatctcagattctctacagatatccatcactgaaagtagttaacttcagaggaaacgttcagacacggttaaggaaactcaaggagggagatgtctctgctacattgttggcactggctggattaaggcggctaaatatggcagaaaat

SEQ ID NO: 70836 - DNA, 462 bp, Zea mays
  Clone ID: LIB3078-020-Q1-K1-G2
caccgtccaaccaaccaccggcggcggcacaagggaagcgaagaggaatcaacgcgatgtgtgcgagcacggcggcggtgcccttctggcgggcggccgggatgacctacatcggctactccaacatctgcgctgcgctggtacggaactgcctcaaggagcccttcaagtccgaggccgcgtcccgcgagaaggtccatttctccatctccaagtggacggatggcaaacaggagaagcccactgtccgcacagaatccgatgaataaagctctggtgccatagtggcatagtccttgctacagatgatttgaagtgttggtgcaagtttccggaacatgctatttagctggcttgattttatagtcaatgctgaataataaatactttttacgacaattggctttttcgttgctaattgcactcgccctacctgaatcagtcatgtgaacatcatggaat

SEQ ID NO: 70837 - DNA, 328 bp, Zea mays
  Clone ID: LIB3078-020-Q1-K1-G3
tcacacattattacctacatcgcctacttcaacatctacactgatctgctacccaacttcctaaatgaacccttcaacatctatgctcaattccgcgataacttccatttctacatcttcaaatctacagatatcatacaagaaaaccccacttaccatacataattcgatcaataaagctctcgtgacataatggcatactcctttctacagatgaattgaaatgttgtagcacatttacccaacatgctacatagctaccattgactttatactcaatgctgaatactaaatacttcttactacaattgcctatttcgtacctaat

SEQ ID NO: 70838 - DNA, 432 bp, Zea mays
  unsure at all n locations
  Clone ID: LIB3078-020-Q1-K1-G4
gagccacgcgtacggtccagtttgtggactggtgccccactggattcaagtgtggcatcaactatcagccacggtctggtgtccctggaggtgacctggcaaaggtccagcgtgccgtgtgcatgatcagcaacaacaccgccgttgccgaggtgttctcacgcatcgaccacaagttcgaccttatgtacgccaagcgtgcattcgttcactggtatgtcggtgagggtatggaagagggtgagttctcagaagcccgtgaggacttggctgctcttgagaaggactatgaggaagtcggtgcagagggtgccgatgatgagggtgacgagggagacgactattgagtagctggctaataagtagttctctggtggttaatggttgggttattntgagtatatactctatggttccactccattggatact

SEQ ID NO: 70839 - DNA, 460 bp, Zea mays
  unsure at all n locations
  Clone ID: LIB3078-020-Q1-K1-G5
cccacgcgtccgctcagggaggtgacgccggagctgtcgtgccccgtggtgctcctctcggactacaagcccatcatgtctcgcagcttggccgagatgaaagaggcgggggtccacggtcttatagtgcctgatctcccgtacgtggccgcgcactcgctgtggagtgaagccaagaacaacaacctggagctggtgctgctgacaacaccagccataccagaagacaggatgaaggagatcaccaaggcttcagaaggcttcgtctacctggtgagcgtgaacggagtgacaggtcctcgcgcaaacgtgaacccgcgagtggagtcactcatccaggaggttaagaaggtgactaacaagcccgttgctgttggcttcggcatatccaagccagagcacgtgaagcagattgcgcagtgnggcgctgacggngtgatcatcggcagcgccatggtga

SEQ ID NO: 70840 - DNA, 324 bp, Zea mays
  Clone ID: LIB3078-020-Q1-K1-G6
tggagatcggcgtctacaccggctactccctcctcgccacggcgctcgcccttccggaggacggcacgatcttggccatggacatcaaccgcgagaactacgagctgggcctgccctgcatcgagaaggccggcgtcgcccacaagatcgacttccgcgagggtcccgcgctccccgtcctcgacgacctcatcgcggaggagaagaaccacgggtcgttcgacttcgtcttcgtggacgccgacaaggacaactacctgaactaccacgagcggctgctgaagctggtgaagctgggcgggctcatcggctacgacaacacgc

SEQ ID NO: 70841 - DNA, 370 bp, Zea mays
  unsure at all n locations
  Clone ID: LIB3078-020-Q1-K1-F11
cccacgcgtccgcccacgcgtccgcccacgcgtccgcaatggcgtccctctctccgtccgggcacctcccttgcaattcaagaactggcttccttggaaagacacatgggattcgtccttgtgttttccctgctggaagagttggatttgtcagaacagtagtggaatgcaaggaatctagaattggaaagcagcccatcgaagttccatcaaatgttactctcacattagaagagcagtttgtcaaagctaagggtccgctgggggagttatctctgagctttccaggtgactngaagatcgtgaaagaagaatccggttacctgagagcttataagactgcagagaccaagacggcgaaccagatgca

SEQ ID NO: 70842 - DNA, 438 bp, Zea mays
  Clone ID: LIB3078-020-Q1-K1-D9
cccacgcgtccggtttcaactaatcagcttactaggatgaagcctgcaacggtgggactgctcattttgttgaacatgatgtgcatagttgcatactttgatcatggaacgatggctgaagaaaccaccttgctggcaaattcgtatggaagaaatgaaggaaccaagggcatacatcatggaagaaagctgatggacaatagtattggttcaaaccgtgagtattcaatcgatgatatgtctcatccaaaggcaccacatactgagctcaagcaaccctcatacttagctcctggttgctcaagcaaccctctcaagcaaccctcaaacttagctcctggttgcattccctaaagttcatgcatacatatatagccttccactcatcatatgctggtatccgatctatatatagacacatatgatatgttgcatatc

SEQ ID NO: 70843 - DNA, 403 bp, Zea mays
  Clone ID: LIB3078-020-Q1-K1-E10
caatcactgctaccagcaattgtagaacttgcagaggataggcactggatagtccggctggcaataattgagtacatcccattgttggcgagtcaattaggtgttgggtttttcgatgacaagctgggggcgctctgcatgcaatggttggaagacaaggtcttttcaatcagagatgctgccgttaacaacttgaagcgccttgcagaagagtttggtccagagtgggcaatgcagcatataatccctcaggtgctggagaagatcatcaacccacactatttataccgcatgacgattctgcaggcaatctccttgctagctcctgtcatgggtgcagagatcacctgtcaaaagctgcttccagtcgtcattaattcttcgaaggacagggttcccaaca

SEQ ID NO: 70844 - DNA, 311 bp, Zea mays
  Clone ID: LIB3078-020-Q1-K1-E11
cccacgcttccggaccttgtttgttctggatcagtggtcactatttacatggcttgagtggtatcagtttaatcaatcaataagttgtgtcaacttgggacattgttgaaccatgtgcattgaaatttgggtggaactaaacagtctatactccaaaatgtgagggccttggaaaccaagaggatgcactatatattttcaatgaacactatattgtttctgtttcattttatttcaaaacatggtatgtactccctgacttcacttgagaagcgagaattgtatacttgttttgatggtggtatggtgag

SEQ ID NO: 70845 - DNA, 424 bp, Zea mays
  Clone ID: LIB3078-020-Q1-K1-E12
aacaccttaaaagtggttggcacatatggttacatgtctccggagtacgcaatggatgggatcttctctgtcaagtcggacgtgttcagctatggagtactattgctggagatcgttagtggcaggaggaacaggggagtgtattccagttcaaacaaccaaagccttctaggccatgcatggagcttgtggaacgaggagaagagcatagagctagcagatgagagaatgaacggacaattcaactcagacgaagtgcagaagtgcgtcagggttgggctactgtgcgtgcaagagaatccagacgaccgtccgctgatgtctcatgtgcttctgatgttagctagtcctgatgccgcatcactgccgactcctaagcaacctggcttcgcagctaggagagttctaatggaaacagacacat

SEQ ID NO: 70846 - DNA, 335 bp, Zea mays
  unsure at all n locations
  Clone ID: LIB3078-020-Q1-K1-E2
gcagcagctgtgtgttccgcaagggcagtcgtcgtggatcatcaaatcacatggagaggggactccagtttacagggatattgagtaacatacctgaagagaatcccgatttctacaactggaatagagtgaaggtccggtactgtgatggtggatctttcactggtgatggctctgatgcggctgcaggcctttatttccgaggtcagcgcatttggcaagccgctatggatgacctaatggcccaaggaatgcgttatgctaatcaggcccttctttctggatgctctgccngtggtgtttctaccatacttcactgtgatgaattccatgga

SEQ ID NO: 70847 - DNA, 420 bp, Zea mays
  unsure at all n locations
  Clone ID: LIB3078-020-Q1-K1-E3
tcggcaatcactgcgaacacaagctgtcgatctcaccgacaccgtcgaagaacagatcaatggcgttcgagcatgcagtcatgatcgcgtgccacagcaaggctgattttgacgcctacatgaccaatgcccaggaagcccgctagctggaggtcattgacttcactggcgactggtgcggtgcatgccgcgccatcgacccactgatgcgagaacactccaagaagttcactcaagtagcgttcctgaaagtggacgcggactacttgtaagaagttaccgtgtgctaccaggtccaggcgatgccgtactancacttactgaagaacagcacgacggtcgcgaccatcgtggttgccaggaaggacgagctcctggcccagatctgagagcatgcactgcctgcgcctgcgtctgcgt

SEQ ID NO: 70848 - DNA, 405 bp, Zea mays
  Clone ID: LIB3078-020-Q1-K1-E4
ctggatcgggagacgcacaggtcccgcggcttcggcttcgtcaccttctccacggaggaggcgatgcggaacgccgtcgagggcatgaacggcaaggagctggacggccgcaacatcaccgtcgacgaggcccagtcccgcggcggccgtggaggcggctgcggtgggtacgagtggaggccgcggaggcggcggctacggcggtggcgggcgccgcgatggcggtggcagctacagcggtggcgtcggctactgtggctgcagcggctaccgtggtggtggcagcggctaccgcggtggcaaccggggcagcggatacgggaactccgacgggaactggacgaactgagcggtggggcccgcgcggtcaagttatcctgttcgctaccgtgatgtataccctag

SEQ ID NO: 70849 - DNA, 407 bp, Zea mays
  Clone ID: LIB3078-020-Q1-K1-E5
cccacgcgtccgtccgcctgctcaaggcctacggcgagatccccgacaacgtcaggctcaacgagggcgtcgttgatgaggaggaagccggcgcgcaggatgactatatacagttcgaggacgaggacatcgacaagatctgatgatcgcctcttccacacggtccctttccatggtaaactaaacgtatgcaaaacaattgtatccttctgttttgtggtggctaccatgactgaagaatggtagtcgtggtgatggtataatgatttgggcggagagtactgtgtataatgatttgggggcacttgttgtgcccaataaccccatatggtgatatagcaagtatgggacttgacgaacccgttcctttcctttctggtaatatgatatatttggttgggcatgat

SEQ ID NO: 70850 - DNA, 447 bp, Zea mays
  Clone ID: LIB3078-020-Q1-K1-E6
cccacgcgtccggttgacagaaagccggctggagcaactgaacaacaggcgttgggatatgtctagccttcaggaagctatctctgtgccttggaatagtatacctatgaacacggcgaggtcatactctgctatgagagttctggaggatcatgaattatctgaaggtcgcaatcctggctaaacagcactttctgatatagatgcagttctggctcggaggatggatatgcgtgataaaatgtctttgaatgagtctcgtatgactactactctcgaggaacgactgctatgatctggaaagactgagcatgctcctgtatgtgctatcctgggtggcattgttggtcacgaggcgatcaaatcgatatcctgcaagggcgatccatgtatgaatttgttctatatcgatgtggctgacggtaaaagtgtgatcgacgatatacc

SEQ ID NO: 70851 - DNA, 458 bp, Zea mays
  unsure at all n locations
  Clone ID: LIB3078-020-Q1-K1-E7
cttatatcgatgcaggcatcaaatgtagtggctttgccatatcaagtcccaggtcaagtttctggacctcctgtcttaactaatgcaccaaattttcacccggtatgtactgtgcagttgaggccgcccacaaatggtggactagctgtccagacaatgggtagtgcctctcaagttgcttttggttacccagcagtccagctaccaacacttgaaacgggctcttcatgggcatttggtgctccacctcaggctctgtcttcttttactgcaaaagacaaagctgatcaaacaggaaccaagcaagttgacgatggcaagaagccccaggaggcaggtgcttcctcgtctgctcatgctgaagatgagaaaaaggctgatagaggactctctcttatgggttctgccataaggccaggcatcgcaccaaatgtcanatttggagggtctggatcata

SEQ ID NO: 70852 - DNA, 409 bp, Zea mays
  Clone ID: LIB3078-020-Q1-K1-E8
gtctgaaggccagagctttaacccaccgagcttggctattatcttgcagctcggatttgcgaccgatgatggtccggaccactgacctggctgtggttgagcagaatgaatcgaagcttgcgaaggtgctcgatgtgtatgaccaactgctgggggagagccagtattttgctggtgatgatttcttcctggacgaccttgtgcacttgcccaatgcagatttccttgtgaacagaaccagcaaggctggcttgatcaccgagagaaagaatcttgctcgatggtgggatgatgtctagtaccgacctgcatggtaaaaggtcactgagatgcacagcacgctcatgccctgttagagctgaatattgggtttctgtgagcagatgacgatggcaaataggtgcattct

SEQ ID NO: 70853 - DNA, 377 bp, Zea mays
  Clone ID: LIB3078-020-Q1-K1-E9
acggcagggttttggagcggctcgatggaggcggcgagcaacggtgggctgctgtaccacgaggtgcaagaggggaagctatgcgccgtgcactgcgtcaacaccactctgcagggccccttcttcttcgagttcgacctcgcctcgctcgccgccgacctcgaccagctggagcgcctggtgatgctcgagggctccctaagcccctgcgcggacaacgctaccgtaggggacttcttcgacgagggcgaggggtcccacaacgtctccctcggcagagatttcagcatccaggttttgcagaacgctctggatgtttgggacctgcaggttatcctccttgattccgcagctgcatggtcgtcccaatttgaccc

SEQ ID NO: 70854 - DNA, 451 bp, Zea mays
  Clone ID: LIB3078-020-Q1-K1-F1
cgcttctctacgggctcggcgtctccgtgtacgcgttcgagggcatcggcatggtgctggcgctggaggcggaggcggcgaacaagagcaagttcggcgtcacgctcgggctgtccatggcgttcatcgccgtcatgtacgggctgttcggcgtcatgggctacgtcgcgttcggcgacgccacgcgggacatcatcaccaccaacctcggagccgggtggctgtcggccgccgtgcagctggggctctgcatcaacctcttcttcacgatgccggtgatgatgaaccccgtgtacgaagtcggccagcgcctgctccacggcaagccgtactgctggtggcttacgtggctgctggtcgtcgtcgtcggactcgccgacatgtacgtgcccaacttcacggacttgctggcgctcgtcgagagcagtgtctgcgtcctcctcgggttcgt

SEQ ID NO: 70855 - DNA, 367 bp, Zea mays
  unsure at all n locations
  Clone ID: LIB3078-020-Q1-K1-F10
ggagtacgccgcggtggagccgcccgaggaggcaaaggtctacgttgggaacctgcccgacgacatcgaaagcgagggactcgcgcagctcttcgaccaggccggcgtcgtcgaggtcgccgaggttatttacaacatagagactgtccagagccgtgggtttggctatgttaccatgagcactattgaggaagctgataaagccattgagatgttcaaccgctatgacattagtgagaggcttctgaatgtaaacagggcatctnctaagggcactcgcatggaaaggccttcgagacaatttgcgcctgctttcagagcttatgtnggcaacttgccatggcaagctgatgactctaggctggtg

SEQ ID NO: 70856 - DNA, 453 bp, Zea mays
  Clone ID: LIB3078-020-Q1-K1-D8
caaccatctaccagcgactcagcgagcgagagcagcacacacgcagctagctaggagcagcagcagcggcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccc

SEQ ID NO: 70857 - DNA, 409 bp, Zea mays
  Clone ID: LIB3078-020-Q1-K1-C4
cccacgcgtccggagggctaccgcatcgccggcggcccgctcggcgaggtcgtcgacccgctctagcccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgagggaggcgccgccggtgacctttaggtgtccggatgcatgtgagcgcacgctggttttcggtttgtaccatgatgtaaactattgttcaatcgacaaggaataattgtgttc

SEQ ID NO: 70858 - DNA, 336 bp, Zea mays
  Clone ID: LIB3078-020-Q1-K1-C5
agacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacgg

SEQ ID NO: 70859 - DNA, 354 bp, Zea mays
  Clone ID: LIB3078-020-Q1-K1-C6
cccacgcgtccggccggcgtgacgggcgccaaggtgacggacatccgcgccgtggacttggcggaggcgcgcagggtgctcgacgtcaacgtgcacggcgtgttcctggggatgaagcacgcggcgcgcgctatgatcccgcggaagctgggctccatcgtgtcgctggccagcgtggccagcgccatcggcgggacgggcccgcacgtctacacggcgtccaagcacgccgtggtcgggctcaccaagagcgtcgccgcggagctcggtcgccacggggtgcgcgtcaactgcgtgtcccgctatgccgtgcccacggcgctgtcgatgccggacctgccccaaggcgcgcgc

SEQ ID NO: 70860 - DNA, 379 bp, Zea mays
  Clone ID: LIB3078-020-Q1-K1-C7
cccactcgtccggccggcgtgacgggcgccaaggtgacggacatccgctccgtggacttggcggaggcgcgcagggtgctcgacgtcaacgtgcacggcgtgttcctggggatgaagcacgcggcgcgcgctatgatcccgcggaagcgtggctccatcgtgtcgctggccagcgtggccagcgccatcggcgggacgggcccgcacgtctacacggcgtccaagcacgccgtggtcgggctcaccaagagcgttgccgcggagctcggtcgccacggggtgcgcgtcaactgcgtgtcccgctatgccgtgcccacagcgctgtcgatgccgtacctgccccaatgcgcgcgcgcaaatgacgcgcttaaggactttc

SEQ ID NO: 70861 - DNA, 458 bp, Zea mays
  Clone ID: LIB3078-020-Q1-K1-C8
cccacgcgtccgcccacgcgtccgcggacgcgtgggacgccatcgagcgcttgacgagcgggttccagcagttcaaggtcaatgtctatgacaagaagccggagcttttcgggcctctcaagtccggccaggcccccaagtacatggtgttcgcttgctccgactcccgtgtgtgcccatcggtgaccctgggcctgcagcccggcgaggccttcaccgttcgcaacatagccgccatggtcccaggctacgacaagaccaagtacaccggcatcgggtccgccatcgagtacgctgtgtgcgctctcaaggtggaggtcctcgtggtcattggccatagctgctgcggtggcatcagggcgctcctctcactccaggacggcgcacctgacaccttccacttcgtcgaggactgggttaagatcggcttcattgccaagatgaaggtaaagaaagag

SEQ ID NO: 70862 - DNA, 273 bp, Zea mays
  Clone ID: LIB3078-020-Q1-K1-C9
cccacgcgtccgcccacgcgtccgttctcttccttcctcttcctctgcaagaagcgaaggacaatttagaagcgcccttcctcctctcccccatccgtacccaatctaatcgacacccggccgagatgggccgcaagttcttcgttggtggcaactggaaatgcaatggaaccacagatcaggttgagaagattgtcaaaaccctgaatgaaggaaatgttccctcttaaaatgtggttgaggccgtggccagtcctcctaaggggtccctcc

SEQ ID NO: 70863 - DNA, 309 bp, Zea mays
  Clone ID: LIB3078-020-Q1-K1-D1
aagggtgagcccgtccaagacgcccgtgcgtccccgcgcccctcgccagctgatgttgtggtaggtgtacatacaggaggtgctgacgatgccactgctcatatataagtaatagagatagacatgtatgaaaagggtcttttgtttttaagttgtgggctcggccttttttttctctctccttgattcaccgttggtcgaggctgttctttttttttaccttccacatagaggagagcttcttactaagaaggaagaatgaagaaggaagcgcgtggtttttttttttttttttaccttgatgctttt

SEQ ID NO: 70864 - DNA, 428 bp, Zea mays
  Clone ID: LIB3078-020-Q1-K1-D10
cccactcttccggcttcaactaacaacgttactaagatcaaccctgacacgatggcacgggtcatttacttgcacatcatgcgcatagttccctactctgatcatgtaccaatggctgatgaaaccaccttgctggctaattcgtatggaaaacatgaactaactcaacgaatacatcatccaagaacacttatggacaatagtattcgttcataccgagagcactaaatccatcatctgtctcacgcaaaagctccacatactcagctcaagcaacccttatacttacttcatactcgctgaagacaccatctcaaaccaccttcaaacttacctcctgaatgcaatccataacgttcatgcatacctatatcgccttccactcatcatacactggtatcctatctatatacagacacatatgatat

SEQ ID NO: 70865 - DNA, 436 bp, Zea mays
  unsure at all n locations
  Clone ID: LIB3078-020-Q1-K1-D11
ggtacccacatttcctttgaccccccaccgtataatatatcttggaggtaaaagagactgggcttcagatgttccttggtgatctagttgtgcgctttcgatctggtattgctcagatagtcagatgtttctccgctgtaggctggttcaagatcaagccatctaaggaggaggtggcctgttcatattgtgaaacatcatgatgcttattttgggcatcttaagctatcttctctggcacatcaatgatttcatgagcttcaaggcccctttattttaaaagttgattctttgcataatcctctctgtgggtgcctacaaagtttaaatgtggacatggctgtcactactcactagtctcattgaagcatcatggtgcanatcctgcttcaaggtctgctattgatagcttanagatggctgtgatgtcaacgcc

SEQ ID NO: 70866 - DNA, 381 bp, Zea mays
  Clone ID: LIB3078-020-Q1-K1-D12
gcggcgagttcaaatcccacaatcttcttgtagcacaccactgtcttcgtccaactcgggggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgccgcaagaccgtcaccgccatggatgttgtgtacgccctcaagcgccagggccgaactctgtacgggttcggtggttgagcgca

SEQ ID NO: 70867 - DNA, 380 bp, Zea mays
  Clone ID: LIB3078-020-Q1-K1-D2
tcgcccacgcgtccgagacgctggagacgagcatcggtttcagccaggagcggctcacgtcggacctggcgctgttccacgagatcgaccccaaggaccccatgaaagccttcggagcttatcttgggccgcacggttggatcagccacgtctgctgcatttgagttcgtcgtcagtatgcatgagggctgctgaggccattacaggaacagtgagctttaataagcggtgttttcagtaccgtttggttgtcagcgcaacacgtgttgttggaacactgtggttccatatatataccatatatgtatctaagattcatcattatccatttaaatgtagacataaaaatcaataactacagtgaccaatatttgggacgg

SEQ ID NO: 70868 - DNA, 445 bp, Zea mays
  Clone ID: LIB3078-020-Q1-K1-D3
gccaggaccgcggcgccctcgtcgagttctacgcgccatggtgtggccactgcaaaaagcttgcccccgagtatgaaaaacttggcgccagcttcaagaaggctaaatctgtactgatagcaaaggttgactgtgatgagcacaagagtgtatgcagcaagtatggagtttctgggtaccccacaattcaatggtttcccaaaggttccctggagccaaagaagtatgagggtcaacgttctgtggaagcccttgcagaatttgttaacagcgaagcaggtaccaatgtcaagatagctgccattccttcaagcgtcgtggttctgacttcagagacctttgactcaattgtccttgatgaaaccaaagatgtccttgttgagttttatgccccatggtgtggtcactgcaagcatcttgctccgatttatgagaagctggcttc

SEQ ID NO: 70869 - DNA, 452 bp, Zea mays
  Clone ID: LIB3078-020-Q1-K1-D4
gcgagggcgaaacccacataccctctccctcccgtactccggcctacacatgcaggggcgatgacgctgggtagctccggcgccggatcgagcgtcgtcgttccccgaaacttcaggctattagaggagctcgagcgtggagagaagggcattggtgatggaacagtgagctatggaatggatgatgccgatgacatctacatgcggtcatggactggtaccatcattggccctcacaatactgtacatgagggtcgcatctaccagctgaagttgttttgtgacaaggactatccggagaagccaccatctgtcagattccactcaagaatcaacatgacatgcgttaatcacgagacaagaatggttgatccaaggaagtttggattgctagcgaactggcagcgggactacacgatggagaacatactcaaccagctcaagaaagagat

SEQ ID NO: 70870 - DNA, 196 bp, Zea mays
  Clone ID: LIB3078-020-Q1-K1-D5
gttctagatcgcgagcggcggccctttttttttttttttttcctgaaagaaacgattatatatgtctttcatcatatataatgaatggtcctcgattgaatggccaacaagcaaaccaatccaatggacctcggaataattactaccatggcatggaaaactattaacaacaaaatggttgaacctgaccattcca

SEQ ID NO: 70871 - DNA, 456 bp, Zea mays
  unsure at all n locations
  Clone ID: LIB3078-020-Q1-K1-D7
cggacgcgtgggctcggcgcgctcgggtgcgtgttcccggagctgctcgcccgcaacggcgtcaagttcggcgaggcggtgtggttcaaggcgggctcccagatcttcagcgagggcgggctggactacctcggcaacccgagcctggtccacgcgcagagcatcctggccatctgggcgtgccaggtggtgctcatgggcgccgtcgaggggtaccgcgtcgccggcggcccgctcggggaggtggtcgacccgctgtaccctggcggcagcttcgacccgctcgggctcgccgacgacccggaggcgttcgccgagctcaaggtgaaggagatcaagaacggccgtctcgccatgttctccatgttcggcttcttcgtgcaggctatcgtcaccggcaagggcccnctcgagaacctcgccgaccacatcgncgaccccgtcaacaacaacgcc

SEQ ID NO: 70872 - DNA, 404 bp, Zea mays
  Clone ID: LIB3078-020-Q1-K1-C3
cagcattattgatacggcaatcaaggacttctacaacaagagcatggataccatggtagaggctctgaagatgaatcttaccgatggatggtctgacgacatcgtccactgggaaaattgcaagaacaaacacgcgacctgcgcgaacgactacgcaattgagagcatccattattcctgcaactacgcctacaaagatgtggagcaagacatcactctaggagatgattattttttcagtaggtacccgattgtggagaagaggttagcgcatgctggaatcagattggcgttggtacttaatcggatatttggtggaggtgaagcggatgatataccactaaaagtacagtaacagctgtaataaaaggaagcatagctattacaaggatttgtccattacg

SEQ ID NO: 70873 - DNA, 320 bp, Zea mays
  Clone ID: LIB3078-057-Q1-K1-G12
gacgagcgatcgatacagccgtgccaacatatcacctgcgacgccgcgaccgggatgggcgtcaattgcaagcctatacatatcgacctctgggtcaacctatagacggagggtatgcttaaacatcaatgtaagctcctaacgcaagctagatcacacagagtaagagggacgactgagacgccttccaacaatgctgaagtacgcagcttatgaaatcacgatgcactgctagaccattgacatcatcatgatcgatagtcacatgatacatccttactgaaaggtacgccacctactaatcagacatctgacgacta

SEQ ID NO: 70874 - DNA, 203 bp, Zea mays
  unsure at all n locations
  Clone ID: LIB3078-057-Q1-K1-G2
cggacgcgtgggccgcagcccataccgtcgcagagaacgacgtggtcacagggattttgcatgcaagaactgccggagacctgngcacttcgctaaggagtgtccatctgcacctatgtgcaataactgtaaccttccaggccactttgcagcagaatgcaccttacanactgtttgctggaactgcaaagagtctgggcaca

SEQ ID NO: 70875 - DNA, 455 bp, Zea mays
  Clone ID: LIB3078-057-Q1-K1-G3
acaaattacccagatctcaagccgccatcaacccctacgccaccgtcagtggagtctgaagtcgagacgaaggctagcagcaccgtgactgaaggaccagcagtggtcaattctgcacctatagcagacgctgccacgggatcatctcctgccactactaggcccagacctcagtcaccataccctaattatccagatttcaagccaccatcctcgccttcaccgtcagcaccttaatttggcaagagtacaagaaaccgggtctagaggatattaaagaagttgagttgttcatatggagccggcatctcactagaggtgtatgttgtactatgagcgtgacagtgtggctaagtcactgtggcgagttttctgcagcagtaaatatatgatgtaatggtcattagttatcaatgtgctatgattttctttttggtgtcttattttcgatacat

SEQ ID NO: 70876 - DNA, 202 bp, Zea mays
  Clone ID: LIB3078-057-Q1-K1-G4
gttaaattggaatacaagaggaggcaagtcaaatatggtttgtgtgacagcacgttactaacttactctactatatctgcatgagaaaggatgaaccctgtttgcatgtatactaattaatctacggattcattaatgtgtgaataagattttatttaattatgacagcaaacgtgacatgccattacaatttcgtttatgc

SEQ ID NO: 70877 - DNA, 343 bp, Zea mays
  Clone ID: LIB3078-057-Q1-K1-G5
gccttgcagatgagttgatcaacgctgccaagggctcttccaacagctacgccatcaagaagaaggacgagattgagcgtgttgccaaggccaaccgttgagtggagcttgtatcctggtgcacttgcactagaactacgtttctggcagtcgtatttttttcttgtgtttttacccatgtttagactttgagacctatatctaaggttttggttctcagtgaacaatgaaaattactgtgaaatgcagttgttttggtgcagaaatgcgcactgagatattctgcttgtgaatttgtgagtgcttgtggcgtcgccgctggcttgccgatgtaatatttctt

SEQ ID NO: 70878 - DNA, 304 bp, Zea mays
  unsure at all n locations
  Clone ID: LIB3078-057-Q1-K1-G6
ggacgaccgagtggtctcgccggcagtggccgaatttgtgcggcgggtggttccaggagccacggtccacaagcttcttgacgaaggtcacttctcatacttctgcttctgcgacgagtgccacaggcagatattctccaccctcttcggcattccccagggccctatcaaccctgcaccgncgcagccaggcgaggtggtttcagagctcaccgaggaaacaacagtgccagacaatgccacagatgaggaacaaggaaaatcaggcctgccctgattcaagatcggtttcaggacccacaag

SEQ ID NO: 70879 - DNA, 257 bp, Zea mays
  Clone ID: LIB3078-057-Q1-K1-G7
cccacgcgtccgcccacgcgtccgtagctatcttgtcttggggactttgcatattagcagctcttttggacaggatcaagtaaatgctgatgatgtagttgctggatgtcttctttccacttgttacttgtgaccgaacgttctacaggccgacatgaaaatacgaggtacatgatgggctgtgaagcttcaaccgagcctcggcgggttctctttgctttgtgatccactgatgacagtgtcggtttcatcatcat

SEQ ID NO: 70880 - DNA, 159 bp, Zea mays
  Clone ID: LIB3078-057-Q1-K1-G8
gaccgtgcactggtactacgactggcaagaggacctggaggcgtctgcgagggaggagctgctgcgggaggagctgctcgaggagattgagcagagggttgggggcctaagggagctggaggaagcgagcaaggaggagcagctcacaaagtgatcacg

SEQ ID NO: 70881 - DNA, 344 bp, Zea mays
  unsure at all n locations
  Clone ID: LIB3078-057-Q1-K1-G9
accactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggngcggttcgggctggcgccgtcggcgaaccgcanggcgacggcggggctgaagctggaggcccgcgact

SEQ ID NO: 70882 - DNA, 312 bp, Zea mays
  unsure at all n locations
  Clone ID: LIB3078-057-Q1-K1-H1
ncgcgacccctgggtttcaagatgaatggttttagggtttgggctggggaagtaccgaacaggaaattttgaaaaggaatggcaagagaaaacatggggcatgggcctttggattgggattggaaccgtttgcgatggtccttttcgacattccagatattcgactattctggtcgaatgataaacggttcacgttccagttctcagaaggcaagcttggtgtcaagttcaagccattttcaaagtttccttcttggtaccaagatatgagtttctggatcaatggtgcatttacagaaaacaacttatgtg

SEQ ID NO: 70883 - DNA, 337 bp, Zea mays
  Clone ID: LIB3078-057-Q1-K1-H10
cccacgcgtccgcccacgcgtccgcccacgcgtccgcggacgcgtgggtcaaagccgtggaggagctcaaacttgcaagggacatttatgagcatgctgttgttttgagtgtgaaacttgaggaccaagatgcatttgaacgtgatttctgtcagctaaagccttattacatggatacatgtggcataattcccccctcaccagaggagtacccaattttgggactcaatcttctgaggctgttggttcagaatagaattgctgagttccatactgagctggagcttttacctgtcaaggcacttgagcacccttgcatcaagcatgctgtaaagct

SEQ ID NO: 70884 - DNA, 339 bp, Zea mays
  Clone ID: LIB3078-057-Q1-K1-H11
gtttactgtgaaagatggctacttttgtcctgccctggccaaagctgtcaaaagggtgaggaaggctgagaaggtgctccttacagtaaagccacaatatggatttggtgagaagggtagaccagcagctggagaggaaggtgctgtgccgccaaatgcttcactgctcattgaccttgagttgatttcatggaagactgtcacagaaattggggatgataagaaaatccttaagaaggttctcaaggagggagaaggttatgagcgtcccaacgagggtgctgttgttgaagtcaaaattatcggaaagcttcaggatggcgcggtgtttacaagaag

SEQ ID NO: 70885 - DNA, 244 bp, Zea mays
  unsure at all n locations
  Clone ID: LIB3078-057-Q1-K1-H2
gacgcgccctggtggcccaagatgcagaccgtggccgagctggtcaaggcctgcaccaccatcatctggatcgcgtcggcgctccacgcggccgtcaacttcgggcagtacccgtacgccgggtacctcccgaaccgnccgtccgtcagccggaagccgatgccgacgccggccagcgacaagtccccgaagctgaaccgcaggccgaagaaggtgttcttgcgcaccataaccagccagttcc

SEQ ID NO: 70886 - DNA, 457 bp, Zea mays
  unsure at all n locations
  Clone ID: LIB3078-057-Q1-K1-H3
gtttggcacgctgaaatggttctgattctacctggaaaccgccggatccatgccaaaagcattgttcctgattcattttgagtgtggaacggctagaaacggttagctcgttttgcctaccaaagagaaacacccaaaacccagtttagctggagaatcactacctnccccgaactcaccttgaatntacctgtattttccactgacatcaccacaagacccatctnctctggtcgcccctaagcacctgttttgattgtggngaccctagggagggggcaacggatgctcgattntgcttgattctagtctaggtagctcctgtggctgtatccatgggagagaccaatgtttgtgtgaggatgaagaagacaagaagatactaggtacgacttgggccaaaaagaaaagataaagggttgtgtccagtaaaaaagaagaagctgatgagcccgtc

SEQ ID NO: 70887 - DNA, 104 bp, Zea mays
  Clone ID: LIB3078-057-Q1-K1-H4
attcggtcgaccacgcgtcgccacgctcgggacgcgggcgccggcccggacagctcacgcgctgcgaaacatcgcggagcggcgtgctcagcgacctgataaga

SEQ ID NO: 70888 - DNA, 149 bp, Zea mays
  Clone ID: LIB3078-057-Q1-K1-H6
gatgaggatgcaggaggtccaaacactccagcagaagcagatgctgatgaaatcattaggtctagcattccatatggtagtccagtccaggagtctgaatctgatagagaagaggaagatttatagcacggacgaagagagctaggaca

SEQ ID NO: 70889 - DNA, 433 bp, Zea mays
  Clone ID: LIB3078-057-Q1-K1-G11
gcggaacacaacaccgcaccacactacccagcggaatccgcccacccgcacccggagcagaggagatatgtcgcaggggaagggaggagcgtcgaggaaggaggaggtggtcaccagggagtacaccatcaacctccacaagcgcctccacggctgcacattcaagaagaaggcacccaacgccatcaaggagatcaggaagtttgcgcagaaggccatgggcaccacggacattaggattgatgtgaagctcaacaagcacatctggagcagcgggatcaggagcgtgccgcggagggttcgtgtgaggatcgcccgcaagaggaacgacgaggaggatgccaaggaggagctctactcccttgtcaccgtcgcggagatccccgccgagggcttgaaagggctggggaccaaggtcgttgacgataccgat

SEQ ID NO: 70890 - DNA, 437 bp, Zea mays
  unsure at all n locations
  Clone ID: LIB3078-057-Q1-K1-H7
cggacgcgtgggcggacgcgtggggccgaggttgcgtgcgtgattgggatggcggagccggggctcgaggacagccagccggtggatctgtccaagcacccctccggcatcgtccccacgctccagaatattgtatcaacagttaatttggattgtaaacttgacctcaaagcaatagctttgcaagcaagaaatgcggagtataacccaaagcgttatgctgcagtaatcatgagaataagagaacccaaaaccacggcactgatatttgcatcgggtaaaatggtatgtactggagctaagagcgagcagcaatctaagcttgcagcatgaaagtatgctcgtattattcagaaacttggttttccagctaaattcaaggactntaagattcagaatattggtggctcttgtgatgtaaagtttccaattaggct

SEQ ID NO: 70891 - DNA, 278 bp, Zea mays
  Clone ID: LIB3078-057-Q1-K1-H8
ctagaatgcacaaaattaaacttagattgctgcaatgaagaaaaacagaagattgaagtctgtctggaagagtgcagtgaggaacgcaacagaataagggtggaacttgacctgattaagaagttattggagaatatggcattaactgacaataacacatcacatgatagttctgaatcatgcacccttggaacaacgtgaattaggcattgtcttgaaaatggtaaggcggaccctgaataaaaggttccaccaattccaccaaaattggattaagg

SEQ ID NO: 70892 - DNA, 361 bp, Zea mays
  Clone ID: LIB3078-057-Q1-K1-H9
gccgctcaccgctctctaaacgacggcgcgccccagccatccgctcggcggccacggacgagcagcttcagctccggcgagacgccgtccaagaagaccacccggaaggagaagcaacaggagcggcggcggcagcaggacgtgcaggaacggcagcagcagctcctggggatggaagaagcgtccctggcgaagcaagacggcggcggcagcggcagcaacagcaacggcgaggttgacgacgacgacgagcttccgcagcccgtgttcgaccgcatcctgcgccggatcgcgttcacggtgggccttcccatggcgtcgggcgtcgcgctgctcaacgtgtacgacgcgctcaagcgcg

SEQ ID NO: 70893 - DNA, 254 bp, Zea mays
  unsure at all n locations
  Clone ID: LIB3078-057-Q1-K1-E2
tcgcgcgagggccgcccttttttttttttttttaaataaaaggtatcttattatatatgatgcagtgctgcttacaagaagcagatggtacattactacatttcaaacttcattgcaaagtagaatatatatggacataagatcacatggatgttgctccacactttttagcacacacagatatacaacgcanatacacattgattgccttttctggaggcaattcaccacacgtgcgttcctttagttacccc

SEQ ID NO: 70894 - DNA, 242 bp, Zea mays
  Clone ID: LIB3078-057-Q1-K1-E4
cgtttcgccgcccctagcccaaatcccccacctactcgccgccggcgccgtctcagcctgatccttctccgctagccatggccgccgcgggtcccgggctctactccgagatcgggaagaaggccagagatctcctatataaggactaccacacggaccagaagttcacgctcaccacctacgccgccaacggagctgccattactgctgcaagcacgaggaaagatgaagctatctttaat

SEQ ID NO: 70895 - DNA, 188 bp, Zea mays
  Clone ID: LIB3078-057-Q1-K1-E6
ggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgc

SEQ ID NO: 70896 - DNA, 245 bp, Zea mays
  Clone ID: LIB3078-057-Q1-K1-E7
gcggcacagaggtgcgacgtacgacgactacgacgcaggcgccacacatggcatcccaggtctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccggcaccaaccttgatcatggtgacgacgacgacgctgatgcctgtcgc

SEQ ID NO: 70897 - DNA, 357 bp, Zea mays
  Clone ID: LIB3078-057-Q1-K1-E8
ggaatatccccaggaccgttacaaacgacgagctccgcgacatgttcgctgcgcacggcgccgtcgagcgggccgaggttatgtacgacaagtatacgaatcgcagccggcggtttgggtttgtcacgatgagcacagcggaagaggccaatgctgcagttgaggctctcaatggaactgaggttgtggatggaaaatttaaggggaccgtaccaaaagcgcttttaccgaacatggaccgaccagaaccgaacccaaagcttttgttggaaaatggtcagtccagggttaatgtgggaaatttggcaaaaacggtaccacccgaggttttaaaaacctttttttccaaaaggggga

SEQ ID NO: 70898 - DNA, 413 bp, Zea mays
  unsure at all n locations
  Clone ID: LIB3078-057-Q1-K1-E9
gtcggccgtctctaggtcgtcggcgaggaaggcgcccttcgtcgtcagggccagctccagccctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctaggcgcggtgggcgccatcgccccggagatcttcggcaagatgggcatcatccccccggagaccgcgctgccgtggttcaagacgggcgtcantcccgccgcgggcacctacaactactgggccgactnctacacgcttctcgtcttcaacatggcgc

SEQ ID NO: 70899 - DNA, 117 bp, Zea mays
  Clone ID: LIB3078-057-Q1-K1-F1
gactaggttctagatcgcaagcggccgccctcaatctaaaacctggttccccggaagaacccttcggccgtggttcgacggaagccttcccggcaacttcggtttggatccttgggg

SEQ ID NO: 70900 - DNA, 427 bp, Zea mays
  unsure at all n locations
  Clone ID: LIB3078-057-Q1-K1-F10
gaagcaatggcgaaggacaccatggagcacgcatcggagcctaacctgaacctggaaggcttcctggctaacgcttacctgcaccccatcttccgccttttcgaggaagccgggaaagaggaggagacggtggaggtgaggatcgacaaagccgagaagcagcagcatcgccatgaggaggacgaggctcacgcgaggagctcgtcgcagtaccgggaggaggagactcacttcaggagcacgcacgagacgcattaccaccacgaggagagccacgtcagcaggagcacccagtatcatgagggcatccacgtgaggagcgacacggactcgccgtcgncgtcacacttcgtctaccactacgacatccagcagtgatgatgtcgtctctaaacttgntttcctgggtgtcttgtgaatgcttctc

SEQ ID NO: 70901 - DNA, 433 bp, Zea mays
  unsure at all n locations
  Clone ID: LIB3078-057-Q1-K1-F11
gcgcgcttcaccttccccaccccgccgccgccatcgcacgcccgcagccgcatgcgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgccctgacaaggcgcgccgcctcggctacaaggccaagcagggttatgttgtttaccgtgtccgtgttaggcgtggtggcaggaagaggcctgtgcctaaaggtattgtctatggcaagccaaagcaccaaggtatcacccagctcaagttccaaagaacaagaggtctgttgctgangagagggctggacgaaagcttggtggactcaggggtctcaacttctactgggtgaatgaggatagca

SEQ ID NO: 70902 - DNA, 439 bp, Zea mays
  unsure at all n locations
  Clone ID: LIB3078-057-Q1-K1-F12
ggcaaatgggatgttcctctgccaaaggtcaggcctgtagctgaagaagaaatgttcagggttctacgaactggcaagcgaaaaaccaagcagtggaagagaatggttactaaagccacctttgttggagctggatttacaaggaaaccaccaaagtatgaacggttcattcggccaactggtctgcgtttcaccaaagctcatgtgactcacccagagctgaagtgcactttcaaccttgacataatttctgtgaagaaaaacccaaatggtccaatgtacacttctcttggtgttatgacaaggggaacgatcattgaagtaaatgtcagtgagcttggtctggtaactcccgcttgaaaaagttgttggnggaaatatgctcaagttacaaacaacccggagaacgatggctgtatcaaatgctgtttgctagtgt

SEQ ID NO: 70903 - DNA, 189 bp, Zea mays
  unsure at all n locations
  Clone ID: LIB3078-057-Q1-K1-F2
cccacgcgtccgcggacgcgtggggcgcagctgcagctccgcaaggcagatgttgctgactcgtctgtccagcgtttcttgctcgtcaacagcgcagcagttgcatgcgggcgtcggcaagttcgccgccgncgcatgctggagctggaagaagaagcgcgaggagctcccctgcttcagggccagact

SEQ ID NO: 70904 - DNA, 347 bp, Zea mays
  unsure at all n locations
  Clone ID: LIB3078-057-Q1-K1-F3
gacacgcttctcatcagggctgtcgctaccacaaatctgtgagaattttgttaaggcagcatatgacccacgaatctcagggatttatctgcacatagagccactgagatgtgggtgggcgaaggtggatgagatcagaaggcacattgtggatttcaagaagtctggtaaatttgttgttggttatatgcctgtttgtggggagaaagaatactatcttgcttgcgcgtgtggtgagctatatgcacctncaagtgcttatgttgccctgtttggcctaactgttcagcaaacatttctcagaggtgtccttgagaaagttggaattgaaccggaaattcaaagaa

SEQ ID NO: 70905 - DNA, 271 bp, Zea mays
  Clone ID: LIB3078-057-Q1-K1-F4
cccgggttcagcatgcccggcagcggcagcagcctacccgggttcagcttgcccggcagcggcagcatgcccctcttcggcggcggctccccgggcttcagcggcttcggcggcatgcccgggtcgcccaccgccggctccgtccccgagcacgccaacaagccctgaacgccaacaagcgtggtagtagagtggtgctactgttactgtagtacgtcgtcgtcttcatgcatgcgtggttcggggtttcccctagctccatacgagcagt

SEQ ID NO: 70906 - DNA, 82 bp, Zea mays
  Clone ID: LIB3078-057-Q1-K1-F5
caagaaccgggagctggaggtgatccactcccgctgggccatgctgggcgcgctcggctgcgtcttcccggagcttctcgcc

SEQ ID NO: 70907 - DNA, 246 bp, Zea mays
  unsure at all n locations
  Clone ID: LIB3078-057-Q1-K1-F6
cctgccgcgcctccaagtactcggagttcttcaagcgagagtgcccgcaggccttcacctacgcgcacgacagcccctcgctcacccacgagtgcgccgcgccgcgcgagctcaaggtcatcttctgccactagagctcggagggctgggctgggctgggcgcgccgcgcccgcccgtgcgccgncgccgccaacaagtgtcgctagtagaggtagtaggatgcctggaatagctgtggccctgtg

SEQ ID NO: 70908 - DNA, 434 bp, Zea mays
  unsure at all n locations
  Clone ID: LIB3078-057-Q1-K1-E11
ggagtactcccgttccgagcacactagtcttccctgcgcttgctcgctccttcgggccggcatggcgctgctcgccgtccagggcatggccatgtccaccgccgccgcggccctcccatctcacaaccacggcgccgtctcatcctacgtctccacctcctcctacgcgctcgcagcctccgccgccttcccccgcgcccgagctgcgttcgccgtcggcaccgtcttgtcggccaccgtcactccagttcttgacgtctactgcgggagaggggacaagaaaacgaaaaggggcaaaaggttcaaccattcatatggcaatgcgaggccgcgcaacangaagaagggactgggcctgcgcgggttttgctccttcagctcctccaaggaggatcagttcgatgatggggagatcatttcaatcgagattgacg

SEQ ID NO: 70909 - DNA, 55 bp, Zea mays
  Clone ID: LIB3078-057-Q1-K1-F7
cccacgcgtccgcccacgcgtccgaccactcgtccggacacgcgtccgcggacgc

SEQ ID NO: 70910 - DNA, 130 bp, Zea mays
  Clone ID: LIB3078-057-Q1-K1-F8
attgcgaacccgcggatgatgagcaagcttcaaggcgagatagcgcgagtcgtcagcggcgatcagacgaccatcgctgaaccggacctgaacaaaatgtagtacctgagggcagcgttcaaagaggtgc

SEQ ID NO: 70911 - DNA, 323 bp, Zea mays
  unsure at all n locations
  Clone ID: LIB3078-057-Q1-K1-F9
gtcgcagctgacggacgactgaaccaccgacagacaacatggccgcctccgcctgcacggtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctncagcatc

SEQ ID NO: 70912 - DNA, 445 bp, Zea mays
  Clone ID: LIB3078-057-Q1-K1-G10
gtttggagaagtagacattgatggctcactagtcgctgcacaaaccgctggagctgaggacataatgatgctaaataacggctgcctttgttgcactgtgcgtggtgatttagtccgtatgattggtgaattggtgaacaagaagaaggggaggtttgatcatattgttattgaaaccacaggtctagcgaatccagcacccattatacaaacattctatgcagaggatgtagtttttaatgatgtcaagctggacggtgttgttactttagttgacgcaaagcatgctagacagcatttggatgaagtaaagcccaagggtatagtcaatgaagcagttcagcaaattgcctatgctgacagaattatagttaacaagattgatcttgtcaaagaacctgaagtgttgtccttggttgaacgtataaggggtatcaaccacatg

SEQ ID NO: 70913 - DNA, 459 bp, Zea mays
  Clone ID: LIB3078-020-Q1-K1-B1
gaaggatgtgccgaggccggtgacatactcctactctttctttcacctcatcttctccctggccagcatgtactcggcaatgctcttgactggctggtcaacttcggttggtgagagcggaaagcttgtggatgttgggtggccatctgtctgggtcaggattgcaacccagtgggcgacggcaggtctgttcatatggtcgcttgttgcacccgtcctctttcccgacagggaattctaagttcaaccacggtaagcctggagcatcaaacgtgtctactggggtagctaatatatcctatcaagtatgttgcctttaaaacatgctccgagtcggtgtttgcccactgttatcaagtttgtctacttaataacatgtgactttaggcattgtgccactaatctaacagtgaacgtgtgtgctgcttgtatgggtatatactggagaattttaaagat

SEQ ID NO: 70914 - DNA, 439 bp, Zea mays
  Clone ID: LIB3078-020-Q1-K1-B10
cccacgcgtccgcagacgcgtgggcggacgcgtgggcgccacgctctcccctatgggtcgagccgcttcacagcgccggcgatcgactctccgaccgccgcgagaatgccgatcaagaggttcgtggagatccggcgcgtggccctggtgaactacggcaaagactatggccgcctcgtcgtcatcgtcgatgtggtcgaccagaacaaggcacttgtggacgcccctgatatgctcacgtgccagattaacttcaaacggctctcacttactgacatcaagattgacatcaaacgcgtacccaaaaagtcaaccctgatcaaggctatggacgaagctgatgtgaatacgaagtggtgaaaacagttcatggggcatgaagctgattgtccagaagaggagggctgcgctcactgactttgacaggttcaaggacatg

SEQ ID NO: 70915 - DNA, 438 bp, Zea mays
  unsure at all n locations
  Clone ID: LIB3078-020-Q1-K1-B11
caaaggttccgcacctctcaatctttccgatcgtcttcaccaggttcttcggtgggctggtggttcaattgaaattttcttcagcaaccactgccctctctggtatgggtatggtggtggactaaagttcctggaaaggttttcgtacattaactccatcgtatacccttggacatctatcccgctcttggcctattgcacattgcctgccatctgcttgctgacagggaaatttatcacgccagagcttaacaatgttgccagcctgtgngtcatgtcacttttcatctgcatttttgctacgagcatcctgnanatgagatggagtggtgtaggcatcgatgactggtggagaaacgagcagttttgggtcattggaggcgtgtcttcacatctctntgctgtgttccagggactcctcaaggtcatagctggtgt

SEQ ID NO: 70916 - DNA, 432 bp, Zea mays
  Clone ID: LIB3078-020-Q1-K1-B12
ggcctgcgcgtcaccgtcaagctcactgtccagaaccgacaggccaaggtctccggcgtgcgctccgacggcgcgctcgtcatcaaggcgctgaaggagcccgagagggacaggaagaaggtcaagaacatcaagcacagcggcaacatcggcctcgacgacgtcgtccagatcgccaggaccatgaagaacacgtccatggacaaggagttggccggcaccgtcaaggagatcctaggcacctgcatcagcgtcaggtgcaccgtcgacggcaaggaccccaaggacctgcagcaggagattgatgactgccaagtcgagatcccgtccgcttgaagactagacatctaaggggacttccatcggtgctgctgaagtgtaggcgttctgcatgctgtcgatgtacctttttcaagcaacgcgagccatcta

SEQ ID NO: 70917 - DNA, 406 bp, Zea mays
  Clone ID: LIB3078-020-Q1-K1-B2
tccagacgtgcctaggccactgacatacttctactctgtctgtcacctcaactaatccatggtcagcttgtactccacaatgctattgactggctggacaacttctgacattcagagcgcaaagcttgtgaatgttgcttgtccatctgcttgagtcaggattgaaatccactgtactactgcaggtctattcatatggtcgcttgatgcacccgtcctattttccgacatggaattctaacttcatccatcgatagcctcaagcatctcacgcttcaactgtggtatctaatatattctatcaagtttattgcccttaaaacatgcttctagccacgtttgaccatggcatgaagttcgcatacttaataacatgcgaatctaagcattgtgccactatcttaac

SEQ ID NO: 70918 - DNA, 426 bp, Zea mays
  unsure at all n locations
  Clone ID: LIB3078-020-Q1-K1-B3
ggcatctttgtatcaaaaagatgcagaagagacagttgatggtattgaaaatacaactgctacccagcttgatgttgctgatattggaagcctttcagatcttgtttctcaggttgaggttgtaattagcttgctgcctgctagttttcatgctgccattgcaggagtatgcatagagctgaagaagcacatggtaacggcaagctatgttgatgaatccatgtcaaacttgagccaagctgccaaagatgcaggtgtaactatactttgtgaaatgggcctagatcctggcatagatcacttgatgtcaatgaagatgattgatgaagctcatgcacgaaagggaaaaataaaggcatttacatcttactgtggtggattgccatctncagctgcagcaaacaatccgcttgcctataaattcag

SEQ ID NO: 70919 - DNA, 461 bp, Zea mays
  Clone ID: LIB3078-020-Q1-K1-B4
tcgcccacgcgtgcgtaaggtcctgtcgatgtggacattggtgccaatccatccgccgagggtggtgaggacgaaagcgttgatgacacagctgtgaaggtggctgatattgttgacacattccgtctacaggagcaaccttcttttgacaagaaatcatttgtgtcttacatcaataaatacatcaagaatctcactgctgtgttggatccagagaaagcggatgagttcaaaaagggtgtctagggtgcaaccaagtttctccttagcaagctgaatgacctccaatttcttgctggtgagtccatgaatgatgatgcatctgtggtattcgtctattacaaggatggtgcctctaatccgacacttctatatgtctctgatggtcttaaggagatcaagtgctaggcgtgctggcatattagttacccatgttgggtactatctatgtactattatta

SEQ ID NO: 70920 - DNA, 458 bp, Zea mays
  Clone ID: LIB3078-020-Q1-K1-B6
gcgcggagcacaatgttcacctggtcactgatcctgccgataatacccttggcgagtgggctgggctttgcatgattgactctgagggcaaggcaaggaacgttgtacgctgctcctgacgtcgtcgtcaaggactaccgtgaagaatctgagggccttaacatagagcaggagtatgtcaagtcgcactacatgtgtgacatgtatcagtgatactcttgatttgtacctgggcttaaaattatgcttttgcatctggggcttgcctaggagattataacattctactagaggacccgaagaggatatgtatgaacaatttggacatctgaagtctgcctgtctatggtgctgtcgtctggtactaatgcatatcatgaagagccgagtctattcttgatctgagtttaccttactactcatgtgtctatacccatatgccattggcttatggaaat

SEQ ID NO: 70921 - DNA, 463 bp, Zea mays
  Clone ID: LIB3078-020-Q1-K1-B7
ggggaacaccattcctggtatcgaggaggtcaacatcttcaaggacgatgttgttatccagtttcagaaccctaaagtgcaagcatccattcctgcaaatacatgggtggttagtggagtaccccagacaaaaagtctgcaagaccttctgccatcaattatcaaccaactgggccctgataacctggacaaccttaagaagctggctgagattttccagaggcaggtacctggtgctgaagcagctgcacaggatgatgactacgtacctgagcttgtccaaggagagacatttgaagaggctgcagagaatgagcctcaactggagcaggatgagaacaaagaatcgtgattttgttgtgaaggatcgtcggtttaattgttggcattagccttgcgagagaccctacctgctcatctggcgtgcctatatacatgtgctccagctttgtgtcaagtgtgc

SEQ ID NO: 70922 - DNA, 208 bp, Zea mays
  Clone ID: LIB3078-020-Q1-K1-B8
ccggcaatggcaggttcatcatcggcgaggaagaggaataggctgctggcctcggacatgagtcgtgtgcgtttacttttacctgtgactgtgagtgatcgatcgattgctgtgtatcaattactcgtgatgagacctcgaaggtagggtgtcgcgttgggttgtctgcttgtagaaacaagagcttatatataaattactactagct

SEQ ID NO: 70923 - DNA, 377 bp, Zea mays
  Clone ID: LIB3078-020-Q1-K1-C1
agaatatagtatagtgccacctactcttttttattctgcccaagtgcatagacagaaaaggacagggggggaaaaaagtgacttcgagcaaaaggaaaaggtatagtgacaggaagtgctggagaaacatgctcgatttcgtatgttcaaagagaaggggttatcctatgcaactagacatttttatccttcactggaatgttgagcattgcagaattgacaattgctatgccatcgagcaagttcagtcgtttgtaaatatgctcctagtaggaagtaactgaattattcgcaaaaaaaggaagtggctgaactattgtgccttttgcacgatgcttcgtttcaaggattagccatgaattaacgtttatgtactc

SEQ ID NO: 70924 - DNA, 179 bp, Zea mays
  Clone ID: LIB3078-020-Q1-K1-C10
cccacacgtccggccaggctgacggccgctgacctgacatgtcatgcgcaccttacgctgggcacaggcgcgcatgccgctcgactgtaacggatcactgcgctgtctgtcgcactaatcaccgtgctcgcgctacgatctccgcgccagcatctctaccatgtgtcattgcacatcgt

SEQ ID NO: 70925 - DNA, 440 bp, Zea mays
  Clone ID: LIB3078-020-Q1-K1-C11
cccacgcgtccggcgccgtcgaggggtaccgcgtcgccggcggcccgctcggggaggtggtcgacccgctgtaccctggcggcagcttcgacccgctcgggctcgccgacgacccggaggcgttcgccgagctcaaggtgaaggagatcaagaacggccgcctcgccatgttctccatgttcggcttcttcgtgcaggctatcgtcaccggcaagggccccatcgagaacctcgccgaccacctcaccgaccccgtcaacaacaacgcctgggcttacgccaccaacttcgtccccggcaagtgagcgagggcatgatgcttgcatgcgtgtaccgtagacgtacgtattcctacgtactgcaggttgcaccagtatttgtgaagggagctttgggagccagagattgtaccgctagtgtatttgtatgcatgatgtgga

SEQ ID NO: 70926 - DNA, 328 bp, Zea mays
  Clone ID: LIB3078-020-Q1-K1-C12
cccacgcgtccggcgccatgcagctcgctcggccgcgaccttgccgagctccgccgctgctccacgtctcctggtcgggctctcgttctgcgcgtgacgccgctgttccctggtgctccctgctcgaccctgcttcttcttccttgagcctcgccgtgcgagttctccctggctcatgtgcctaccgccgtcggccccagtctctcgctcgcaaggtcttcccaagccgtcgtctcctgcctctggctgtcaagcgcgacgaactcgtcccgagctcgtcacaacgtctcagccctgcgtgtcgcgctagctcgcgtctatggtcgcg

SEQ ID NO: 70927 - DNA, 371 bp, Zea mays
  unsure at all n locations
  Clone ID: LIB3078-020-Q1-K1-C2
cagctgggtgccttgtggaagaaagctcacatgctcttaccctggcatcaaattttcctatggccgggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagacttcccaggtagcaacaacgggacaagtctcttncagaccatcattggactgaagattagagacctctatgaacagattgttgctgaaagggctggtgtaccagcgggaagcagcaaaagtttaacgatctatgcattcagatgtcctaaaacta

SEQ ID NO: 70928 - DNA, 446 bp, Zea mays
  Clone ID: LIB3078-020-Q1-K1-A9
gggaacgactacccttcttcagtgacaaacagcaagagaagcttgtgggatcctataaggtgttgggaataaactactacacctcaatattctccaaacatatcgacatctcaccaaaatactcgcctgttctcaacactgacgacgcctacgctagtcaagaaacgtatgggcctgacgggaaacccattggtcctcctatgggaaatccgtggatctatttatacccagaaggcctaaaggatatccttatgatcatgaagaacaaatatggaaacccacctatctacatcactgagaacggaatcggggatgttgatacaaaggagaaacctctacccatggaggctgccttaaatgactacaaaaggctagattacatccagcgccacatctcaactctcaaggagtcaatagacttgggagcaaatgtgcatggctacttc

SEQ ID NO: 70929 - DNA, 279 bp, Zea mays
  Clone ID: LIB3078-019-Q1-K1-H2
acgggagcccgttcttcggcggctacggttacggttggtcgccgttcagcttcttggcccccgggccgagcgtcgccgtcggggtcgtcggcggtttcaacacgctcgtcctcttcttggtgctgggcgccaacgtcggaactgacaggcggttcctcaacaggaacaacgaccattacgacgactactgtttatcagtgccaggctccttgtacgcacttcacctccgtgtgtaaaatatatattacgaaattcttcccgtgcggaattttaggaacg

SEQ ID NO: 70930 - DNA, 346 bp, Zea mays
  Clone ID: LIB3078-019-Q1-K1-H3
ctcacaggctaagagaagtctactagcatcaaagcagatttgcagatagaccttgtgcaaggcatggagactttcacccaggagcatgtcatcggaattccattgacttcgtttgcatatgcccatgaggcacgacgacgaaaatcttgctgatgtgacatggttcatagaaaacatctgaagagtatcttcattcatctgatgaacacactgagccatataacagatagctacatgcaaggattcaaagaacacttaaccatgggaccaaaaatttcagaaactgtacaagggagactaagcttcggtgcacaggttctccaaagctgcggtattgataaaggct

SEQ ID NO: 70931 - DNA, 298 bp, Zea mays
  Clone ID: LIB3078-019-Q1-K1-H4
cccacgcgtccgaaagacagcaaccttctgttctgggatcttgcagcagcttgactatgggggggttgaatgccaagccctggttcttgcttccacccgtgagcttgcacaacaaattgaaaaaattattccccccacttggggactaccttggtgttaagagccatgcttgcgttggaggaacatctgttcgtgaggaccaaaggattctcgccagtggtgtgcatgttgatgttggtacacctgggcttgtgtttgacatgctgcgtaaacagtcccttcgccctgataacataaa

SEQ ID NO: 70932 - DNA, 321 bp, Zea mays
  Clone ID: LIB3078-019-Q1-K1-H5
ctcgccgtctccaggccgtcggcccgctccatccgcaggccccgcgcagccgccgtggtgggcaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtaagcgcgtcggcgtaaccggacctcctgccgatcaagaagggacctcaggagcct

SEQ ID NO: 70933 - DNA, 172 bp, Zea mays
  Clone ID: LIB3078-019-Q1-K1-H8
cccacgcgttcgaaagacagcaaccttctgttctgggatcttgcagcagcttgactatggggtgggtgaatgccaggccctggttcttgctcccacccgtgagcttgcacagcaaattgagaaagttatgcgcgcacttggtgactaccttggtgttaaagtccatgcatgc

SEQ ID NO: 70934 - DNA, 441 bp, Zea mays
  Clone ID: LIB3078-019-Q1-K1-H9
cgagcaagctaagaaatttggctgcactgaattcgttaaccccaaggaccacgacaagcgagtgcaagaggtgctgattgagctgaccaacggcggcgtcgaccgcagcgtggagtgcaccggtaacgtcaacgccatgatatccgccttcgaatgtgtccacgacggctggggtgtcgccgtgctggtgggtgtcccgcacaaggacgaccagttcaagacccaccccatgaacttcctcagtgagaagacactcaagggcacctttttcggaaactacaagccccgcaccgaccttgccaacgtcgtcgagatgtacatgaagaaagagctggagctggaaaagttcatcacgcacagggtgcccttcttggagatcaacacggcgttcgacctgatgcttaagggggaaaacctgcgctgcattatgaggattgagga

SEQ ID NO: 70935 - DNA, 242 bp, Zea mays
  unsure at all n locations
  Clone ID: LIB3078-020-Q1-K1-A1
tgctgatctactcttcactggaggcccacttatatataggacaaaaatcccaattttgtggggaagagccacaagtagggatatatctgacgaattctcgtatgcaacggcaacgccgctctacccctcaacttttattttcctttttctactttgcaacatgcatcaagggctgtcattgatcgacattcacatatatgttacatagggaattacatgcgactgcctaaactctangaaaa

SEQ ID NO: 70936 - DNA, 409 bp, Zea mays
  Clone ID: LIB3078-020-Q1-K1-A10
gtgttctgaggagctggtcggcgctcctagatcccttcgcctctgtcgcgttcgaggctgggtagccgacaccatgagtcgctcggggcagcctccggatctcaagaagtacatggacaagaagcttcagattaagctgaatgcaaaccgtgttgttattggcacacttcggggattcgaccagttcatgaatcttgtgatcgacaacactgtggaggtcaatggaaacgacaagacagatattggaatggtggttatcaggggaaacagtgttgtcatgatcgatgcactggagccagttgccaagtcgcagtgaatcattattgttcagctgatataatagcagcatgaaaactgatgctaatgctatcagtgaacccttgtggacttcggactaatgcttttggac

SEQ ID NO: 70937 - DNA, 338 bp, Zea mays
  Clone ID: LIB3078-020-Q1-K1-A11
caccagcgtcgtacaacaggagggagaaaggcttggcgtgccgtctcggtgggagctcggcttggccgccgtatcggcctcgaagacccattttggggaaagggtagaccttggggaaacacgcggaggcaccttcgagctttgggatcacctgctgttgccttaattgctcaccggagccaatagttgctgcggtgccagcttgatccgtgggccggtgacgccgctgctccatcaaagctgggaggtaacgagaatttgaagatcatgctggtacctggaatctcgagtcccaggtcatgaacaggtatcgcatgaagaggcgcatggaggatgct

SEQ ID NO: 70938 - DNA, 427 bp, Zea mays
  Clone ID: LIB3078-020-Q1-K1-A12
gttcgataacacctaccaggctactattggtattgatttcctgtcaaagacaatgtacggtgaagatagaactgtgagactgcaactctgggatactgctggtcaggaaagattcaggagtttaattccaagctatattagagactcttcagttgctgtcattgtattcgatgttgcaagcaggcagtccttcttaaatacatctaagtggatagaggaagttcgcactgagaggggcagtgatgttatcattgtgcttgttgggaacaaaactgaccttgttgacaagatgcaagtctcaatacaggaaggggaaggcaaggcgaatgaccttggagtcatggttattgaaaccagtgctaaggctgggtttaacattaaggcgctgttccgtaaaattgctgctgcacttactggaatggagacg

SEQ ID NO: 70939 - DNA, 385 bp, Zea mays
  Clone ID: LIB3078-020-Q1-K1-A2
cccacgcgtacgctcagggaggtgacgccggagctgtcgtgccccgtggtgctcctctcgtactagaagcccatcatgtctcgcagcttggccgagatgaaagaggcgggggtccacggtcttatagtgcctgatctcccgtacgtggccgtgcactcgctgcggagtgaagccaacaacaacaacctggagctggtgctgctgacaacaccagccataccagaagacaggatgaaggagatcaccaaggcttcagaaggcttcgtctacctggtgagcgtgaacggagtgacaggtcctcgcgcaaacgtgaacccgcgagtggagtcactcatccaggaggttaagaaggtgactaacaagcccgttgctgttggcttcggca

SEQ ID NO: 70940 - DNA, 270 bp, Zea mays
  unsure at all n locations
  Clone ID: LIB3078-020-Q1-K1-A3
ccgagaagcgctttagccgtagccgtagccgtagcgataagagtgagctagctggtgcacaccggcgtgcngtcactgcgtactccgtggcgctcctcgccgcgcccgcgctcccggcggttcgcgcttcggccttcttccttggggcaacgtctggcaacttcggtttccagatgcaccgaagctcttcctggttcgcgccaaaggcgctttcgaggacacatcggccttcggcgaccagttgatcgaggacctcaaagcgaagtggga

SEQ ID NO: 70941 - DNA, 461 bp, Zea mays
  Clone ID: LIB3078-020-Q1-K1-A4
tcgcccacgcgttcgctgtgacccagacaagcctgtagtgcttgaacgtatggaatttcctgatcctgtgattaaggttgctattgaacccaagaccaaagctgatgccgacaaaatggctactgggttaatcaagcttgctcaagaagacccgtcattccacttctctagagacgaggaaaccaaccagactgttattgaaggaatgggagaactgcatcttgatatcattgtagacagactaaagaaggagttcaaggttgaagcaaacgttggaagctcacaaagtaactaccgggaaagtatttccaaagttgcggaaatacaatatgttcacaaaaagcaatctggtggatctgggcagtttgcagacattattgtgcgttttgaacctttggaagctggaagtgggtatgagttcaagagtgaaatcaagggaggggcagtgcccaaagaatatg

SEQ ID NO: 70942 - DNA, 312 bp, Zea mays
  unsure at all n locations
  Clone ID: LIB3078-020-Q1-K1-A5
cccacgcgtccgcgctgaggaagcccgcacccctgcccggatccgatggccaacagcaaggtcccgcggcggatcatcaaggagactcagcggctgctcagcgagccagcaccgggggatcaccgcgtggccttggaaggaaaccatgcgctacttcaacgttatgatccttgggccgccgcattcggcctatgaaggtggagtttttaagcttgaactctttttacctgaggaatatccaatggctgccccaaaggttaggtttctgacaaagattcatcatcccaacatngacaagcttggtaggatatg

SEQ ID NO: 70943 - DNA, 459 bp, Zea mays
  Clone ID: LIB3078-020-Q1-K1-A6
ccgacctcggcttccgggcgtccacggaggtcagaggtgaggtcgtcgagctagtcacccggctcgaggcggttaaccctactactgctcccgtcgagtcgccggatctcctcgacggcaactggatcctcatatatacagcatattctgagcttctgcctattctagctgctggggcaacacctttggtcaaagtaaagcagatatcccaagaaattgactccaaaatcatgacgatagtcaatgcttcgacccttacgactccattcgcttcattttcattcagcgcaaccgcctctttcgaggttcaaagcccatcaaggatagaggtccaatttaaggaggggagctttcagcctccgacaatatcatcatccgtggatctacctcaacaagttgatatatttgggcagaagatcagcctggggccagtccagcaggcactgaatccattgcagc

SEQ ID NO: 70944 - DNA, 430 bp, Zea mays
  Clone ID: LIB3078-020-Q1-K1-A7
cccacgcgtccgtccacgcgtccgcccacgcgttcgcccacgcgtacggctgaaggtgcgcaatccttttatgatgggcagagatctgatacaatggttggtctacaaaagcagtccatcaaggagtctaggtagcaacctaatactgaacgaactgaaactatatacgataattataatctttctcggacattagaaggtcttgaacaaagtgtacatgaagacattattgtgctatccaaggaactacacgaggctgaggatgctgaaaattctagacacatggagagattgaaggatataaatacacagtaccaggagatactattaacacttagagctcggctagcgaactatacagatgagttgctgctcaaggaatctctagcacgccagcagcaataccagcacgccatcatgagccattatg

SEQ ID NO: 70945 - DNA, 385 bp, Zea mays
  Clone ID: LIB3078-019-Q1-K1-H12
cccactcgttctaacaatgatccgcaacttgtcaactgctatcgaaaaacccagggcttgcatcttatcctcatgctatgaccgaacaaacgatacttatatttggagaacttgagttctgagtgactgctcagagtgccactatcggttctgcagtaacaccaatttttggattaatctcatggcaactagcacgatgcgtgcaaagtattcctgacaatacaactcaatacacaaattacaatgcactgcagttggccaaatcactcaagaccgcactgcttgttcttggctacacatctaccggcctatccttattcgcggcttttgggcttgctgtgctagcccagcaaattaactctgataacaaatcggagtaactgac

SEQ ID NO: 70946 - DNA, 142 bp, Zea mays
  Clone ID: LIB3078-019-Q1-K1-F3
gcgatctgcacgaccaactgcctcgcgccattcgtctagatcttggacgacgagctcgaagtgttgggggggaccatgaccacgacgcactcgtacaccggcgaccagatgctgctggacgcgtaccaccgcgacctctggc

SEQ ID NO: 70947 - DNA, 422 bp, Zea mays
  Clone ID: LIB3078-019-Q1-K1-F4
cggacgcgtgggccggcgggcgcgctggaccccgggctgatgtacgacgccagcgaggacggctacctccgcttactctgcaactacggctacaacgcgtgcactgtgaggctcgtcgactccaccctccccagcgggttcagctgcgcggccaacgttagcaaggacctcatctccaacctcaactacccgtcgatcgccgtgacggggctcctcggcaataaatcggctgcggcgggcctaagccggaccgtgacccgcaccgtcaccaacgtgggggcgcaagaggcggactcctacacggtcgccgtcagcgcgcccgccggcctggacgtgaaggtcacgcccagtaagctcgagttcaccagaggcgtcaagaagctggacttccaggtgagcttctaccgttgcgggaacgacga

SEQ ID NO: 70948 - DNA, 147 bp, Zea mays
  Clone ID: LIB3078-019-Q1-K1-F5
gatccttggatgcttaatgctggttactcattgacttcagatacagcaggtgttcaggtgcgttgcatggatgcccctggtgacattattagaatctggatgcatggctgacttgaagaacgaatacgcttgacaccatcagaagtc

SEQ ID NO: 70949 - DNA, 392 bp, Zea mays
  Clone ID: LIB3078-019-Q1-K1-F7
cccacgcgtccggagaagctctgctccagatcttccgtcattgctactggactctcgaatgagtatttcttggaatgcctattgttccagcagtaactgagcttattgctgctcaatttctatggctagactatgacgaccgcacaaaacccatttatctgtatataaactccactggaactatggacgaaaataacgagcttgttgcatctgaaactgatgcttatgcaattgctgattttatcaatcgaagtaaatccaaggtttacacaatcaatcttagcatggcatatggtcaggctgcgatgcttctttcccttggtgtcaagggcaaaagaggagtgctgccgaattcaatcactaaattgcacctgcctaaggtgcacaaatct

SEQ ID NO: 70950 - DNA, 433 bp, Zea mays
  Clone ID: LIB3078-019-Q1-K1-F8
acggaaaggctatcctctgtgccttcaggtggtggtgcaattgacatgggagctccaggagctggagctggcggtggcgcagcacctgctgaagaggcaaagacggaagaaaaggttgaagagaaggaacagtctgatgaacatatgggtttcagcttgctcgattaaaacagcactaccagtctacaggctcttcgcgaatggtctcataatattggccggtttccacaaaataagattgtcaatagctactacgtacttatgctattctgcatgtgatgtacgagtgtgcatcttcaagaatctctatgttgaatggtctgtggtcccataataataatggtaacaatgtaaattgtatgtcctgtacggactttggtatcgcgacatctcattgtgcatcttcaaggatcataaattgaatgttatcatt

SEQ ID NO: 70951 - DNA, 280 bp, Zea mays
  Clone ID: LIB3078-019-Q1-K1-F9
gttatcgcctaatcttgcattcatacgaggtcattctctggattgctaatcacaactcaggtcaggtttacacttactcgagcctgaacagagctcagctcgatgataccctaagtctgggattacctgaatctccaaggacataacaccatatttttaaaattcttaggagcatctaccacacttgaaaccttattactactaatgtcatagcgagagctttcagtatcatatcatgcactgaatactgcatcacatatcaactcataaacactgtcta

SEQ ID NO: 70952 - DNA, 199 bp, Zea mays
  Clone ID: LIB3078-019-Q1-K1-G1
gacaagatatatacacaatcttcacgcggtgtagccatgtgtttgctaggaaccttctgtagagcaggaacctggataggaatggcatgatcacctgcatgaggttccaccgtactggctgctcaagaacccgagcgtcatctggttccggatcatcagctggctggcgacggacagattcataatcatcaaccgttac

SEQ ID NO: 70953 - DNA, 261 bp, Zea mays
  Clone ID: LIB3078-019-Q1-K1-G10
ttctgggtatcgtctctatgatcctccttacagtcactgggtacatgactggtgcactggcatagctgcaccttgctgctgaacaccatgattcacactaccatgtcatacactttcggaggatcaactgaatccctccagtactgctactggctgatctactactacgcgcgatccgacatatctacctccatgcatacatgcctcttgattgagtacatcgtctggctctgctatgcattctgattaatgctagagata

SEQ ID NO: 70954 - DNA, 274 bp, Zea mays
  Clone ID: LIB3078-019-Q1-K1-G11
cccacgcgttcgggaaaatgatgaggtcttgattgctggatttggtcgtaaggggcacgcggtgggagatattcctggtgtccggttcaaggtcgtcaaggtttccggtgtgtctctgcttgcccttttcaaggagaagaaagagaatgccaaggtcttagattgctcttgctaccaaaatcagcaagcgtggagttgaaacgggatggcgttagatgattaagaagaatggttgcttgctatgtttgcagtgcattcgtgcaattgttaacct

SEQ ID NO: 70955 - DNA, 415 bp, Zea mays
  Clone ID: LIB3078-019-Q1-K1-G12
ctgttgctgccgttagtgaattcattgctcaattgcagattttagagtttcttgacaatgctaggttcactgtcggctacgaagctgcgttgcatattcactctgttgtctaatactgcgagaccgttgagctcatagaggacattggcatgaagaacaacaactacgagcatccaaagaagaaaaagccaaagacgaagcctctttttgtgaagaacggtgcaattgttgtttgccgcattcatgtgaataacttgatatgcatagataagttctctgatttccctcagctcgcaacgtttacacttagaactgatggaaagactgtagctgtatgcaaagttgatgatattacgactgctggtagcccaacattctgagcttaattcaatattcaacatgatggataatcatg

SEQ ID NO: 70956 - DNA, 172 bp, Zea mays
  Clone ID: LIB3078-019-Q1-K1-G2
gagacctatccgttcaaccctaatggttctccactgggtatagcagccctttgctcacctggggggaggcacctggctatgatgccgcatccagagcgttgcttcatgatgtggcaatatccatggtatcccaaggaatggcatgttgaaaagaatggccccaagccttggc

SEQ ID NO: 70957 - DNA, 364 bp, Zea mays
  Clone ID: LIB3078-019-Q1-K1-G3
taaacttatcctttcaaccctaacgttattctactccgcttaccacccttttgctcacctggctggattcccctgactatgatgccgcattcacatcgttgcttcatgatctggcaatttccatgctatcccactgaatggccagtttataacactggccccagtccttgtctgccaatgttccaaaatgctagagaatggtgttcatagtgctaggaagcttcctgctgcaacgatgtactcatccaaacacctgcttctaccaatatatggatgattgctggatgtatggcccaattgattacccctttttggcaaaaataaatgtctttgaccatcaatacattatctttgactaatgtat

SEQ ID NO: 70958 - DNA, 433 bp, Zea mays
  unsure at all n locations
  Clone ID: LIB3078-019-Q1-K1-G5
ctgaattgaatggcaagctcactggcatgtccttccgggttcccaccgtggatgtgtcaggtgttgacctcactgtcagaatcgagaagggggcctcctatgaggaaattaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcgtggtacgacaacgagtggggctacagcaaccgcgtcgtcgacctgatccgccacatgttcaagacccagtaggctagtagagagatagatttctgcctccctatcgagggtcgtcccaatggcctntggtcgcaaaccaactttgctgcttgtctatgctg

SEQ ID NO: 70959 - DNA, 366 bp, Zea mays
  Clone ID: LIB3078-019-Q1-K1-G6
cgctatcaggtttggccggctgacaaggatatacctgcgcgttgccaccgaggctgtgacaggggttaccgtcaatgtcacaccggactaggctgcctgctataacctaattgacatgctttggacttctgcttgtgcattcctactcatggctgttctgggctacatggaccagaatctggcttccaccggcttatccttgaccattgcgcctatcatatcagtctcctacgtccttattaccgttaccgactagtctatcaacctcatctacaatatgtacaacgcgcagagttactgcaccctctttgtcgacctaatcctctacatgtttgagaccgactgggctactagaggcatcgattt

SEQ ID NO: 70960 - DNA, 152 bp, Zea mays
  Clone ID: LIB3078-019-Q1-K1-G7
caggtttatgagcggcatttcgcgaacaaggaaaccaaggagttcaaagatttccacattgcgctacgtcgagttctgcaagtatttcaacacagtgatgcccggtcaggattttgacactccatctactacagagattcagaaattctttg

SEQ ID NO: 70961 - DNA, 358 bp, Zea mays
  Clone ID: LIB3078-019-Q1-K1-F2
ggcatgcgcaaggccggccacctgctccacgtcgagcggccgtgcgcctacaaccgccaggggcagaggtggttcgcctacgtcaactccacagaagaccacgtccaggccagatgatcgacgcgcccgccccgctcctgctgccgctgatgcatgctgctacacggagatcacatgcatacatatatacacgttccgtctcagttgatattaattacctgtgcattggtgctgttcgttattgatgttgctattagctgcggctcccaagatagaagacgctggcagggcatccaacacactgtatgtatgtagtgggttgcgctggccccggttcagtacgtgtactctcgatcaa

SEQ ID NO: 70962 - DNA, 385 bp, Zea mays
  Clone ID: LIB3078-019-Q1-K1-G9
gccatggtcgccttcctcggcttcgccgtgcaggccgtcgccaccggcaaggggccgctgaacagctgggccacccacctgagcgacccgctccacactaccatcttcgacacgttcggagggtcctcttaagcccgccattgctccgccccgtccatcgaccggaacgtgttcttggattaattaactacgatctctatgagcctggggatggatcaacccgtcgtgcgtggtctcgttttgtgatgagtgggagagagaggatgacaagatcgatcctttgttaatggagatctcgttaattaagggagctaccgctgggacttggtggtttggaatatatgatccaacccgtgattgatcaatgcattcacttgtgtaccac

SEQ ID NO: 70963 - DNA, 92 bp, Zea mays
  Clone ID: LIB3078-019-Q1-K1-H1
tcggtctcatgcgcaatccatgcgcacattgtccgtgtccgctctcgtgagaacaggaggaaccgggagcgccctcagagtttatgcgccgg

SEQ ID NO: 70964 - DNA, 423 bp, Zea mays
  Clone ID: LIB3078-019-Q1-K1-H10
cggactcgtggacagactcgtgtgctccgactcgcgcacccggttccgcgtgcatttgggcacggactatctcggctctcgccagccaatctagggtttcggtcccagcgtgcttatccgcccacaccggacatgtctaatcaaggaggtaaagccaatccgctaaaagcgcccaatgccgacaataatgagtacgacgagacagatcttgcatatctgcagacgaagaatgaccaggataaagcactgaacgatctcaaggccaatgcacaaaaggtcgcgattggatgctcgggtctgaagaaaagtggaaagaaatgagactggtcacccgtctccattacctataggatgatccagcaactgtctatctgtgatgcgcttcactacgtgtgattgtaacaatggtacctattgtgttct

SEQ ID NO: 70965 - DNA, 270 bp, Zea mays
  Clone ID: LIB3078-019-Q1-K1-H11
cccactcgttcggacacacgcgtgctatcgctcggttactcaaggccgccaagtactccgagctgatgatctcctgcgtccctggctacatcgccgctttcctcgagtacctcatcgctgaggtcctggagcttgctggaaactcaactagggataacaacaatacccgcatcgtgccgcgtcacatacagctctccgtgcgcaacgactacgagctgaccaagctgctttgaggtgccaccatcactagacgctgcattatgcccaaca

SEQ ID NO: 70966 - DNA, 423 bp, Zea mays
  Clone ID: LIB3078-019-Q1-K1-D8
cggacgcgtgggtccgggtgctggtgacctccgccgtggagctggacgcgcgccaggccgagcgcatcgcgcgcaagatgcgccgcctcaccggctttgtcgacctcaaggtagagaccgccgtggacgcgtccctcatcgccggcttcgtcgtctgctacggcaccgacgactcgcacgtcatcgacctcagcgtcaggggccagctcgcggcgctcaagagccgcgtcgactccatcgaccagaccgcgcatgcccacggacacccacaccaccactgaccgtcgatccaacacctgaggcaccggagcaaagcacagcgcgccgtcaccgtgctacagcttacaatacaagcctatactgtacacgcacagaatgacagaacagaaccgaacgcgcgccatggcaacaacagttttccta

SEQ ID NO: 70967 - DNA, 174 bp, Zea mays
  Clone ID: LIB3078-019-Q1-K1-E1
gtggcggccccgaaggcggaagaaggaggcgggctcatgaagacgctgtggctcggctcgctgttcggcctctggtacctgttcaacatctacttcaacatctataacaagcaggtactcaaggttttcccataccctataaacatcacagaagttcaatttgctgtccgaact

SEQ ID NO: 70968 - DNA, 260 bp, Zea mays
  Clone ID: LIB3078-019-Q1-K1-E10
caatcctatgcgattcatgtactttccttgacataccagaaagttccaaggcctattctggtagaggcaatcaacatcgaaggtctcgcgttggacaagtttcttgagtaccatgccgcgaactcaggttgggtgattgagaatggtgggcagtctcaagtgattgttcttccgcgtaatgagttcaatcacccagagctcaagacaacacagccgatatcctttccgtttgaacacgtaacacgcatattccctgtcct

SEQ ID NO: 70969 - DNA, 413 bp, Zea mays
  Clone ID: LIB3078-019-Q1-K1-E11
acggcaggctttagaagcgcctcgatggaggcggcgagcaacggaacgctgctgtaccgcgaggcgcaagaggtgaagctatgctccgtgcactgcgtcaacaccactatgaagggccccttattcttcaagttcgacctcgtctcgctcgccgccgacctctaccagctcgagcgcctgatgatgctcgacgactcactaagcctctgcgcacacatcgctaccgtaggggacttattcaacgtgtacgagggctccaacaacgtctccctctacatagatttcagcatacacgctctgcagaacgctctgtatgtacgacacctccacgatatgcaccttgattacccagctgcaagtgtcacgccaatttgaccctgagcacgaggttgctttcatttgccaacttcatg

SEQ ID NO: 70970 - DNA, 357 bp, Zea mays
  unsure at all n locations
  Clone ID: LIB3078-019-Q1-K1-E12
tcgnccacgcgtccggattcttgaagagatcgagcttcttttgcaccacaaggtcgaggatggcttgcaactgcngatcaagctgcggctgcggctcaagctgcaagtgcggcaagaagtaccctgacctggaggagacgagcaccgtcgcgcaggccaccgtcgtcctcggcgtggccccggagaagaaggccgcgcccgagttcgtcgaggccgcggcggagtccggcgaggccgtccacggcttgagctgcngtggcaacttgcagtgcgacccctgcaactgctgatcacatcgatcgacgaccatggatatgattattatctatctaacttgtggtggtggttgaacaatta

SEQ ID NO: 70971 - DNA, 443 bp, Zea mays
  Clone ID: LIB3078-019-Q1-K1-E2
cggacgcgtgggaccagatctttcttcctgttgcttcctcggctggtttccttctctcggggcgtcggctgcttcttcccccaaccaaagacacgaatcagccatggcgctcgcctccgccacgtcccgccccctcctcggtcgccccgccggcaccgcgcggccccacctcgccgattcctcatcctcccccgcctcctcgatccgcttcccccgcggcgccgacggcggcgccagcagagcggccgtctatctccgcgcccccacgcctccagcggcggcaacagcaacatctggtagcattgctccagcaatttcattgactgaaaaggccttgaaacatctgaaccaaatgagagctgaacggaatgaaagtttgtgcttgagaattggagtgaaacagggtggatgctcaggcatgtcttacaccatggaatttgaaa

SEQ ID NO: 70972 - DNA, 424 bp, Zea mays
  Clone ID: LIB3078-019-Q1-K1-E3
ctggtttccaccgacttaaccggtgacagcaggtcgagcatcttcgacgccaaggccgggagtggcctgaacgaccacttcatcaagctcgtctcgtggtacgacaacgagtggggctacagcaaccgcgtcgttgacctgatccgccacatgttcaagacccagtaggctagtagagagatagatttctgcctccctatcgagggtcgtcccaatggcctttggtcgcagaccaactttgctgcttgtctatgctgagaataaatgtgaacggtgcccctggacgctggatccatgctggttttggacacggttgtctttttgtgttttaacttatatgctgtcgtcctgtaacgaattcgcaagttttaggtcttttgcgctatgataagaatgaacaatgagggttcagctttggtggcgc

SEQ ID NO: 70973 - DNA, 426 bp, Zea mays
  Clone ID: LIB3078-019-Q1-K1-E4
cccacgcgtacgcttcaagagtttgtggagtttgtcaaggttaagaatttcattcacgcgggtcatatgctcgaaaacaccttgctccctggggctctgtacacatgaaagaattgcagcgtgtcacagcaacattggtttttagaagcaatactaattgtactccatacaagatattgtttgagcaagaccgctgggactatcttgttgacattttcaagcaagattttagcaagttatatggcatgacactagaaccgctgctgaacatatatctgcaagcaggcctgacagctctcaaaaccccgatctgctctgagggtagctgtgcctaagaagaccccttgcctctggagggcttcaggaaactagccgagcctctggccttctctaaacagcaccactcgaaacttgttgggtcatcac

SEQ ID NO: 70974 - DNA, 433 bp, Zea mays
  Clone ID: LIB3078-019-Q1-K1-E5
gtaccttctcactcgcagctacatcactggctaccaagcttccaaggatgacttggctgtgtacacttcgttttcgtctgctccctcgtccaagtatatcaacgtagcaaggtggtttaatcacattgatgcgctcgtgaggctgagcggaattactgcagagggccaaggtgtgaaggttgaatcgtcagcagttccttcagccccaactccagatgttgctgaagcacaggccccagttgctgaggaggacgacgacgatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatggccaagctcgaggaagctgtt

SEQ ID NO: 70975 - DNA, 421 bp, Zea mays
  Clone ID: LIB3078-019-Q1-K1-E6
gagcttcttaactcatacttacgtgactagcctccagacagacagagataactagggtgagtgcacttgagagacagctgctccctcagccaagtatataaacctaccacggcggttaaatcacattcatgccctcgtgaggctgaccggaattactgcacatgcccaatgtgtgaaggtcgaatcgtcagcaggtccttcagccccaactgcagatgttgctgaagcacatgccccagatgctcaggacgacgactactatgatgttgacctttttggtgaggagaccgtatatcaaaagaatgctgcttaatagcgtgctgtagctgacaaggcttctggcaagaagaaagaatctgggaagtcatcagttctacttgatgtgaatccatgggacgatgagactgacatggccaaactt

SEQ ID NO: 70976 - DNA, 347 bp, Zea mays
  Clone ID: LIB3078-019-Q1-K1-E7
cgcaagttcatgaccaaccgactgctgtccctcatacaatttgagcttgaggttatgcacgggggcttcgccaacgtctgcaaggtggagcagaaggataggcttgccaagatgtacgaagcgcatgactccaacaccatcgctgactcaagttactgaccaacttctgtggatgcaagtcgactgagcttcacctcatttactattaccttcagtctgccaagaagatcaagcccaaatatcctgatgatcacgaatggtattgctacgaacgttgagaagatccgaacgcatatgatagtacggatgatcaagaccaagatgatccttggagtgattatgaccaa

SEQ ID NO: 70977 - DNA, 386 bp, Zea mays
  Clone ID: LIB3078-019-Q1-K1-E8
gttgaggccatgacctgcggcctgcccacgtttgccacagcctacggcggtccgggggaggtcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctaaccggcgtgtacgggttctggaagtacgtgtccgacctgtataggcacgagacccggcggtacctgtagatgctcgacgcgctcaagttccgcaccatggcgagcaccgagccgatggccgtggagggagagcc

SEQ ID NO: 70978 - DNA, 412 bp, Zea mays
  Clone ID: LIB3078-019-Q1-K1-E9
atctgtttacccgcctacctcggtgccaccttcgcaaggttgcaccggccgtccgctacgtttgcaagaatcatgggctcacttattctgcagccacattctggggtgcaaatgtgcttacatggaagacactcagggctgctgcattgcaggccaggaccgctacaagtggtggtgctccgaagaatttggtatgggaggctgtgaacacccatggataaatgggatgaagatacgggctaatggcaacttctggtgttcagcttggtgcccatgtgattgtctggatgcctttcagttatttagagatattgatcattcaacctgcctgagtcaagctggaattttcgtgttgacaagtggctgtctatccagttggagaattcatgcttcaatagtctggttgttcacg

SEQ ID NO: 70979 - DNA, 438 bp, Zea mays
  Clone ID: LIB3078-019-Q1-K1-F1
gggatctacgggtaccccagggacaagaagagcaagaacggcaagctgcggcttctctacgagtgcgcccccatgagcttcatcgtcgagcaggccggtggcaagggctctgacggccaccagagaattcttgacatcacacctacagagatccaccaaagagtgcctctgtacattgggagcgtggaggaagtggacaaggtggagaaattcctggcttgaatgtccctgcttcatgccagagctctctcatcagatggactccccaagacatcaagtttagggagggaatatgtactctctctttcccaccccatataagtcttcttcgtctcatatttcgataaatcaaacaatcttaattttgacctaatatatacacacaacattaatatttatagtattagaataaaatattactagattgatcatatcata

SEQ ID NO: 70980 - DNA, 188 bp, Zea mays
  Clone ID: LIB3078-019-Q1-K1-F10
acgcccacgcgttcggcgaggtgcgccgacagcacgatgaataacatgaaggctgatgccgtgttcaagggtcttcaagtggcgatcaaatgccagaacagcaaccgcgagtactagacaaaagccgtgagtgagatccaaagctacagagccttcagcgtgccactcttcggcgacctacacggagc

SEQ ID NO: 70981 - DNA, 396 bp, Zea mays
  unsure at all n locations
  Clone ID: LIB3078-019-Q1-K1-F11
gcactcgttcgcccacgcgttcggcgaggtgcgcctacagctcgatgaataacatgaaggctgatgccgggggtaggggtcttcatgtggcgatcaagtgcaagaacagcaacggcgagtacgagacaaaggccgtgagtgagatccaaagctccggagccttcagcgtcccactctccggcgacctccacggcgccgactgccacgctcatcttcacagcgccgccaataactcgccttgccctgggcaggagccgtacaggatcgcgcccatgtcaggcggcaccttcttcgccgtgcctggcaagatgcactacccgtacgcggagtgcgcgtacgcgtttctctgcttcccgatcaagaagcacttgttagatcacttncacaaagcacccc

SEQ ID NO: 70982 - DNA, 262 bp, Zea mays
  Clone ID: LIB3078-019-Q1-K1-F12
cttcggcgccacgcccggcgggctctgcgcattccctcgatacaaacgctctaaaccggatagcaacaatcaactggaggctcacacactcaccattgtccatacctccgtagataaccgccatgtttgcatacacatgatttacaacgcatttgaccgaaatatctgctgtaacacacggcagagcaattctctacaacgctatatgggacgaactccatagcactgttcatgctgtgcaccatatgactaccaaaacgcc

SEQ ID NO: 70983 - DNA, 422 bp, Zea mays
  Clone ID: LIB3078-019-Q1-K1-D7
ggccggtattttgtcttcaggagcttggcattactgcactgcacattaagcttcgtgccagcggaggcaacaagaccaagacccccggacctggtgcccagtctgccctcagggcgcttgcccgttccgggatgaaaatcggacgcattgaggacgttaccccggtccccacggacagcactcgcagaaagggcggtaggaggggaaggaggctgtaggcgtctcttctgcgtgccgtttgctggctcttggcgggtggccatcatgaagctagtcctctcttggtggtgttgctgttttctgtgtttgtcaagacgagctttaattttgctctatgtggatgaccgtttgccgttagtcgaacctgtatgatgttgcatggataatgttttttggctcaggaattggctcgtcatatttct

SEQ ID NO: 70984 - DNA, 151 bp, Zea mays
  Clone ID: LIB3078-019-Q1-K1-C10
cggactcgtgggtggccagatgattagagagctgaaaatatgttaagaacaataccatagagagaagttcctcagtgctctcgcagcttaaggagcaaacagcaacactttacttcgttttttatactttattatagccgcactgtttatt

SEQ ID NO: 70985 - DNA, 306 bp, Zea mays
  Clone ID: LIB3078-019-Q1-K1-C11
tctgaacaaattgatgaagagacgagcctctaatttcaagggagctgatcgattgactcgtctggaaatttttcttcttggtgctgttgccaaacttggtgcaaccgttgttacttatccccttctagttgttaaggcaagacttcaggcaaagcacatgattaacgatgacaagaggcattgttacaaacgtacacttgatgcgttcacaaagatggtacgatatgagggtctgtcaaggatgtacaaatgaatgggcacacaaattgtgcaaagtgtttttgcttctgctttgctttttatgat

SEQ ID NO: 70986 - DNA, 237 bp, Zea mays
  Clone ID: LIB3078-019-Q1-K1-C12
cgcgagcgatccgctggacacccgcgacagcctggtggagacgctgaccaccatcatgtgggtcacctccggccagcactcggccgtcaacttcgggcagtaccacttcgccggctacttccccaaccggccgaccaccatccggaagaacatgccggtggaagaaggcgggccgggcgaggagaaggagaagttcctcaagcaaccggagacgacgctgctggacatgctgcccac

SEQ ID NO: 70987 - DNA, 156 bp, Zea mays
  Clone ID: LIB3078-019-Q1-K1-C2
cccacgcgtccggccgaaccctggtggctctggtagtgggcgttctggggtgagtgggggtgaccggagcaacaatggccataacaccagctctggtagctatgatggtagaagtgatggtggcaggtacggccaagcacagcagggtaatggtgc

SEQ ID NO: 70988 - DNA, 368 bp, Zea mays
  Clone ID: LIB3078-019-Q1-K1-C4
attgagtttaaatgagttgccaacctttccatattcagcttaagaatttgggttgaaatgatcagggcatgcaacttaataatatatttaatgctttgacattcattatttgcttctataacaacagcacacatctgtgagcccggataagaaacttttggctgtggttggagatgatcgggatgctcttcttgtggattcacggaatggaaaggtaacctctaccctagttggccatctggactactcatttgctacggcatggcacccggatagccggacctttgcgaccgggaaccaagacaaaacctgccgtatctgggacacccgcaacttgtcgacctcgcttgcggtattgcggggcaaca

SEQ ID NO: 70989 - DNA, 212 bp, Zea mays
  Clone ID: LIB3078-019-Q1-K1-C5
acggcatctcatgaggtacgataaataatcgcgtgatgtggaagacgagccaagtcgggcccgggcacgggctaatccgcaggatgatgctgatggacgaacatgcctgatcaagtgcaaggacatagatgatcgtcaagtggacatcgcctaacaaatactaacctagtgttattcaggttataggtacagtgctgctgctgatggggtta

SEQ ID NO: 70990 - DNA, 409 bp, Zea mays
  Clone ID: LIB3078-019-Q1-K1-C6
gttacaacgaagagtgggaggaggaaggagattattataacagagggcgcgggagagggcggctacgtggacgaggtgggagagggcgtggtggctactacggaggtgggaggcgtggtggctacggttatgattatggctatgcccccagaggcgggtactatgaagagcaagacgaatactatgatgagcccgaggaatatgctcctccccctggccgcggacgtggcagagggagaaggggcggcatgccttggcgtgggcgtggaggccgcgggccaccgcgcggtggccgagggaactactactaggcgcgagaaatgcgacgtgccgaatgcgtgtgcttattaagtatctgttagcgtttgctgcagtgctcttctatggagctccgaccccggactggaat

SEQ ID NO: 70991 - DNA, 438 bp, Zea mays
  Clone ID: LIB3078-019-Q1-K1-C8
cccacgcgtccggcgcgtcaggctctacgtccggggcaccatccttggatacaagaggtccaagtcgaaccagtacgagaccacgtctctcgtgcagatcgagggggtgaacaccaaggaggatgtcgcgtggtacgctggcaagcgcatggcgtacatctacaaggccaagaccaagagcaatgagacccgctacaggtgcatctggggtaaggtcacccgtccgcacggaaactcgggcgtcgtccgtgccaagttcaagtccaacctcccgcctgagtccatggggcgcaaggtcagagtgttcatgtacccgagcagcatctaaagttttggtggagtaaagatggactagaaatggccatgtgtttatttctcacttttctctgaacttaaaatgccttgtgttggtaacttagattgttcaagtgctgaacc

SEQ ID NO: 70992 - DNA, 448 bp, Zea mays
  Clone ID: LIB3078-019-Q1-K1-C9
aaaagttgtcagactgtgctcatggcacatctgctctaccttgttagggccatttcccggattgtgcctcacctagctgaggatgtctggcagaacctaccctttcaatacaccttgcaggatggatcccttgcaaactttgtttttgatctgaaatggccagaaaagaatgaagaatggctctcggccccgaaggatgatgttgatttcctgggtgttatcctggagttgaggtcagaggtcaacaaaattttggagaatgctcgcactggaaagttgattggttctagcttagatgcaaaggtttatctccataccgaaagttcagatacggtattaaagctaaaggagctatcttctgcatccaatgatgcagacgctctgcatcgcctgtttatcacatctcaggtcgatattcttccaatcctaaatgaagagattacatcat

SEQ ID NO: 70993 - DNA, 424 bp, Zea mays
  unsure at all n locations
  Clone ID: LIB3078-019-Q1-K1-D1
cccacgcgtccgcccacgcgtccgcccacgcgtccgcaaaggcagcacactcagctatccagcaggggagatcgagacgcaggagtcatggccaccgtcagcgccgccgtggtgaccaccatcgttgcccgcgccgcgatcgccaggcccaatgctctagggctgcctgcgctgagggcgaggagcgagagggtgcggtgcagctacgccaaggacgcggtcccagtcagcaccaagggcgcatgcgcgtcgctgctcgccgcagcgggcgcggtgaccgcgtcggcggtgcccgcgctggcgctcgtggacgagcgcatgttcacggagggcaccgggctgagcctcgggctcagcaacaacctgctggggtggatcctnctgggggtcttcggcctcatctgggtcctctacaccatctaca

SEQ ID NO: 70994 - DNA, 196 bp, Zea mays
  Clone ID: LIB3078-019-Q1-K1-D10
tcgcccacgcgttcggacgacttgtttcattgattcttgaagagatcgagcttcttttgcacgacagggtcgaggatgtcttgcaactgcggatcaagctgcggctgcggctcaagctgcaagtgcggcaagaagtaccctgacctggaggagacgagcaccgtcgcgcatgccaccgtcgtcctcggcgtggccc

SEQ ID NO: 70995 - DNA, 414 bp, Zea mays
  Clone ID: LIB3078-019-Q1-K1-D11
agaacaatcctgattgtactactgtatatgttggcaacctcggccatgatgttaaccgcgatgggcttcaccgtcacttgtataacttggtggtcgtggcgatcgaggaggtccttgttcagcaggacaaagggtttggattcgtgagatataacacccacggggaagcagcactcgctattcagatgtccaatgggtcggtagtccgcgggaaaccaatcaagtgctcatggggtgtcaaaccaactccaccggggacaggctccaagcccctacccccttcagccgcaacgtaccagcccgctgtggcaatgccaggcgtccctcaaggtttcacgacagcaaaactccttgcctaccagaggcatcttgccctgagccaagccgcggccggtcaatagcatgctggtcttg

SEQ ID NO: 70996 - DNA, 240 bp, Zea mays
  Clone ID: LIB3078-019-Q1-K1-D12
gtccagcgcgtgttggcaaccgtggtgacgctgcagttcttccagcaggcgtcaggcatggactgggtggtgctgtacggcccgcgcgttctcgccatggctggtgtcacatccaacagcttgctcctgagcctcaacatcctcttcggcgttgccaaggttggctacatcctcatcgtcatggctctagccgaccgcgtcggacggcgcccactcctgctggtcagcacttagcgcatg

SEQ ID NO: 70997 - DNA, 435 bp, Zea mays
  unsure at all n locations
  Clone ID: LIB3078-019-Q1-K1-D2
cccacgcgtccgcccacgcgtccgcaggaagcaaaggaaccaccgaggatcagatggacgtggacagcgggaatggagagggtggagttgtaagccctgtcccaccagcaccagacactgaanggggtaatgacgaagtatcggttcaagagatcagtgaagcccagcccttgccttgaagacggcgctcctttcccttaaagctccgctttcttctcccgcacctggcgatcttcacgatgttgttgttgcacaacaagtccggactgagtatttcctatttggttctatttctagtgcactataatatcacaagcgaagctacaattgggtgtgagctatattggcatatccttccctttgttgtattcccttgaacaatgaatcataacaactgtttaccatttttctaaaggatcgactggttatgtactc

SEQ ID NO: 70998 - DNA, 438 bp, Zea mays
  Clone ID: LIB3078-019-Q1-K1-D3
cggacgcgtggggcgccggccgccgtcgtcgcggcgcccggggcggccggcggggccgcggccgaggaggaggcccccgtcgagaagacggagttcgacgtgatgatcgaagaggtgcccagcagcgcgcgtatcgccactatcaaggtggtgcgcgcgctcaccagcctcgcgctcaaggaggccaaggaccttatcgagggtctccccaagaaggtcaaagaggccgtcagcaaggacgaggccgaggacgccaagaagcagctcgaggaggtcggcgccaaggtgtctatcgcgtgacactaggtatacgagtactccttttttttctttagtttcttttggttgcatccccaatctcttgtatccccactgttgttcgtaaggaattgctgtttcatgatatgagatttgtgtatgtgtcgattcactagcttg

SEQ ID NO: 70999 - DNA, 434 bp, Zea mays
  Clone ID: LIB3078-019-Q1-K1-D5
aaggaagcaatccgacgtgatgcggttcgttcaacgcgtgcgctgttgggagtacaggcaggagccggccatcgtccgcctcacaaggcccacccgccccgacaaggcccgccgcctcggcttcaaggccaagcaggggtatgttgtttaccgcgtccgtgtgaggcgtggtggcaggaagaggcctgtgccgaagggtattgtctatggcaagcccaagcaccagggtatcacccagctcaagttccagaggaacaagagatctgttgctgaggaacgggctggacgaaagcttggtggactcagggttctcaactcctactgggtgaatgaggatagcacctacaagtactttgagatcatcctggttgatgtggcccacactgccatccgcaacgacccaagaatcaactggctatgcaatcctgtgcaca

SEQ ID NO: 71000 - DNA, 427 bp, Zea mays
  Clone ID: LIB3078-019-Q1-K1-B8
cttctcctcgccgtcgcgtgagactgcgctaaaacctaggctttgagacaccaatggcctgggcgacggcgacggcgcccacattcgctctcgcatcgtccttctcgcgcggcggcttccttccgctccctcgtcacgccggccggcccatgcttcagtctctgcgactcgtcgcgtcagccgtgaagcggcggcgcggcgcggtcgtggtggcagcggacgcggcggcggcggccgggagcgcggagttcggcgacgaggagaacccgtatgagcttctgggcatcatgccgcttgatagcttcgatcacatgaaaatggcctacaagaagaagcgcaaggacgccgaagagactggagacgacgagttccttgccaagttggacagggcctatgacactgtcatgatgcagcagctgcagtatcg

SEQ ID NO: 71001 - DNA, 439 bp, Zea mays
  Clone ID: LIB3078-019-Q1-K1-D6
cggacgcgtgggcggacgcgtgggttcgtccctgccggctccgggaacgccggcggcgggagctacgcgaaggacaagctgggcaacgacatcacggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaacggcgctgagaacaagttcatctgcccctgccacggatcccagtacaacaaccagggcaaggtggtccgtggaccggcgcctctgtcgctggccctggttcacgccgacgtcgacgacggcaaggtcctcttcgtcccgtgcgtggagaccgacttcaggaccggcgaggacccaatggtggagg

SEQ ID NO: 71002 - DNA, 277 bp, Zea mays
  Clone ID: LIB3078-019-Q1-K1-A10
gtggatcgtggaggagcgcgccgacggcaccaacgtccacaactggcactgggcggagcgcgagtgcctggagtggtcccgcgcgcggctctcttccctgctcgcgggcctcaccatcctcgacggcgagggcggcctcagtctccgcaccgtcgcgctcgacaagcttgatggcgaggcctacgtcaacatccgcaagggcaaggtcatcccggggtacgagctctcgctcaccctctcctgggaggccgaggcccgctcggagtccggagctgcg

SEQ ID NO: 71003 - DNA, 441 bp, Zea mays
  unsure at all n locations
  Clone ID: LIB3078-019-Q1-K1-A11
cccacgcgttcgggcgtcatcgcagggcggttgtcggggcgccggtggaaggagccccggaccgggcggtcgtcggccgtggcggtgtctcggaagccgatcccgctggaacagcgcgttcgggagaagtctctgaagcgcgcgtaccaggcccgcaaggcggagctcaaggaggagatccggcagaacaaggttgcgaagcggaaggcccgcgaggagcgggagaagcggaagcaggagaacgtgctccgcacgggcaccaagctgcagcgggtcaccaacccgaagacgatccagaagatcgccaagtccaagaagcgcangcagctcaaggtcgtcccctacgagttcttcggcggcnagaggtcggaggccatccggcgcatgcaggtgcctggacttgagaattgaatctcaattctcaatctctggttctggggt

SEQ ID NO: 71004 - DNA, 274 bp, Zea mays
  Clone ID: LIB3078-019-Q1-K1-A12
gtaccacaccactccgcgctagctgaggactggacagcggcacagaggtgcgacgtacgaggacgacgactcatgcgccacacatggcatcccaactctacgccgccgtgccacggttccacggactacggtgctacgccgcgcccagatccgcggtggcagcgctgccgtccgtgaaggtcggcaagaagaggtcgtcgtcgcaaggcatccgctgcgactacatcggctccgccaccaacctgatcatggtgacgacgacgacgctgatgct

SEQ ID NO: 71005 - DNA, 405 bp, Zea mays
  Clone ID: LIB3078-019-Q1-K1-A2
cttcgcccactcgctccagccgcttcaccgcgccgtcaccgccaccgcgaggatgccgttcaggaggttcgtggagatcgggcgcgtggccctggtgaactacggtgaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtcctcaagaagacagccctgatcaaggcgatggaagaagctgatgtgaagaccaagtgggagaacagctcatggggcaagaagcttattgtccagaagaggatagcatcgttcaatgactttgataggttcaaagtcatgctggcgaagatttagaaggg

SEQ ID NO: 71006 - DNA, 440 bp, Zea mays
  Clone ID: LIB3078-019-Q1-K1-A3
gtcgctcgaggccttcatgggcaaccctaccctgaagcgcggcgacgataagtggctgggctgggggttcaagctgattgattctgtggattcctacattccagtgccacagcggcagaccgacctcccgttcttactcgctgttgaagatgtcttctccatcaccggtcgtggtacagttgccactggccgtatcgagcgtggcaccgtcaagattggtgacacagtcgatatcgttggaatccgggacacccggaactgcaccgtgactggcgttgagatgttccagaagaccatggacgatgccatggctggagacaatgtcggactgctgctccgtggtatgcagaaggatgacattgagagaggcatggtgctggcaaagcccggctctatcacaccggacaccaagattgaggctgttgtgtatgtgcttaaaa

SEQ ID NO: 71007 - DNA, 362 bp, Zea mays
  unsure at all n locations
  Clone ID: LIB3078-019-Q1-K1-A4
gggcggttcgggctggcgccgtccgcgaaccgcaaggcgacggcggggctgaagctggaggcgcgcgactccggcctgcagacgggtgaccccgccgggttcaccctcgccgacacgctggcctgcggcgccgtcggccacatcctcggcgtcggcatcgtgctcgggctcaagaacaccggcgccctcgaccagatcatcggctagatccctacgtcgccgttgttaagatcagactcagcagcctcgatcgcgccgncggccggcaggtgcaggtggtgactttgtaacgtgtgtgcgtgcgtacgtgtacattgcatccatcttggttccaatggacatatagctcctgttgctcctct

SEQ ID NO: 71008 - DNA, 435 bp, Zea mays
  Clone ID: LIB3078-019-Q1-K1-A5
ggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgtcggcgtcaccggacctcctgccgatcaagaagggacctcaggagccgccgcagccgggcccgcgcggcaagatctaagctcagcttctccatttgcatggtctagtagcttgctttgtactgctagcgccggtcgatccgtcgcaatcgtcatgga

SEQ ID NO: 71009 - DNA, 436 bp, Zea mays
  Clone ID: LIB3078-019-Q1-K1-A6
cgatcttcggcggcagcacgggcgggctgctccgcaaggcgcaggtggaggagttctacgtgatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagtacaagatcacctaccagttctaccgcgtcttccccaacggcgaggtgcagtacctacaccccaaggacggcgtctacccggagaaggtcaaccccggcagggagggcgtcggccagaacttccgcagcatcggcaagaacgtcaaccccatcgacgtcaagttcaccggcaaggccaccttcgactaatcacatttcacgtacgccgcacgccccagccgggatccaaattaaag

SEQ ID NO: 71010 - DNA, 372 bp, Zea mays
  Clone ID: LIB3078-019-Q1-K1-A7
gcagcttggcgctgatattattcaaaaggcattggtagcacctgcttcattgattgcacacgatgctgtagtcgagggtgaagtggctgtcgagaagatcaaggagagcgattgccagcgtggctacaatgcaatgactgacatgtacgataacctgatggaggctggtgtgatcgaccctgccaaggtgaccagctgtgcgctgcacaatgcggactcattccctggaatggtcctaaccacgcaggccatcgttgatgagaagcccaagccgtagcctcaagtggcagagccaccggagggagcccttaccgtttaatacttaacgttcttgaggctggtgtacagactggtcagatctgttagcagggt

SEQ ID NO: 71011 - DNA, 221 bp, Zea mays
  Clone ID: LIB3078-019-Q1-K1-B10
tcgcgcacgctttgtgcgtccaccttcgatcgtcactctacacgactataactgtcatacgcggctggctcatataagatgtcccccctcgcgtcatattttgcactgccagagtctgtgcttcacaagcgcatacgcaatgatcattgttccaccggaaataaagcaaaagccttattctagactaagaagtccatcgctagccggatgattatctatac

SEQ ID NO: 71012 - DNA, 429 bp, Zea mays
  unsure at all n locations
  Clone ID: LIB3078-019-Q1-K1-B11
aaggccgcatccagctttagagccatgcctctgtcactgccttttcaaaacggacatccgcagggtgctagtcttactcagagagacatgaatctagaaaggcgccctgcaaagttgactaagccgacaggcaaggatcccccataaaacaagaacaagtcgggcctaaaggatctcccagatgacaagagcaaatcatgggatgcggatgcatccttctcgttgttccaattcaacttgccaatagcttcgcctgtaacaccatcatcaaaagataagagcggagagctggccgcaaggacgccactggctcaggtgcaagctcagctttgctcgagggaacaagcagatgtcaaggagtatagcctgttctcctcgaaagataatggcatattttcngttatgtagataaaagaaaaactgtgacaa

SEQ ID NO: 71013 - DNA, 403 bp, Zea mays
  Clone ID: LIB3078-019-Q1-K1-B12
attggtagaagttattctcgagcattacggttttgaagctgatgaagcggcggtcacatgtttggtttgtctggttccagttgctttggatgtgtacataaaattttgggtatacaaataccttccaaggttatcacccagtgtgggcaacgttctggatgaaataaagcgtcattagagattttttgccttagaaattcactatgatctgcagcaattcactcctcgatgtccagagctgttagaactgaaacctgtcaacatcttgaaggcttcagaaaatagaggcaaacagagttgcaaggtcctgaaaccgagacgtcctatcaatttatgttgataggcctatggtggtattatatagtgatgggtatttttcaccgactccaccggtggagtttac

SEQ ID NO: 71014 - DNA, 244 bp, Zea mays
  Clone ID: LIB3078-019-Q1-K1-B3
cccacgcgtccgacggcgcacaaggagcagctggaggcccgcgtcgcgcgcatgaaggaggacccggcgctcaagcccattctcgacgagatcgagtccggcggccccgccgccatgatgaagtactggaacgaccctgaggctctgcagaagttcggccgcgcgatgggcgtcggcttctgcccgttcggcaaggcctgcttgctcatagcacgcctattctgtttcgactctcggataggat

SEQ ID NO: 71015 - DNA, 170 bp, Zea mays
  Clone ID: LIB3078-019-Q1-K1-B4
cccacccgtccgctggaaacttaactcgggtccggttccctggtgataatattcagcgatgcttcgcgagggcaccgttcccctgcgcgctcgctggacgccgtcgcacatgctccctgctcggcctccccggcgtgctgctccctcgccttggtgcccctgcgagctcc

SEQ ID NO: 71016 - DNA, 436 bp, Zea mays
  Clone ID: LIB3078-019-Q1-K1-B5
catcaagaagcctcataagatccactctagatcccgtgcaagaagggcacatgacgccaagcaaaagggacgccactcaggatatggtaagcgtaggggtaccagggaggctaggctacccaccaaggttctgtggatgaggaggatgcgtgtgctgaggcgccttctccgcaagtatcgtgaggccaagaagattgacaagcacatgtatcatgacatgtacatgaaggtcaaaggtaacgccttcaagaacaagagggtgcttatggagagtatccacaagtccaaggctgagaaggccagagagaagacactttctgaccagtttgaggccaagcgcgccaagagcaaggcgagccgtgagaggaagatcgctaggagggaggagaggttggcccatggtccacgagaaataacaccacctgtctcatccaca

SEQ ID NO: 71017 - DNA, 435 bp, Zea mays
  Clone ID: LIB3078-019-Q1-K1-B7
gtggaaagcaagaactgccttgtggttgaggatagtgttatcggattacaggctgcaaaaggagcagggatgtcatgtataataacatatacaccttcaactgctagccaagatttcaaggatgcaattgctacctatcctgaccttaataatgtcaggcttgaggacctcaagctattactccagaaaactcttgttactggatagcaaagtgtcttgttttcccccaaagaatacattgaaaattttcttgatgcatgataatccacgctattattccctggacgttgaacagttggtgctgggtgttgaacagtagatgaatccaaacatacatcttgttgaacaattggtgctggatggtggaagacatgattactcagatagataattaatgcaactagaaagatagatagttacgattgttaaaacttt

SEQ ID NO: 71018 - DNA, 312 bp, Zea mays
  Clone ID: LIB3078-019-Q1-K1-A1
gatgagctgaccagcctcaaggactacgtgaccaggatgaaggagggacagaatgacataggctatagcactggtgagagcaagaaggcagtggagaactcccccttccttgagaagctgaagaagaggggctatgaggttctgtacatggttgatgccattgacgagtatgctgttggtcagctcaaggagtttgagggcaagaagcttgtctctgccaccaaggagggtctgaagcctgatgagactgaggacgagaagaagaggaaggaagagctgaaggagaagtttgaggggctttgcaaggtcatc

SEQ ID NO: 71019 - DNA, 418 bp, Zea mays
  unsure at all n locations
  Clone ID: LIB3078-022-Q1-K1-F2
ggagaagatgacccaaattatgtttgagactttcaatgttcctgccatgtatgttgcaatccaagcggtgctctcactctatgctagtgggcgtactactggtattgtactcgactctggtgatggtgtgagccacactgtgcccatttacgaaggatatgcccttcctcatgccattcttcgtttggatcttgctggtcgggacctcacagactccctcatgaaaattctcactgagaggggttactccttcacaacctcagccgagcgagaaattgtaagggacatcaaggagaagctagcatatatagcccttgactatgagcaagagttggaaactgccaagaacagctcttcagttgaaaagagctatgagctacctgatggacaagtaatcaccattggtgcanagagattc

SEQ ID NO: 71020 - DNA, 441 bp, Zea mays
  unsure at all n locations
  Clone ID: LIB3078-022-Q1-K1-F5
cccacgcgtccgggttttcgcgccgccgccgccgccgccgccgcagccgcaacaatgccggcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttccttctgttgtatcaatgtgtcagtttttctgtaagctagcaagtgttgctatgacgctnntattaagattctggtgagcggtgatgttaagagaaaaatggcactactgtggtgtaccccaagattccttgcagcattgctatgctaagtaaagaaccctntatctntatatatat

SEQ ID NO: 71021 - DNA, 386 bp, Zea mays
  Clone ID: LIB3078-022-Q1-K1-F6
ctttgataaatatggcagggtcgcatatgtaagaatcaagaagaactttgactttatcgggtttgagatacaggacgatgctacaagagcattggagggtactaatggaagccatttcatggacagggtgatctctgatgagtatgcacttcgtgatgacgatgaataacgtgatagaggtaacgtgtacagcccatacaggagaggtagtgaaagatccgcaggtcgaaagcgatcttctagtccctacggtggaggaccggagagaggtagcccagattactggagaagcaaggagagggggagcccatactatggctggagaagacgcagtcctgataatggcaatggagtaagctcatctggtcgtagcagaggcgatcatg

SEQ ID NO: 71022 - DNA, 452 bp, Zea mays
  Clone ID: LIB3078-022-Q1-K1-F7
cccacgcgtccggcgggatcgagactacgtcgacctcggtgggagctgaggccgtcaccgggcaggtcacggaggtcaacaaggacaccttctggcccatcgtcgaggccgccggcgacaaggtcgtcgtcctcgacatgtacaccgaatggtgcgggccttgcaaagtgatggctcccaagttccaggagatgtccgagaagaacctggacgtcgtgttcctcaagctggactgcaaccaggacaacaagcctctcgcgaaggagctgggcataaaggttgtgccgacgttcaagatcctcaagggcgggaaggtcgtgaaggaggtcaccggcgccaagatcgacgagctagcggaagccatcgagatagccaacaagaagtcaggctgacaaaggaatagcaagatcgacgtgcagtgcaagcaaggatgaatggatgatcgatgaact

SEQ ID NO: 71023 - DNA, 438 bp, Zea mays
  Clone ID: LIB3078-022-Q1-K1-F8
gattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataagtattgtgtggcgtgtgtgagagagagagaaacagagttcttcagtttgctatctctctctgcat

SEQ ID NO: 71024 - DNA, 287 bp, Zea mays
  Clone ID: LIB3078-022-Q1-K1-F9
cggactcattgcttcactcacacgtcactttcttaatcagacatacaagcctctcatcaggggtcatttagatggttacatcatatctaacatactcctacaagcacagctacttccatggctcacatatattatcaccttaatccagttacacacaccatactaccagacactactggctcacaatataaccataccactacatccaatacagctatcaatactcactatatcactacacatacttcaattatccaagatacaatcaacatctaccactattctat

SEQ ID NO: 71025 - DNA, 475 bp, Zea mays
  Clone ID: LIB3078-022-Q1-K1-G10
atcacgaggaggcaggggagcagcatccacaaccacaagccatggcggggagggccaacagccccactaacaactccgccctcatcgcaatcatcgccgacgaggacaccgtcactggcttcttgatggccggcgttggcaatgttgatctgcgcaagaaaaccaactacctcctcgtcgacaacaagacgacagttaaacaaatcgaggatgcgttcaaagaatttactacgagggaggatattgctattgtgctcatcagtcagtatattgccaacatgataaggtttctggtggatagctacaacaagcccgtccctgctattctggagatcccatccaaggaccatccatatgatccagcgcacgactctgtgctctctcgagtgaaatatctgttctctgcagaatcggtggcgtctgataggcgatgaaggcatccttgcgtagcagtacccttcgatgcatctatttt

SEQ ID NO: 71026 - DNA, 238 bp, Zea mays
  Clone ID: LIB3078-022-Q1-K1-G11
agtacatcctcctctactctcgaaacctttctgtagactacctctactgtcaacacaccggcgacttccagggcaagattactgcgaccaccggcctatatctaaactacatttctagatctttacacctactctgatggcgactgatcaaactatcgagaactacaccatgcaaaaccataatgactataacctctacaacccctacatcgtcatctacatatataagtacttaact

SEQ ID NO: 71027 - DNA, 480 bp, Zea mays
  Clone ID: LIB3078-022-Q1-K1-G12
cccacgcgtccgaaagaatctctgaccggagtcctgccaggctgatagaatcctggcagggatggatatactgctaggttctgggagattcttggcgcgacagactcccctcatgctcgtccctcgctgctctcgaggctcccgggacagaagcggcagcgacaaacgtgaaacctctgctgactgggacaaggcatgggctaagttcaagaagaaagggaagaggaccctcttttctgatttctcaccagacaagtatgtgacctggaacccacggcgcagcgagtatccgttgtcagaagaggttgatccaatcaagagaactgaaagatctaacttgatgctttggacgagtccccagttcacgttggtgggggcgattatcatcgtcttgacattactaatctacacactagtcgttccttccaagtaactgcacaagtgacagctaggaagtgagttgtaaatcaatattatttc

SEQ ID NO: 71028 - DNA, 413 bp, Zea mays
  unsure at all n locations
  Clone ID: LIB3078-022-Q1-K1-G2
ctcgccgttcctccggagctccttcgtctcgtcctcctccacgtcgtccgcctccgcctcccccgcctcgctcacggcggctgtctcggcgtctctggcatttacgtcctcctcctcgtttgcgggttcatctttgggaatcgagttcagctacagtataatgacaacgcggagatcccgtggtatgcagattagggctggaaaggctgccctctgcatgaccaagaggtcaaggtctaggaagtcacttgcccgtacacatggtttccgcaggcggatgcggactacttctggaaggaaggtactgaagcgcangcgcgccaaaggcaggaaggttctttgcacaaggacaaactcaaacagtgggaagaaaagaatgttctaattacactgcaatttgatgtgctcgcaac

SEQ ID NO: 71029 - DNA, 388 bp, Zea mays
  unsure at all n locations
  Clone ID: LIB3078-022-Q1-K1-G3
cacaaggttcgagttcgtcaccgtctagtacgactgtgcgagggaggaagaggcgaggagaagatgcagatcttcgtgaagaccctgacggggaagaccatcaccctcgaggtggagagcagcgacaccgtcgacaacgtcaaggccaaaatccaggacaaggaagggattcccccagatcaacagcgactgatattcgctggcaagcagctggaggatggacgcacgctggctgactacaacatccaaaaggagtcaactcttcatttggtcctcaggcttangggtggaaccatgatcaaggtcaaaactctcactgggaaagagatcgagatcgacattgaacccactgactcgattgacaggatcaaggagcgtgttgaagaga

SEQ ID NO: 71030 - DNA, 433 bp, Zea mays
  Clone ID: LIB3078-022-Q1-K1-G4
cccacgcgtccgcaggacgcttccccgccgagtgcttctcaacgcagttggcgaatccggcatggttgcttctggtgacacattgcttggtttgtatgagaaagaacggttaggcctgttgcagtatgccgacgatgagtctaaagaagagaggtactgggaaaccttggatgctgatttgcgttactggaccagatccctgcgcccagtgcagtggtatcctggtcatattgcaaaaacagagaaagaattgaaggaacaattgaggctcatggatgtcgtcatagagatccgtgatgctaggattcccttgtccaccagccatcctaagatggactcatggctaggcaaccggaaaaggatcatagtcttgaatcgcaaggacatgatctcaactgaggatatgaatgcatgggctacttactttggtaat

SEQ ID NO: 71031 - DNA, 250 bp, Zea mays
  Clone ID: LIB3078-022-Q1-K1-G5
cccacgcgtccgctttaatggcaattctgaatacgctgatcaccttgagcccgttaatggggtggaacctatgaaagctgccggtctactgcaccaccttgagactactgatgagggacaaaaagatctaactaagtcacagatacctgctcacggggcaattggtgcttacaggacagcttattatcaatcccatgcaccggcaggatgtcgcgctctgctctgtcgggataatctgcatacttatcgt

SEQ ID NO: 71032 - DNA, 432 bp, Zea mays
  Clone ID: LIB3078-022-Q1-K1-G6
aaaggcactaaatgcttctcggaacatgtttcctgctactgagctccagaggcagatctgctactctataatggacctaaccttgtttggcgagcaatcatccaagcctatggacacgatttccactgttgccgatttgagaaggaagcatacaagtgggaaatacgcagaaggcacacactggcatacacgatttactcatctcgtaacctacggtgctggctactatacctatctatatgctagatgttttgccacaactatatggcaagaagtatgccaagaagacccgttgtcccgcagtgcaggcagtgccatcagggacaaattcttgcggttcggcgggtcaaaggacccatcatccctgctgaaggattttgcaggtgatgccgtcattagaaactccgggagtggaataatcccgaacgctag

SEQ ID NO: 71033 - DNA, 401 bp, Zea mays
  Clone ID: LIB3078-022-Q1-K1-F12
cccacgcgtacgaccgtgctgaccaggacttctgacggcgactagggctgcaagcaccaggtcatcaccgggaccgtctccgacggcaagctctacatctgcaatgcgcaggccggctacaagcggtggttcaagggcgccaggaacggcgtcgagaaggccgccgcctacttcagcgtcgcgtgaccgacgtaaactattgtgtctttgatgcttctcatcacggatgcacatgcacgcaccgcgtgtacgtatagagctaggcatggcctggctcgacatgcttgttgcgtgtttctttgattgtacatgagaggacccgtttctgctgccatccaagctgtttgagaaatcttggtactaatattgcttcatctgttctgtttttaaaagaaaaatac

SEQ ID NO: 71034 - DNA, 232 bp, Zea mays
  Clone ID: LIB3078-022-Q1-K1-D8
agctgctgctgttgtgctctgttagtgttgtttaatttagtttaataccgtgtgggtgagatatggcacgcgttcttgctcaactacatcaccatggcaatgtctgcaaatccatggattgatggatggatgttggttgtttcttgacattctggacatgttgttcactttggctatgtatgttttaacagtccagcgttctccttacaaaatatggcgtgctttgttgact

SEQ ID NO: 71035 - DNA, 284 bp, Zea mays
  Clone ID: LIB3078-022-Q1-K1-D9
gcacgcctttagctcggtacttcctgcagtccatgctccgtcactcacaccttggcccgggttaaccttgggacggccagggcctaccagatcaccgcggtctccagcatgctactcccgcagaccttactatcaaacacgtcggcaacgccgcaagtactagggctcgtcttgtgattgcaccggctctgcttgcgctcttgccagtagagcatcactcacataatgacgcgctcatatacaagtgccacatctagatacacctacactgtcactacttgatc

SEQ ID NO: 71036 - DNA, 440 bp, Zea mays
  unsure at all n locations
  Clone ID: LIB3078-022-Q1-K1-E1
gacccacgcgtccgcccacgcgtccggccaggtggtgctcatgggcgccgtcgaggggtaccgcatcgccggtggcccgctcggggaggtggtcgacccgctgtaccccggcggcagcttcgacccgctcgggctcgccgacgacccggaggcgttcgcggagctcaaggtcaaggagatcaagaacggccgcctcgccatgttctccatgttcggcttcttcgtgcaggccatcgtcaccggcaagggtcccgttgagaacctcgccgaccacctcgctgaccctgtcaacaacaacgcctgggcctacgctaccaacttcgtccccggcaagtgagcgagggcatatacatacttgtatgcgtgtaccgtagacatacgtattcgtatatgtactgcangagatgtaccagtatttgtgaagaagggagcatgggctc

SEQ ID NO: 71037 - DNA, 429 bp, Zea mays
  unsure at all n locations
  Clone ID: LIB3078-022-Q1-K1-E10
cccacgcgtccggcggccggtctctgctttcagattcatttctaaccagggttcctccaggccagccgccggcactgttgaggagctcacatcgcctcgacacaacacggtctctggtttcaacgtataataactgggctgcgagcactatatggatgatggcttcacgaggcaccagtgccgtgctttcaagggctgctcggatgaggcaaaaactgcagtctgccttggaggccagtgccctagatattgaagacgtttcttaccaacatgccgggcatgcagccgtcaaggacaatgcgaacgagacgcacttcaacatcaaggttgtttcaccaaaatttgaggggcagaaccttgtgaagcgtcacaggatggtgtatgatcttctgagggatgagcttagctcaagcctncatgctgtctcca

SEQ ID NO: 71038 - DNA, 465 bp, Zea mays
  Clone ID: LIB3078-022-Q1-K1-E11
cacgcagctagctaggagcagcagcagcggcggcgatggcggcctccatgatctcctcggagctctggcggtggcgcctgagggcctgcacgccctcggccgccgcgcctcctccttcgccgtcgtctgctccaagaagaagatcaagaccgacaagccctacaggattgggggtggcctgaccgtcgacgtcgacgccaacgggagaaagggcaagggcaagggcgtgtaccagttcgtcgacaagtacggcgcgaacgtcgactgatacagcccaatctacaacgaggatgactggtctcccaccggcgacgtctacatcgagtgaaccactgggcttctgatctgggccgtcaccctcgctgggatcctcggcggcggcgccctcctcgtctacaacaccagcgcactctgcggctaatgatatccaatgcatgcgcttcttgcgattcgtcatgtaaaatc

SEQ ID NO: 71039 - DNA, 444 bp, Zea mays
  Clone ID: LIB3078-022-Q1-K1-E12
cgaagcgcgcacaaagagaagaacctcggtgctgagatggcacaagccatggcgtcgatgagaggcctctggcagggcgtgctgcccagcaggcgcgccgacagcagaaccaggacggccgtcgtcgtcgtcagggcgtccgcagagggcgacgccgttgcgcaagcgggccgccgcgccgtgatcgggcttgtggccactggcatcgtcggcggcgccttgtcgcacgcggcgcgcgccgagaccgtcaagaccatcaagattggagccccgccggcgccctccggtggactccccgggactctcaactctgaccaggcgagggacttcgacctccccttgaaagagcggttctacctgcagccgctgccgtcggcggaggcggctgctagggtaaagacatcggcgcacgacatcatcaacctcaagccgctcatcgacaag

SEQ ID NO: 71040 - DNA, 327 bp, Zea mays
  Clone ID: LIB3078-022-Q1-K1-E2
acagagctacctgactggcgatttactctgcgactacagctgtgacaccgcggggctgtcggcggaccactagacgttcagccaagaaccgtgatctggatgtgatccactatggctgggccatgctgggcgcgctcggctgcgtcttccacgagctgatcggccgcaacggcgtcaagttcggcgaggccacgtggttcaagggcggatctcagatcttcaacgagggccgactggactaccttgggaactccagcctcatacacgcgcagagcatccttgctatctgggcctgacaggtcgcgctcatgggctgatgactagggc

SEQ ID NO: 71041 - DNA, 441 bp, Zea mays
  Clone ID: LIB3078-022-Q1-K1-E3
ctcaactgttggacaatgggcacggatagagaatatgaccatcctgggcgaggatgttcatgtgtgtgacgaggtatacagcaatggcggtgttgttctcccacataaagagatcaagtcaagcattttgaagcctgagatcgtcatgtgagagttctccagttttaactacagtacattcttaagttcttcgactaagtgaggattgcagatccccttttataagtgatatctattggtatctttggcctaattcaaacagcttcagacatgttcgcttgctaaactgttgacgatgtatccttgttctttgttgaaaaagtttgtacttgtagtgtcaatcatatttcacaagtggttgtcatatatactgagggaggttttggacccttgatctacagaagttcaatacaatagtagcaggaataagttatttttttt

SEQ ID NO: 71042 - DNA, 450 bp, Zea mays
  Clone ID: LIB3078-022-Q1-K1-E4
attcttttccaagtttgggaaggttgtggagcatgaaatcatccgtgaccatgcaaccagccggtcacgtggatttggttttatagtctttgatgcagaaaaagcagtagatgatttattacataagaagggcaatatgattgatctaaatggttctcaggtggagatcaagaaggcagaaccaaagaaaccctctaaccaaccacctcgttcacttgatagtgagcctaggggccgtccatatgcagacagttatgatggatttggcagctcttacaattatggtggtagttttggtccctatagatcacctcgaagttttggcgctaggcctagcagctacagtagtgcttatggtcctggtgattatggtagtggctatgctacttatggtggagcattagtaggataccgtgaacctttcctttattctaatcgctatggtagcac

SEQ ID NO: 71043 - DNA, 58 bp, Zea mays
  Clone ID: LIB3078-022-Q1-K1-E5
tctgactcgtgcgaaaaaaaaaaaactaattaaaaaaaaaaaaaaaaaaaaaaaaata

SEQ ID NO: 71044 - DNA, 426 bp, Zea mays
  Clone ID: LIB3078-022-Q1-K1-E6
cgctgtgaatgcgcccatggtcccagctgagatcctgtcagagctggctccatatgtttgtctggccgagaagctcgggaggctggcggtgcagctcgtggccggcgagagcggcatcaagggcgtgaaggtggtgtacaccacagcgcgtggccccgacgacctggacactcggctcctccgcgcgatggtgaccaagggcctggtggagccggtgtccagcacgttcgtgaacctggtgaacgcggactacacggccaagcagcgcggcctccgcctcacggaggagcgcgtggcgcacgacagccccgcggcggaggcgccgctggagtccgtccaggttcgcctctcgcacgtgcagtccaagttcgcgggtgccatcagcgacggcggggacgacatcgtcctggagggccgggtcaagta

SEQ ID NO: 71045 - DNA, 405 bp, Zea mays
  Clone ID: LIB3078-022-Q1-K1-E7
cggacgcgtgggcggacgcgtgggtctagatgcgagcgccgccctttttttttttttttgcacggcagcaggcattatttgcaaaggttttcgactgttttcccggctgttgcagattgttgacagcaatacttttgttttggtaccgtatccagaactacaactaccacagtaaccaattcatgtgaaagacgtggacgcgagcaagcgaccaccccaacacgtaggaatatttggacaacaaaggcattcacacctgcgacacaccacacacaaattcatccctcacgatccgctacgagccccagggctgggacagggaggggctctcacaatatcacttcatctactgtgcaccccaggaacctgatggagctccccatgacttgctgggctgcgaattca

SEQ ID NO: 71046 - DNA, 469 bp, Zea mays
  Clone ID: LIB3078-022-Q1-K1-E9
gagcgaggcaggcaacccaccaccgagaggcagggacaggaacaggaagccggaggcgaggatgtcgtcggtgttcagcggcgatgagacggcccccttcttcggcttcctcggcgccgccgccgccctcgtcttctcatgcatgggcgccgcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcacggggatcaaccccaaggcgaagccctactacctctttgatggctacgcccacctttcgtccgggcttgcctgtggtctcgctgggcttgcagctggcatggccatcggcattgtcggtgatgctggagtcagggcgaatgcgcaacagccaaagcttttcgtcggcatgatcctc

SEQ ID NO: 71047 - DNA, 251 bp, Zea mays
  Clone ID: LIB3078-022-Q1-K1-F1
gaaggacttaccgtgttttcgcaccagagatttatagaaaatgcggcgagtagaccgtgagacaagtggatgcgtacgtgtgataggcgagatacatcgaaatttggacatgtaacattatcgtgaactgcgcaccgctcgggatactatgatgaaactgacgaagaacatgctcaagttgctacagacactggagatacacttaatggcgctcccagaataaacgcgcttcaaagcgctgaaaaagctag

SEQ ID NO: 71048 - DNA, 406 bp, Zea mays
  Clone ID: LIB3078-022-Q1-K1-F10
acgacgccttcctttacaccatgtacacataacaaatccttcaatgaagtactcacaatggctattataggggaatcttgcacaacatcgtgatgaacagaaaaataccggcaccactgcgtatatatccttttcactaaggtttgtaccggagctgctcctgcaaattccaagcatgtcgacttgactacttattgtccatagcaaaagccttcctcctggcaatacagactgcaacaactgaagacacttctaactacacacgttcgactagttcactaccccttctatattcgcacatatactgataattatcacaatacgatatccagaaaactacatgattcctgtcatacagtatatactgaaagaccatataccgaattcactgcgtgtatctatatgt

SEQ ID NO: 71049 - DNA, 444 bp, Zea mays
  Clone ID: LIB3078-022-Q1-K1-F11
atcaagcgtagcctcgctcacggctacggttccaaccgccaccttgctctcagcgaggaggacagatgatgggtcatgaatgctattcaagcaaacactgtaaatttcgtgaaaaggatgaacgagataactcaggcgatgaaaactgctcacaatctcttggactctcaaggcgagacccttgagatcatacaacatctgtggtatgagctacatgtaccattggcatatattggactaccaggacatctacatgataaggccgatctagatcgtgcactgaacgacttgcaagatgaaaaacctatattctatgacatgattacgcataagatgatgatacgacatgtgcactagtgtctttacgattaatgatctaggcatgaagaactattagatgatcgaactgttgagataatatagcatttgtccagtacaaatgca

SEQ ID NO: 71050 - DNA, 379 bp, Zea mays
  Clone ID: LIB3078-022-Q1-K1-D7
gctagctagcgttcctaatcaccgacgaataatctcttcttcacctcactaacaccgagcgtagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcat

SEQ ID NO: 71051 - DNA, 399 bp, Zea mays
  Clone ID: LIB3078-022-Q1-K1-C3
acctggtgcacgcacagagcatcctggccatctgggcgtgccaggtggtgctcatgggcgtcgtcgagggctaccgcgtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtccccggcaactaactgactgagcaacgccgtacatgtgtactaccatcagatccatccattc

SEQ ID NO: 71052 - DNA, 420 bp, Zea mays
  Clone ID: LIB3078-022-Q1-K1-C4
atcctgacggtgcccatcagctccgtgatccacccggggtacgaggaggtggtgcgcggcgagggcatgcccgtccccaaggacccgtccaggaagggcaacctccggataaagttcgacatcaagttcccggcgaggctctcggcggaccagaagtccggcgtcaagaggctgctcgggcagtagagcgcctcgtgttctggtgtgctgtgtgtcagacattttcgtgttggttgatcttgaactgggggatgctgccatttgcagcgtccgtgacgacgacgacgaggaggcaggccaccgagcgctgagtacagaacaagctagtggtggtatatggttgagaccttgagatgcacagcataggattccttgtgcaatcttccagacgggtggtgcttgtctgttcaccggtccatg

SEQ ID NO: 71053 - DNA, 423 bp, Zea mays
  Clone ID: LIB3078-022-Q1-K1-C5
caccggtggatttcgtctggtatctcatgaccaccgaacctcaaggatcacatcagcatggttcaaaacgtgatttgccttcatgccgaaaaaatgtgcccggcacatcatttgtctcagatttgagagatcacatccacgagttcatcaacgcctcttctgatgaacacatgacatgcttcacaaagactatcaagaagatgttcgggatgtcaatgactgtcgcacataaatcctcgaaagcagaggaagctgggcccgcatgactgcatctcaccatttcatatttgactaggtagcagccagtaaacatatcttgtgtagataacactgtgtccacacttttgactgataagattatgtacacttttgactgataagattatgtacagttacatgggccatgtatgtaataattttact

SEQ ID NO: 71054 - DNA, 437 bp, Zea mays
  Clone ID: LIB3078-022-Q1-K1-C6
gacagagcctaaacccgaaccgaatccggagccaaagccagagccgcaacctaaggcagggcctaagcctgagccggaaccagaaccaaagccagagccacaaccaaagcctgagcctaaaccagaaccaaaaccagagccaaagccagagcctaagcccgaaccaaaaccagagccaaagcctgagcctaaacccgaaccaaggccagaacctaagccagagccaaagcctgagccgaaaccgaaaccagatccaaagccagagccacaaccaaagccagagcctaagccagaaccaaaaccagagccaaagccagagcctaagcccgaaccaaaaccagagtcaaagcctgagcctaaacccgaaccatgaccagaaccagaaccaaagccagagcctaaacctgaaccataaccgaaaccatgaccggagccac

SEQ ID NO: 71055 - DNA, 440 bp, Zea mays
  Clone ID: LIB3078-022-Q1-K1-C7
gccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcatgggctcaaaggtgaccccacgtacctggtggtggagcatgacaagacgctggccatctacgggatcaacgccctgtgcactca

SEQ ID NO: 71056 - DNA, 423 bp, Zea mays
  Clone ID: LIB3078-022-Q1-K1-C8
atcttcccggatggcgaagggaaagtcaatccagaaggtgtagcgtattacaatggttggataaactatctgcttcagcaaggcatgactccttacatcaacctttaccactatgatcttactcttgcgcttgagaagaaatatggagggtggttaagcgcgaagatggcggacttgtttacagactatgctgacttctgttttaagacctacagcgatcgcgtaaagcactggtttacattcaatgagccaaggatagtagcgctacttggctatgacacagggtcaaattctcctcaaaggtgcaccaaatgcgctgctggtgggcattcagcaaccgaaccttacatagttgctcataattatctcttggcacatgctactgcagttgctagataccgtacgtaatatcaagctgctcag

SEQ ID NO: 71057 - DNA, 469 bp, Zea mays
  Clone ID: LIB3078-022-Q1-K1-C9
gaaatggaagagcactgccagtttgcatgccccctttgctccaagtcggtttgtgacatggcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaatcgcaagtcacacaacaccgtcagatctgaaatagcaaatcctgtgggggtttctgcatttcttcaagaagcgtgatggactgatggccccttcccgtgagctgctgagcaccgggatatctggcaagacactcatcactgtatccactccactgggtcctgcggaggcaaacagctcgagattgtatatctgctgctagctgccgcccttcgttatgcataagcctact

SEQ ID NO: 71058 - DNA, 390 bp, Zea mays
  Clone ID: LIB3078-022-Q1-K1-D1
gccgaggtatacagcgatccgtcgaaaatccacatggaactcaactggacagcccagtacactgatcttggccaaagcctcgcccaggcgtggaaatggcagaaagcgcacccgaacggatatggaccagcctgattcagagttcaaagattgagagagactcgtcacgcagatccaaagggtccatgtgcagtcatgtagccttcagacagttggttcttcatcaccatagaaagatagcaaagagcaacagaagagtcctgattcttttattgcagcgctcgaagaaggaaaaaatatcacagagaaccccctacctgctccttgattagtttcaaatatatatatataggtcctcgttgacattttaaatataattgatgtgtgctg

SEQ ID NO: 71059 - DNA, 296 bp, Zea mays
  unsure at all n locations
  Clone ID: LIB3078-022-Q1-K1-D11
nccacgcgttcgnccactcgtncgtccactcttncgnccacgcgtccgccaacgtgttctgcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaggtcgactacctgctc

SEQ ID NO: 71060 - DNA, 427 bp, Zea mays
  Clone ID: LIB3078-022-Q1-K1-D12
cccacgcgtccgccagaccacgcacgccgtcatagaaaaaccagaattctccaagcaatcgtatcgccaacgcgggcacggagcggtgctggcgtctgtttccgccggcgctggcgccgacgccgatgggctccgccgatcgcagtaagctgcagatcgacaggatcgtggtgacggagaaaggcgccaggagctgcgtcgaatgccgcgccaccaccacgcccatgtggcgcagtggcccgaccgggcccatgtcactttgcaacgcttgcgggattcggtaccgaaagaagaggaggcaagagcttggcctagagcacaacaagcagcagcatcaacaacaaaataatggcgaggctaatactggagtaaaagacagctctagcaacagcaataacaagcgggagcagcaactttcacgtggtgc

SEQ ID NO: 71061 - DNA, 343 bp, Zea mays
  Clone ID: LIB3078-022-Q1-K1-D2
gttacacatcacttagtacgatccaagcggtctagatcacgtgtcagcgtcgacgtaccgggaaggtaaggctctgagactgatgctgtggcatacatacgttcacgagcggctgatgagctagatctaaagacatcttataaactctgccgtcgttgtcattgactatcgaagcgcaaggccgcagtcctagagctatacatagctaaggctgatgaagttctcacttcatggagcactgatatgatcattgtactcgtggagcacctagctgaccttgttgacgtgcagcatgcatggatatacgaaggagaccgcaaggctgaagaccttgaaggcatgt

SEQ ID NO: 71062 - DNA, 366 bp, Zea mays
  Clone ID: LIB3078-022-Q1-K1-D3
cggacgcgtccgcccacgcgtccgcccacgcgtccgggccgacgccgccgcgcggagcggcaagtcgctggccaacgagatgaaggtcgggtacgtggagtcggcggggtcgtcgccggcgaagacggacctcgcggagctggcggcgctgctggccaagaacctggtcgacgagaccgccgcggtggcggcgttccagggggacgtgctcgtgtacggcggcgccaacctgacgctcgtggacatggagcaggtggacctgtacgggctcgagatcaaggggcagcgcccggtccacgtggagtacggcatggacggcgtcggcgacgagggcgcggtgctggtgcagcccgaccgccgacgggc

SEQ ID NO: 71063 - DNA, 418 bp, Zea mays
  Clone ID: LIB3078-022-Q1-K1-D4
ctcagggtgcctgtgcctgctcccgctgttccttcctcatggccaccgcctgccacctcgccgcgccgctcggcctcgccccgttgccccgcggctgcgcctctgctggcgtcgtggccgtcgtccggtgcgctcggtcgtcaggctccaagatcccgagaggcgttgctgtcagggcgacgtccggcggcgagggcgccacggaggaggtgccggagattgtgaaggctgcgcatgacgcgtgggacaaagttgaggacaagtacgccgtggccaccatcggtgtcgctgccatcgtcgcgctctggacggtagtaggtgccatcaaggccatcgacaagcttcctcttctgcctggtgtccttgagattgttggaattgggtatacagggtggttcacataccgtaacctcgtctt

SEQ ID NO: 71064 - DNA, 442 bp, Zea mays
  Clone ID: LIB3078-022-Q1-K1-D5
cccacgcgtccgcggacgcgtgggctgcggtagcgaaaacgcgagcgctgcggaacaacgatggcgacgatgtctcttgccgcggcgtcacccctcgcctccattccccgcggcatcgccgctcaggctccttgcgcggcattcctgtccatccgcttaggtggcgcgacggcgacgcggttcgctggactggcggtggcctcgcagccagcggagcgtcgcgccgcggcgatggtcgcgatggcgaagagggagcaggagctggaggagatccgggccatgacgacggaacagatggaagaggaggtggtagacctcaagggggagcttttcctgctccgccttaagcgctcggcgcgccaggagttcaagaacagcgagttcaggcgcatgcgcaagaggattgctcgtatgctaaccgtgaaaagagagcgggaaattg

SEQ ID NO: 71065 - DNA, 352 bp, Zea mays
  Clone ID: LIB3078-022-Q1-K1-C2
gccgccgtcgtcagggcgtccgccgaggcgcaggcgcaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccttgaaggagcggttctacctgcagccgctgccgccggcggaagcggtggcgagggtgaagacgtcggcgcaggacatcatcaacctcaagccactcatcgacaagaaggcgtggccgtacgtccagaacgacc

SEQ ID NO: 71066 - DNA, 421 bp, Zea mays
  Clone ID: LIB3078-022-Q1-K1-A8
atcttcccggatggcgaagggaaagtcaatccagaaggtgtagcgtattacaatggttggataaactatctgcttcagcaaggcatgactccttacatcaacctttaccactatgatcttcctcttgcgcttgagaagaaatatggagggtggttaagcgcgaagatggcggacttgtttacagactatgctgacttctgttttaagacctacggcgatcgcgtaaagcactggtttacattcaatgagccaaggatagtagcgctacttggctatgacacagggtcaaatcctcctcaaaggtgcaccagatgcgctgctggtgggaattcagcaaccgaaccttacatagttgctcataattttctcttggcacatgctactgcagttgcaagataccgtacgaaatatcaggctgctc

SEQ ID NO: 71067 - DNA, 397 bp, Zea mays
  Clone ID: LIB3078-022-Q1-K1-A9
agctcccgcaactgccgccgccactcccactcccgcagccatgccgcccaagctcgacgggtcgcaagtggtggacgtgttcgtccgtgtgacctgccgcgaggtcggcacagcgtcttcgctggcccccaagatcggcccggtcggtctttcccccaagaagatcggagaggacatctccaaggagactgccaaggactggaagggccttcacgtcaccgtcaagctcaccgtccagaaccggcaggccaaggtctccgtcgtgccctacgacgcggcgctcgtcatcaatgcgctcaacgagccagagagggaccgcaagaatgtcaagaacatcaagcacagcggcaacatcagcctcgacgacgtcatcgagatcggcaggaccatgaggcac

SEQ ID NO: 71068 - DNA, 387 bp, Zea mays
  Clone ID: LIB3078-022-Q1-K1-B1
cccacgcgtccgcctaaataagccatcgattcaggctcttatccatgggctgaacagacgctaggactcgattgcaatcaattaccgaaaaaatgaacttgaggagaaaatgttgctgaacttgcacaaaaagaaatggacagatgggctaattttgaagaggtttgacactcattcaaaaaccaacgagcagactgtccaggaaatgctaaacctagccatcaagtacaacaaggcggtgcaggaggaggacgaactgccacctgagaaacttgcgatagcaaatgtaggtcggcaagatgcaaaaaagcatttggaagagcatgtgttcaatttgatgtcatcaaacatagttcagaccctatgaaccatgctcgacacggttgt

SEQ ID NO: 71069 - DNA, 477 bp, Zea mays
  Clone ID: LIB3078-022-Q1-K1-B10
cccacgcgtccggcctcaaccattagtgcatgaggaagatcttagctgggaggagattgaggatgttggcgatgaagatcagaagaatggggttagcaaacggtcaagctctgtcagcaaagtggaggatctccggagacgtcttaattctgtggaagatgatgatgaggacctaagttgggatgtcgatgagtagaaagaacgtgtggagccctgcactgagttgtctgaaggacttctaaattagagagactgccatcctaagcataaattgaatttgtatggtgccgatgaagaagctttgtggatggattgccacaatgtgaatattgtgatggacactggtgattcaaattcagtgggggctcattagtttccttgcaagaactcgatagaatggtagtgttttttctgttagtgttggtaatttgtttccagttagcatacgtttgttgcaagtccaacatgtaccacctt

SEQ ID NO: 71070 - DNA, 479 bp, Zea mays
  unsure at all n locations
  Clone ID: LIB3078-022-Q1-K1-B11
cccacgcgtccgccccaatggccgcggcttctccaccggctacgacaacgccgtcacgggcgccgtcgggggcagatgtgaggaggatgagctccacaaggagaacatcaagaacgccgccttcttcaccggcaacatcacgttgagcgtcaccaagagcaacccgtagaccggcgaggtcatctgcgtcttcgagagcgtgcagtcgtccgacaccgacctctgggccaaagcgcccaatgatgtcaagatccagggggtctggtactctcagctcgagtgattcnagtgtctaactgctaggtgtcctaccgtcctcatggatcttgggaaggtgtacgtaccatggaaaacttttgagagcagatgatgaatcgtgtatgtaatgtacttgttaatgcanattcnggctgtcgcttttttatttttttattttcagtgtgggtttcttctctttcttgtgttctcaagaactacat

SEQ ID NO: 71071 - DNA, 451 bp, Zea mays
  Clone ID: LIB3078-022-Q1-K1-B12
cggacgcgtgggttccagtgtccgccgtcgtgcgctcgctacccctctccctcgaggcctgggccggcgaggagcgcccaggggcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgccgacggcagggagaagtttgcttcagtcccatgtggcggtggcggtgtggctgtcgcggcagctgcccctgctgctggcggcgctcctgcagctgaggcgaagaaagaagagaaggtggaggagaaggaagagagtgatgacgacatgggcttcatcctcttcgactaagcttgtgcaatagtcaagaata

SEQ ID NO: 71072 - DNA, 425 bp, Zea mays
  Clone ID: LIB3078-022-Q1-K1-B2
ctcgatcccagcatccgagagagctccacaggccaggtccccatcgccgcggcgcttgcgccacctctcccccgcccggtagtagcctcgccgccgttgccgagatggggttcgtgtccttcgtcgggagggtgctcttcgtcgccgctttcctcctctccgcctaccaggagtttaatgaattcggtgctgatggtggaccagcagctaaggcccttcggcccaaattcaacgggtttggcaaaaatgtatctgctcatctgggagtagctgtgccacacattgagttgaagcatgtgattgctgctacaattggtcttaagggtcttggaagcctcctttttattttgagcagctctctcggtgcttatctcctgctgctgtaccttgctttgatcactcctatcatccatgacttctacaac

SEQ ID NO: 71073 - DNA, 434 bp, Zea mays
  unsure at all n locations
  Clone ID: LIB3078-022-Q1-K1-B3
cccacgcgtacgcacacacacagagagagtcaagtggtttccaaagccaagtgtgtactagcagtttagcaacgagctagcgcgggctgcagcacgcagccatcatgtcggacgagaagcaccaccacttgttgatccaccacaagaatgacgatggagcagccctacgtcgagtacagttacttcgagaccgatgtgtgtaccgccacctgacggggctagtaccagatggacagtgtgtgtcgagaagagctctggtacactcagaatatctgcgagacacattgacttgaagcatgtgattgctgatacaattggtcttacaggtcttggaagcctnctttctattttcagcagcatatgttcgtgcttatcttctgctgctgtaccttgctttgatcactcctatcatccatgacttctacaactacgat

SEQ ID NO: 71074 - DNA, 443 bp, Zea mays
  Clone ID: LIB3078-022-Q1-K1-B4
gcagtttcccgtcggcaggatcgctcggttcctcaaggccggcaagtacgccgagcgcgtgggcgccggcgcccctgtctacctcgccgctgtcctcgagtacctcgccgctgaggtcctggagcttgctgggaacgcagcgagggataacaagaagacccgcatcgtgccgcgtcacatccagctcgccgtgcgcaacgacgaggagctgaccaagctgcttggtggtgccaccatcgcgagcggcggcgttatgcccaacatccaccagcaccttcttcccaagaaggctggctcgtccaaagcttccaccgtcgatgacgatgacaactgaagcttgccactggagaagaggcattcgctaccgtcttggttcctaggtttagcacgcaattagtcagcatgtctttgagagctcgatgtgtttgggaatgacaatagct

SEQ ID NO: 71075 - DNA, 268 bp, Zea mays
  Clone ID: LIB3078-022-Q1-K1-B5
cccacgcgtccgcccacgcgtccggccggctagctagctagctagctcctgcgtgagctggtagctagtgccatgcgtcggctctgtcgttcggttttgcttcgggtcaccgtgtaccctttgcttgcttggtttcttctttccttttttcctttttttttcttcttttccccggccatggttcctttgctttccagcagttctctgctggatgtgatgtatccattgttgcaatcatggccttgcattggctacctctatacctgct

SEQ ID NO: 71076 - DNA, 376 bp, Zea mays
  Clone ID: LIB3078-022-Q1-K1-B6
cccacgcgtccgcccacgcgtccggcgggcgacagcatcagcttcttcggcgtccgccgggacgaccaggaggagtctcacgtcgcggtcgtcggagggacggggcggtccagtggcgcttccggctttgccgttgtcagagctgctggtggtgtaccagaaacggttgggaataatgtcagcctaaccaaattgctaagtttcaaggggcatttcaagtaaaaggctgcaaaatttgcagaaacacttactgtgttgcaaagcttcaatgtttttggaagtcaacttctgatcacaaatgtatccagaaaactgctcatatactgtatacgagactgatatttttcacttgagaatggggaatttgtgcactgtc

SEQ ID NO: 71077 - DNA, 500 bp, Zea mays
  unsure at all n locations
  Clone ID: LIB3078-022-Q1-K1-B7
ggaattacccgggtgcgacgccacgtccgtccgcaacactaccggggtaaaacgcgggctatgtagcactctgagtgatcgcgctgcatatctgtggtagagggccnagttcgcctgccgagtagtcatcgatgcaagggctgagacanagcacaggcagattatacgaagaattgcttaaaccagtggtgagtgatttcntgatttgtatgaacttcaattacttctgtatgcagcatcatcnttcatatatgctatatcntgctagattatctgtatgacactcccttcctgttgctcactggaacatgtttgtacctcaacttgggagatatttttgtacggctaggccttattctaagaaaacatcaatttaaatgtgggacagagagtttaaggtaaatgaaaatttgaatatcctgttgacttgacacatcattcatttgtgcctagataaaaaggaacgccttcgacttatctactactactacaaacacaaa

SEQ ID NO: 71078 - DNA, 418 bp, Zea mays
  unsure at all n locations
  Clone ID: LIB3078-022-Q1-K1-B8
gctcgctcgatcctagcttcccttccaagaagcgcagcgcccatggccatggccacgcgagcctccgccgccacgcgccacctgctggccgccgcctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcangtggaggagttctacgtcatcacgtggacgtcccccaaggagcaggtgttcgagatgcccaccggcggcgccgtcatcatgcgggaaggccccaacctcttgaagcttgcgccgcaggagc

SEQ ID NO: 71079 - DNA, 53 bp, Zea mays
  Clone ID: LIB3078-022-Q1-K1-B9
agctactccattgcattatagacctctactctgtatgcacatatataccacaa

SEQ ID NO: 71080 - DNA, 258 bp, Zea mays
  Clone ID: LIB3078-022-Q1-K1-C10
cgcgttcgacggacgcttctgcggcccctgtaccaatccttgaataacatcatcagcgatgatcggggtgagatgtcgggggcagattcggacaggttcacattcatcatccagctggtggagagcctacactagctcgtacataggcctatgtagcaaatagccgattcatacactatcatggacattacagacacttacgtgacttacatcaggttcctgtccactgaactaatcacccctaccaataacataaca

SEQ ID NO: 71081 - DNA, 347 bp, Zea mays
  Clone ID: LIB3078-022-Q1-K1-C11
cccacgcgtccggcggctgcgcggtggtgttgagggccggtcctgggccgctgtccgatgtcgagcccggcctggatgaggactccatcgacgtgtaccgtaccaaccgcatcatccctgaggacttccagtacaggaagtattactgacactacacctatctcgaacgccaagacacgatcggcttctgggaggatgtcttcgaatgctaccatcaagctgatccttctgaactcttccaagcactcatcttctcagcatttcctcttgctatcatactgtgtatgatctgtcaaagtgcctgatgagtacctatacatctttaccgtcgacatgatcatagtcat

SEQ ID NO: 71082 - DNA, 293 bp, Zea mays
  unsure at all n locations
  Clone ID: LIB3078-022-Q1-K1-A7
gtactcggtctctggaattcccgggcctcgttgtctggtcgtgatgctgtactcatgtaaccgatatgcccaaatattcttggtgccctctcctcagaagggaaccgaacgtggacgtgagttttgctcgttccagttccatggtatgcnnntctgtttcagcatanttatgtagtnntgtgtctacctggttttttnnggcagttgttacaaannaaaaaaagaaaaataaaaaaagagggcctggctgcttcttagaggactccaanngtcttacgtacccgcgtgcattt

SEQ ID NO: 71083 - DNA, 346 bp, Zea mays
  Clone ID: LIB3078-021-Q1-K1-B12
ccaacccttccggccccccaacctgttttcagaagctttttgtcccggcccattaaggggtcccttcaaaacccgggcccaccgccgaaagggaaggcccccttgccaacaaacccaaaggcctaaaacccgccgccattcggccccaaaaaaggccccaagttgaaaatcctgaggcggaagtcctactgttccaacggaatcggcaccttcttaaccttcaataaggatcttaaaaccctttacccgttgttgttccgtttaaccaagttgaactaccccggcttgtttaccaacaattacgctttgaacaagatctttaaggtgaatttattaaggccatttt

SEQ ID NO: 71084 - DNA, 327 bp, Zea mays
  Clone ID: LIB3078-021-Q1-K1-C11
gaattccctggccgaccgcactcatacgctcactcgtacccccactcattccatcgattccttcaagataatccacagcatgtgacacgtgatctaactctagctcaactacctttccaaatacctaccacatccactcccagactatcccaaacataaacccatgccaataaatgcacatgatcaaccaagtacaattccctctaagtcttatgaaccataagaaatgaaccctataccctgtacacttcctacaaatcataaccgttatgccactcaaaaaactcctattcccaatcagacactagcatcataaatatcactaac

SEQ ID NO: 71085 - DNA, 182 bp, Zea mays
  Clone ID: LIB3078-021-Q1-K1-D11
cccgcgtccgagattatcgatcggagtggaagattgaagtgcaccatcctagggctgggaactattatcctgctaatcttggcatctatgtggaggatggcatcaaatagctttctttactggtaaacatggaaattgtatgtttcagttttaagattgtacaattttaacttattgcttca

SEQ ID NO: 71086 - DNA, 151 bp, Zea mays
  Clone ID: LIB3078-021-Q1-K1-D12
actctgcgcgagctcctcagaagtcaacatttacatctacttctgtctctgaaaggcatgtacaatttatctatgacattatctaactctaccacccaaatactgtacacacataatctctcatacataatctaccggctctacatctcat

SEQ ID NO: 71087 - DNA, 196 bp, Zea mays
  Clone ID: LIB3078-021-Q1-K1-E11
attcccggtcgacgcactcttccgctgctattatgtcactaatacctaagacctatccgttctgtggctcaaaacttggacttggcatgattccaaaatctcatatccttcctatttcacctcccttgcccttttactcatcttacttgcctttctctctttaccttctccctctattccttcatttgaatcccat

SEQ ID NO: 71088 - DNA, 288 bp, Zea mays
  Clone ID: LIB3078-021-Q1-K1-E12
ccctgttgctgcaaatctttctcttaattttgcatctccgacaattgcggcactggctcgatccaatattatgggcacccagctcaacttcacggactcctaccgctactccaccgcagcgcccaccgcagcagctcataagattgtctcccttttcagcaagaagcctgcccataatcccaagcccgcttctgtatcttcctcttctacagacatcatctacgagctctccaagtgagtatggtcctgacaggaagatctaccttcctgatgggctgttgcaccttt

SEQ ID NO: 71089 - DNA, 210 bp, Zea mays
  Clone ID: LIB3078-021-Q1-K1-H10
gcgcaatcgcttatatgatcatgatcgatgcttatgatgtttgccatcgtgcttaaggtctgaggacatacatcatcgccaagattgtatgccagctcgttcttgataaaaccatgtttgaagcttccaactccaacaccttttattggttcttcagactatatggcccaatggtaaattcttttgttgaacacttttacttgatgaatc

SEQ ID NO: 71090 - DNA, 343 bp, Zea mays
  Clone ID: LIB3078-021-Q1-K1-H11
cgtacgcgaggagccagctgccccggcggataccgatccattttccgccgctgagccctaggcggccgccggggcggttgatgaagagacgccaacggacgaagagacggcaaaggaagcggagccggagccgtctgtggctgaagaggtgaaggaggaagcggcagcgcccgctgccgagacagaagcagaaccggcagccgcggagcccgaagctgttactgccgaggagcccgcggcggctgagcccgaggctgctgctgccgaagagcccgagaaggcctagccggccgctgaggtggcccaaaaagccagcgagtgaagtcgtgccccgtacgcgcac

SEQ ID NO: 71091 - DNA, 356 bp, Zea mays
  Clone ID: LIB3078-021-Q1-K1-H12
cccacgcgtccggcagaaacgagagggccggagcagccgcagtcccggcgatccggccgggggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaattactaccacaaggtcgacggtcaaaacacccggaaacttc

SEQ ID NO: 71092 - DNA, 285 bp, Zea mays
  Clone ID: LIB3078-022-Q1-K1-A1
cccacgcgtgcgcctaaataagccatcgatccatgctcttatccatgggctgaacagacgctacttctcgattgcaatcaaggacggaaaaaatgaacttgaggagacaatgttgcttaacttgcacaaaatgatatggacagatcggctaattatgaagaggtttgacactcattcaaatacctacgagcaaagtgcccaggaaatgctttacctagccattaattgcaacaagtctgtgcatgatgaggtctaactgtctccatattatcctgcgatagcaaa

SEQ ID NO: 71093 - DNA, 477 bp, Zea mays
  unsure at all n locations
  Clone ID: LIB3078-022-Q1-K1-A10
cccacgcgtccgcgcctccnccaccctccgtttctcctccgccactcatcctctccaccgagcgctccgccggcggctcccgtcggttcgatgctccctcgccgccgccgccggccccggtgtccgggcgcccccggagctcgtcgactccatcctctccaaggtgaagggaactgaccgaggagtgctgctgccaaaagatgggcaccaggaagtggctgaggtcgcgctgcagctggggaagtactgcatagacgaccccgtcaagtccccgcttatattcggagaatgggaggttgtgtactgctcggtgccaacctcgccgggcgggctctaccggacgccccttggccgcctggtattcaaaaccgacgagatggtccaggcggtggaagcgcctgacgtggtcaggaacaaggtgtcgttctccgtctttggcctagagggcgcagtgtcattgaaagggtagctgaatgt

SEQ ID NO: 71094 - DNA, 448 bp, Zea mays
  Clone ID: LIB3078-022-Q1-K1-A12
gtatccgcagagagtttgttccgtccaggctaccagaaagcaagttgccccgccgcgcagaggaagaagagagcagatgaggatggctcgtacgaagcagaccgtccggaagtccacgggaggcaaggccccccgcaagcagctcgccaccaaggcggcgaggaagtcggcgccgacgaccggcggcgtgaagaagccccacaggtacaggcccggaacagtggcgctgcgcgagatccgcaagtaccagaagagcacggagctcctgatccgcaagctgcccttccagcgcctggtgcgcgagatcgcgcatgacttcaagacagacctacggttccagagccacgccgtgctggcgcttcaggaggccgacgaggcctacctcgtccgcctctacgaggacaccaacctgtgcgccatacacgccaagcgtgtcaccatcatgccc

SEQ ID NO: 71095 - DNA, 455 bp, Zea mays
  Clone ID: LIB3078-022-Q1-K1-A2
ggcagctccaacctctgggtgccgtcctccaagtgctacttctcgatcgcttgctacttgcactcgcgctacaagtcagggcagtcaagcacttacaagaagaacggaaaacctgctgccatacgctatggaactggttccattgctggttttttcagtgaggatagcgttacattaggtgatctggttgtgaaggatcaggaatttattgaagctacaaaggagccagggcttaccttcatggttgcaaaatttgatggcattcttgggctaggctttcaagaaatctctgttgggaatgcaacaccagtgtggtataacatggtgaaacaaggtctcatcagcgaccctgttttctctttctggtttaaccgacatgctgatgaaggagaaggtggtgaaattgtgtttggtggaatggattctagccactacaagggtgatcacacgtttgt

SEQ ID NO: 71096 - DNA, 285 bp, Zea mays
  Clone ID: LIB3078-022-Q1-K1-A3
cccacgcgtccgcccacgcgtccgcggactcgtgggtaagttttgtaatttctgtttccgtcttctcggcttcgcagcatgcagttgctgtatatgatggaagaacactctgttactgggcatgttgcgcggtttccacgcgtgtaagtaatgtagaagtcgctatggtaggtatttccataccgtcattagtggatcattgaatttttttgtaagaaggttattgcaatgccctttttccgggcatgaataagaaaaaggaaatatgcttatatgcatggtatt

SEQ ID NO: 71097 - DNA, 402 bp, Zea mays
  Clone ID: LIB3078-022-Q1-K1-A4
cccacgcgtccgcccacgcgtccgcggacgcgtggggtcgtgtggttggagatccccaggggggtattaatcaattcggatcgccgttacttctcggatatgaagactggatcgctgcccttcatcgtagataacaagcgaaacaaaatttggatttcaaaagcaacctagtgtaggtcaagtgaatgatctagattaggaaaatgctagattcaggctagaagattcaggtaataaactaacttgtgaaataaaacttggcttaaggacccacttctagtaagcttttctgcaaaatgagtccttgaactttgatgagctttaccttgattcccaaaagccagcatacccttgagagtcttttctttagtcgggtaagtcttgctgagtaattgcgtactc

SEQ ID NO: 71098 - DNA, 440 bp, Zea mays
  Clone ID: LIB3078-022-Q1-K1-A5
gaggattaggcccagacctccacttcttccacataaacctcataactgatgtgaaacggacttgtttttgtctcaacaagaactgacacggtttgcaaacctacacagctaactgcctgcacaagccttcactgacggtgacatgtcaatagttggtgttcgtcttcacaaaggaatctgtcaaaggaaggcgccttgtaaagtctttcttgtgctgttgtgtgatagttttgtgtgaagggtaactgaaagttgaatgggttttgtgctcgagtgatagtctattttcccctcttcttttgtttgttgatactaaaatgagaaaagacaagtgatattggtttggtttgctaggagtattgtgatgtaatgcagaaacttgttcccctatatcagtacacccttttaatctatgtatcgtggagtactgattgctgact

SEQ ID NO: 71099 - DNA, 410 bp, Zea mays
  Clone ID: LIB3078-021-Q1-K1-B11
cacggccactcttggccttcccctatctctcccctgttcgctacctcgttcccgcccccgcctgtgcttcaccgcacgtcatgccagggccgtcaccgacagagcttcctcatcctctccatcaccggactcttcattcagttcgcggatggaggagtccgtcaagaagacggtggccagacaaccccgtagtcatctactccaagtcatggtgctcatattgcatggaagtgaaggcgctcttcaagcggatcggagtgcaaccccatgttatcgagcttgaccatctcagtgctcaaggaccacaaatacagaacgtattatagaggctgactgtacagtctaccgttactaatgttttcatccgtagaaagcatgttggttgctggacagatacttttaaactgtat

SEQ ID NO: 71100 - DNA, 403 bp, Zea mays
  Clone ID: LIB3078-022-Q1-K1-A6
gtgccctctctctctcttgttcttgttgtgcaggttttgtggtctacttcttcgagaagatctgtgccaggatccccagagggcaggagaagttcctcgccatcatggatctcaagggctggggctacgcaaactgcgacgtccgggcctacatcgcggccattgagatcatgcagaactactacccggagcggctgggcaaggcgctgatgatcaacgtgccctacatcttcctcaaggtgtggaagacgatgatctaccccttcatcgacgccaacaccagggacaagttcgtgttcgtggatgacaagagcctgcgggagacgctgcggcgggagatcgacgagagccagctcccggagttccttggcgggaagatgcctctcgtctccctcaaggacta

SEQ ID NO: 71101 - DNA, 322 bp, Zea mays
  Clone ID: LIB3078-020-Q1-K1-G8
aagtagtcatcatcgttcgaagtgcagcggaatgaaactaacgatggtcaaacagacagatggggaagcctgtcccatcactcctcatgctcctcctcagccgaggcgggatccgactgaactgttcaacccggtggcaagatggacgaccaagtcactccagcaaccatgtacttcagagaacctggtaaattatgccacaagcaaggctgagtatactaatactcagttcgacttacccggcgtgaggaagctactcctctacctgtagacatgctgctgactggctgcggggtttggttgacaaaggcactagctgagt

SEQ ID NO: 71102 - DNA, 247 bp, Zea mays
  Clone ID: LIB3078-020-Q1-K1-G9
ctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaa

SEQ ID NO: 71103 - DNA, 443 bp, Zea mays
  Clone ID: LIB3078-020-Q1-K1-H1
tggacaagtcgctcaagaccgcactgcttgttcttggctacacatctaccggcctatccggattcgcggcttttgggctgctgttgctagcccagcagattaactctgagaacaaatcggagtaactgacaggcactcgctgaagttgtggacctcatgccttgcctttctatgctccaatgaagcaaacgttcatagggaattgcatacactgggaccttgtgtgtatcagtgcatgcaatgttctgtataaaaataaagagccaattgactgtgattacggataaaataatcggtggagatattgaagcaaacagggaagtcaacctgggactgactgaagaacaaattgatagtgaacgcatcagagaactgctcgtattcaaaattgtgctttcagagtgtgggactgctggtactcatcaaaactggaaaaaatcgat

SEQ ID NO: 71104 - DNA, 423 bp, Zea mays
  Clone ID: LIB3078-020-Q1-K1-H10
catcaatccactagcttcactgggaaacgaagaaagaacataggactgatccggtcggggggacttcctctcgaatcgccccgatcgagaccctagttgccccacgaaccgaggatccaagatgagtttcctgttcgggaagcggaagacgcccgccgagctgttaagagaaaacaagagaatgctggatcgatccatcagggaaattgagcgagagaggcaaggattgcaagcccaggagaaaaagctcatcactgagatcaagaaaacagcttaagaaggccagatgggagctgtcaaagtaatggccaaagaccttattcgtacccggcatcagataacaaagttctaccaactcaaatctcagcttcaaggagtttctctaagagttcagacactaaaatcaacttaagctatgggtga

SEQ ID NO: 71105 - DNA, 336 bp, Zea mays
  Clone ID: LIB3078-020-Q1-K1-H12
acgcgtccgcccacgcgtccgcgacggggcaacggatttcagagacacgcctgcttgcaaggaatcccaatcacaggagttccctgaggagtcggaatcatcgagcgctgatgtgttcgaaggcaacccgactgaggtagcaccagctcttgagtaggactagcaaggaggcacgggggagaaaactcgtctctctattcaagctttagcctatagggagggcttcgcgtttgctgtatagatataaaaggtttggttaaaatctgatgctacgaaaattggctggtataattattttgtactggattttcccttagaatcaaatatagatgggat

SEQ ID NO: 71106 - DNA, 466 bp, Zea mays
  Clone ID: LIB3078-020-Q1-K1-H2
cccacgcgtccggtcacaggcaaagcagatgcagatgctgatgcagccaagggactacggggagcgtgccttgaactatctggttgcgacgtcgagcacctggatacacccgcacatctgcgtcacgggcgcgaccaagcaactgaaagacctccttgagcttgagcacctcaacttccaacgcaccgctactaagggacagcaaggtacccgagagagaaaaagcgacgaatccattgccgccgccgctgctcgggctcgcagcggtggtttcctgatgataaacgggtggctgatagttcatggggtgcgtgctgcagttgtgctcacggtttgctgcggggccatgttcttcagcagcagcagcagatgaagaaatctagcagtgcctacccctaatttttgcatacacaagccacagtcacaatgtaattgtcaagtcttactgatggatctggctagcact

SEQ ID NO: 71107 - DNA, 459 bp, Zea mays
  Clone ID: LIB3078-020-Q1-K1-H3
ccgctgctgacgggcctcatcgtcggcgccaacagcctcgccggcggcaacttcaccggggcgtccatgaacccggcacgctccttcggcccggccctggccaccggggactggacaaaccactgggtctactggatcggcccgctgctcggtgggcccctggcaggcttcgtgtacgagtcgctgttcctggtgcacaagacgcacgatccgctgctcaatggggaaatctgacgaccatcagcccctgtgtgtggcgcatgatgcttcatgcttggttctgtaaaacaggtcatttatctgcaagcatggtacatatattggccacggtaattagagaggcttgctgtaaagcagtaggattgctggctgtagaaattgttggttttttttggttttcctgccaaggaattctttcttttatataatctcaaaaaaaaagatttttttgtatgggct

SEQ ID NO: 71108 - DNA, 366 bp, Zea mays
  Clone ID: LIB3078-020-Q1-K1-H4
cagcgatcgcagcaccgcggcgagataatgagcagcctgtcctccggcatctctgcctcgccatctgcagcgcccagcaccgctcggcgccgccatgacgcagcgccgcagcagctgagggtgaaggcggcggcgcggccacagctgctgcacgccggccgccggcgttcgagtgtcgggaggaggccgggcggcggggtggtggtggtgagggccgggcctgggccgctgtcggagatcgagccggacctggaggaggacgccatcgacgtgtaccgcaccaacggcatcagcccggaggacttcgagtacgggaagtatgacggacaccacacctatttcgaaggtcaagacaagaagggcttc

SEQ ID NO: 71109 - DNA, 454 bp, Zea mays
  Clone ID: LIB3078-020-Q1-K1-H5
gctcgaggtctaccagatctaccacctctcctgccccgcgtcccccgtccactagaaatagaaccccatcaaaacaatcaagaccaatgtggttgggactctgaacatgcttggattggcaaagaggatcaatgctaggttcctcctcaccagtaccagtgaggtctatggtgatccccttcagcacccgcaggtggagacttactggggcaatgtcaatcccatcggtgtcacgagctgttacgatgagggcaagcgttcattcgaaacgttgaccatggattaccaccgtggtgccaaccttgaggttaagatcgcacgtatcttcaacacatatggccctcgcatgtgcattgactatggccgtgttgtcagtaacttcgttgctcaggcactgaggaaggagcccttgacggtttatggtgatggaaagcaaaccattagttttcaatat

SEQ ID NO: 71110 - DNA, 401 bp, Zea mays
  unsure at all n locations
  Clone ID: LIB3078-020-Q1-K1-H6
caaacatgcttggtggctctgttatcaagatggtttaaacctgctgcagaatcttttgtgaaagtaccgttccttggagccgtttcgcatcttactctggcagtttgcccattttgcgttgcatttgctgttgtgtgggctgtttttcgccagctcccctttgcttggattgggcaagacattctgggtattgcattgatagttacagtcatccaaattgtgagagtacctaacctcaaggtgggttcggttcttctcggctgtgccttcctgtatgatatcttctgggtgtttatctccaagagatggtttcatgagagcgtgatgattgtggttgcgcgtggcgacaagaccgacgaggatggtgtgcccatgctgntaaaatcccgcgaatgtttgat

SEQ ID NO: 71111 - DNA, 461 bp, Zea mays
  Clone ID: LIB3078-020-Q1-K1-H7
cccacgcgtccgctactatcctcggcaatattaatgtaggcgaaggtgccatgattgctggtggctcccttgttttaaaggacgtacctccccacagtatggctgtaggtaatcctgcaaaggtagttggttatacagagaaagaagatccttctttaactatgaaacatgatgcaaggagagattattttgagcatgctgccatcagattgagatgattgatacacctaatgacgagtcttctttctattcgtctgtggaatactgtggagtaaaaaaagttccaaatcgccttattggcaagaagttttgtggagttaaaaaaaggtttcgtcgtcttactcgcaggaaaccttgtgaagttaaaaaaaaaatgtttgacgaaacgcatacggatgccattccggacatttcgtcacaggcacaaggctggatagtcgatgagctctgtgtttcccttt

SEQ ID NO: 71112 - DNA, 416 bp, Zea mays
  Clone ID: LIB3078-020-Q1-K1-H8
tcgcttacattgcaggcctcgcgtatgcagtggcagggcaagacaaaggagaggatggcgtcgccgataccgagcgagtggatcgggctgcagcaatttccggcgggtactcagaccaagctgcactaactgctcggaaaactcaaggaggaggatgtgagcacatgaacaattctggcgatggggaaaggtggagtgggaaagtcatccactggtaactacgatcgttgggagagggctgcctatgtcagcggtttccaggggatactttgaacattatcgacactcctgggcttattgtaggtggatacattaatgaggaggccgatgacatcattgagagacttcttttaagcatgactatcgatgttctcctggacctggatcgaatggatgcgtatataatggatacactg

SEQ ID NO: 71113 - DNA, 390 bp, Zea mays
  Clone ID: LIB3078-020-Q1-K1-H9
gccacacgtgcggccacgcgtacgattccccgggcgcaagacgtatacaaaatcagagtggataactacaagccattcgagcatgtctggctggagcgcagcgaataccgcacccgacgtgttcacccgctggaaaacctgcctgttgaacaggtccttgacagaaatgttcctgaccgataaccagtgaaaccatctgatgtagaggatacaccatctacgcttgttcaagatcacaaaggcttaacagaattagcttacaagttgaagaacgcaactgaatttgccgtcaaactggagcataatcaatatacgtcatttcagggcttgacctgcttgatgcagactttaacaagaacagaggactgtattgtggacactcttaagcta

SEQ ID NO: 71114 - DNA, 433 bp, Zea mays
  Clone ID: LIB3078-021-Q1-K1-A11
gtccctcctctctactcggtggcgagatccaaatttggcttgcaatggcatatgaagccggtaggaggcacaaggattgcattgcattgtacaaagagttggagagtagccaccccatgatcaacatcaggcgccaggcagctgagcttagatacattttagaggcacccaagttgaagatatcaaatgacgaggtggtcacaataccacaaattgggagcagctgggattggtatgctggaacatggagtgacaaaatcaaggaacaagaggacaagaaaaggaagatgagtgctgctagcaaccaagttcaaccttctccaaacatctttggagacctctctttcttgcgaccgccaaatgaatggaagaagagtgcatgggtggttgttaccttgtggatccttttgataggaacagcaatctatctgca

SEQ ID NO: 71115 - DNA, 428 bp, Zea mays
  Clone ID: LIB3078-021-Q1-K1-A12
acgtgctacaaacaccttggagcgagtggctcctctgacacatgctgtcggcaatgtggtgaagcgtgtttttgtcatcggtttctcaatcattgtttttggcaacaaaattagcacacaaactggaattggcacgtccattgccatagctggtgttgctatgtactcttacattaaggctaaaattgaagaggagaaaaggaaaaagagcgcatgactgctgtgaataatattatcgggaccttcctcggacacaacatcttcgacaatcacgacctacttctataccttgttttgttttcatcttgagtcagtcggtccattgtttgttcccagtctggtgattaaaagtctgcaaattctgtttgtggaattggcaactatacaaatttggcttctttaagtaaattcagttggcggtacacatc

SEQ ID NO: 71116 - DNA, 457 bp, Zea mays
  Clone ID: LIB3078-020-Q1-K1-G7
gcgacgcagaacctcaacgccatgaaccaggggcccaacccgtggcacgtgtccttctcgtacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgtcgaccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcat

SEQ ID NO: 71117 - DNA, 371 bp, Zea mays
  Clone ID: LIB3078-024-Q1-K1-D2
cggacgcgtgggcaaaagtagatgataccagaagccagaaaccatcagacaacacgcccggtgatgatggtgtatgcgaacaatctgcagcggagatggaagatagcggcacaaaagctttgccgtaccaatcggaaaaggaattgactgaagaaaccattgatccgatcaccgcagcacaggctacacctgaatcaattgctgagacaaatgatgacagcacagtcagtgaggctatacagacaccggaaacatttcctgaggaagaacagcagcaacaaatgaaagaagtgaacgatgaatcaacgaatggactggatcatctcatgaaccccagtaacccgaatgatttgagaaacccacatatggat

SEQ ID NO: 71118 - DNA, 471 bp, Zea mays
  Clone ID: LIB3078-024-Q1-K1-D3
ccgagagacaggacccgatgctggtactcaagttcatctggatggagaagaacatcggcgtagcactcgaccagctggttcctggctatggcagcatcccgttgagcccgtactacttctggccgcggaaggacgcgtgggaggagcttagagccaagttggaagagaaagagtggatctcgcagaagcagatgatcatccttctcaaccaggccaccgatatcatcaacctctggcagcagggtggtgggaacctgtcgacatgagtcccttcccgccctgttctttcaaccgtgcaaagcttgcgttttgttggtttcactacaggctctctctgttgttaatgttaaaagtatggtacatggccttgtagatcggttcaaactgttctcaggtatggccttttccatggaaatcatcttgggatttatcttagttattatgtgtatcaatccgtcacccccccccccc

SEQ ID NO: 71119 - DNA, 313 bp, Zea mays
  Clone ID: LIB3078-024-Q1-K1-D4
gaaaaaaacgtgacatggtcaacgagtgggcatgggccatggctttgcaccctgtagaacaaggcgagtgactacaaaacagctctgttcggcatatggagagaacaaaaaaagaagaagattacaggtgatcctggagatatgaacaaacgcctggacgactcagaattcaagcccgtgctgtctggcagaatcagcgagagcctttatgcggccatggtagaggaaaccacctcggtcgaagacaaccttggtgatccctttctccaagcaagacttggcaatcacctcaccgatcttttgtgctatttcg

SEQ ID NO: 71120 - DNA, 462 bp, Zea mays
  unsure at all n locations
  Clone ID: LIB3078-024-Q1-K1-D5
cccacgcgtccgcaagcttgcacgccgtcgactccctgctcgcctcgcttcgttgtcatcgttcactatcttcgtcctcgtcgtctacctcgccggttctcgcgcccaactggccatcgtgctcgacgtgttttcctccgtgcagattcgcatgtacctttcactccatccgctagtcgcgtggtagagaagatcacgttatcggtggatcaatcgccttgtggagtaatttcttggaggctggtcgtcaccctgaagatttgtggcaaattattttcttagtcattggctcttcactgcaacaaaggtactagagttgtgctgttgtggatggtgttaagtgccagtaggcacgaccttcttataagtctaagtaactcttctatacttcttattgaagatggtcacttaagctagcgtatatttcaaacttantaataatttataacatttcaaagttta

SEQ ID NO: 71121 - DNA, 271 bp, Zea mays
  Clone ID: LIB3078-024-Q1-K1-D6
cgtgagttagcgctttctatatctagcgctttaaaaaaaccttacatggtcaactagtgtgcatgggccattattttggaccctgtggaacaaggcgagtgacttcaaaacaaatttgttctgcatatggacataacaaaaaaagaacaagattacatgtgatcctggatatatgaacaaacgccttgacgactcacaattcaagcccctgctgtctggcagaatcagcgagagcctttatgcggccatgttaaaagaaaccaccttggtc

SEQ ID NO: 71122 - DNA, 370 bp, Zea mays
  Clone ID: LIB3078-024-Q1-K1-D7
cccaattcacatttcttgctaggtttaagtatatgctcccttgtacaacaaatcaaatgatgcaagggattcaactgtcgatttacttggatggtacatccatttttgtgcacgagttgtgattcttgtaactatccgtaaagtcttagatcattagattttagtttacttgtaaaattgctaaatcgtcatttcctgtcttgcttatcagtgagttacacacgtttagtgcttttatcaaaaaaaaaaaaaaaaaaaaaaaaaaaaaaaaaaaacaaaaaaataaaaaaaaaaaaaaaaaaaaaaaaaaaaaaaaaaaaaaaaaaaaaaaaaaaaaaaaaaaaaaaaaaaaaaaaaaagggggggccct

SEQ ID NO: 71123 - DNA, 340 bp, Zea mays
  Clone ID: LIB3078-024-Q1-K1-D8
cgccaacgttgcagcctaccgggcctactttcgacgccgcgaactcatacacctcggtgggcgaaatcggtaaacgccactgtcacctaggcatcaaaattctcatgggcatgtgccttaacaattctatcgacctcgccaacgccaccattccattgactcacggcttgtactacaaaccccttgagtcttgtaccaaagccctaatctctttgttaaacatcattaagccattttttgtccttttttatttaaacccctttttcataataaaacctttctgaaaccttttttctaaatattattttggaatatccttatccttattttttggcttttt

SEQ ID NO: 71124 - DNA, 298 bp, Zea mays
  Clone ID: LIB3078-024-Q1-K1-D9
ggaagctgttgttgctgccaaggctgctggagatgacatggttttggtcaactaggtaagataacctttcgcttcatttatttgttagtgcttgtgttcgtaagtttttctagtcttgtatcctaaaaccgtactactctgtttatgtcctcttgttcttgctttgttttagcatatctgtgagatgcattgccactttttgtactgctcaccttctgttttgacctggtcatggcagttcacaaaaagatggaatatatctgtaccaaagtttcaatttattatggacagttagttc

SEQ ID NO: 71125 - DNA, 347 bp, Zea mays
  unsure at all n locations
  Clone ID: LIB3078-024-Q1-K1-E1
gccacggacaagcggttcaagacgctgccggcgtcngaggcgctgccgcggggcgaggccatcggcggctacatcttcgtctgcaacaacgacaccatggacgagaacctcaggagggagctgttcgggctgccgtcgaggtacagggactcggtgcgggccatccgcccggggctgcccctcttcctctacaactactccacccaccagctgcacggcatcttcaaggccgccagcttcggcgggaccaacatcgacccgacggcgtgngaggacaagaagtgccccggcgagtcgcgcttnccagcacaggtgcgagtggcaacgcggaagatctacgatccact

SEQ ID NO: 71126 - DNA, 377 bp, Zea mays
  unsure at all n locations
  Clone ID: LIB3078-024-Q1-K1-E10
cggacgcgtgggtgacaaatctgacaacaggcacaccatgggaggctgttgctaaggaggttggcaccactttgggtactgactcaggcattctacgagcacagatctcaaaagacgttgaaactcttgttgatgtaattgcttcatggacatcttcaaattctggtccaagactacttcgcccatgatcacccagcagtctgcgtacagaaatgttagtaacagtgaagagcaacaggatttaatgatgcattgtgagtaacanaaagatgatacgagacgttggcaattaaggagttatgttaccttggccggtggaggaaggatgcatggcactggcaataggagcttttgtggacaaactatcttaacccatt

SEQ ID NO: 71127 - DNA, 342 bp, Zea mays
  Clone ID: LIB3078-024-Q1-K1-E11
gtcctgttggtattcctggtgtattgctaaaggatgttgtttcagatttgcctgtgcatggtttgggctatgggaatattgtcatacaggatctatgaagctagcaagaactgcaggaagataagcaagatctggtgtgcttgggtaggacaaggctcccatggttttgagagttgtaacacttatgagcaatctggatttgccatagtcaacttctcttatacctatgatttaggcaggaagtggtcttctgaggaacaagacctgtctgtctctgctggatctttctttgtaattgatgatgctggacaccgtgggaagcgaatgagaaaatcattctct

SEQ ID NO: 71128 - DNA, 404 bp, Zea mays
  Clone ID: LIB3078-024-Q1-K1-E12
gtttagtcgtctaaattgaagaactaaccttagacagaaaagttagacaaaatgtggcaggttaggcagcaaaccaaacatacctttagtattccttagtttggcactctggccttatgtgcattcagcattgttggttgttctatatacccttaacacttgatgcaccaagagatgtttaaaatggatgcagatggcagggaaggttggccagaactggcaccctatgaagccatccatgttggagctgcagcaccgcagatccccgaggcgctgatcgagcagctgaagcccggcggcagaatggtgatccctgtcgggacagtcttccaagagctgaaggttgtggacaagaagttggatggcactgtcagcataagagacgaaacgtctgtgcgctatgt

SEQ ID NO: 71129 - DNA, 414 bp, Zea mays
  Clone ID: LIB3078-024-Q1-K1-E2
cccacgcgtccgcccacgcgtccgctccatagctcgtcgccaccggccaccgccaccctggatcacgccgtccgtcgaggtaaggtcagcatggtgagggtcagtgtgctcaacgatgcgctcaagtccatgtacaacgctgagaagatcggcaagaggcaggtcatgatcaggccgtcgtccaaggtcatcatcaagttcctgacggtcatgcagcgccacggctacattggagagttcgagtacgttgatgaccaccgatcgggcaagatcgtggtcgaactcaacgggaggctgaacaagtgcggcgtcatcagccctcgctttgatatcggcgtgaaagacattgaaggatggactgcaaggcttggtccgttcaggcagttcggatacattgttctcacaacttttgca

SEQ ID NO: 71130 - DNA, 457 bp, Zea mays
  Clone ID: LIB3078-024-Q1-K1-E3
cccacgcgtccgatcgtcgtgctctccacaccagcagccccgcagaagcccaagagcccggccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccgtcttcgtgcccaaggactcggcgttcgcggcgctgaagcagaccacgttcgccaacctcacccaggaccagctcaggtcgctgctgctgtgccacgcgctgcccaagtactactcgctggccgagttcgaccggctgagcgcgctcggtccggtggccaccctcgccggctcgcagtacacgctgaacctcacctacgacatgg

SEQ ID NO: 71131 - DNA, 427 bp, Zea mays
  Clone ID: LIB3078-024-Q1-K1-E4
gccgaccccacgccagtagagatgagggccacatcgtccccagtgcccgccgccgtccgcgtcgccccctcctccgccgccgtagcagtgaaacctcgtgccgcagcgagtggcggcggaggcagcacagcaggcaggcgcgacgtgcttgccgccggtaccgggctgggcgcggcgctgctgctggcgctggggccggcgcgcgcggcggacgaggagtacgtgagcgagacgaaggaggtgatcgggaaggtgcggtcgacgatcgggctggacaagtcggacccgagcgtggccgacgcggtggcggagctccgggacctgtccaactcgtgggtggccaagtaccggcgggagaagtcgctgctggggcgttcgtcgttccgggagatgtactcggcgctcaacgccgtgtcgggccactaca

SEQ ID NO: 71132 - DNA, 459 bp, Zea mays
  Clone ID: LIB3078-024-Q1-K1-E5
ggagaggccggcaccggtgaggaagtctcacatgtcgacggcggacctgctgatctgggcggagggggcgccgcaggagtcgcccgccggggccacgccgccatccaaccgccggccgcatcagccgtcggaggcgctcaggaaggtggtgttcggcgggcaggtgacggaagaggaggccgagagcctcaacaagaggaaaccatgctctgctcccaagtggaaggagatgacaggaagcggcatatttgctgctgggggcgaggctgaagaagatgaatctgccaatgcctctgcaactcccatccggaccgctccaaagaattatcaggcaattagcactataagccacatctcattttccgaggaagaaagcatttctccgaagaagccgacttcgatagcagaggtggcgaagcagcgcgagctgagcggcacacttctgagcgaggacgacag

SEQ ID NO: 71133 - DNA, 310 bp, Zea mays
  Clone ID: LIB3078-024-Q1-K1-D10
ttcttttctggtattctttctgcaagaattctctgtgatctacctactacctgcttagtgagcttgggttcttctaatggcggggcgagctgcttactcttggcttattcaattgttcaactagtaccgcaaaattgttaattctacggctgtctatgattgagaaacctggcgctcacgaagattccgttttgtaaccattgtgtctaatgaggaacttgactaccctatctctgccctggattgacaagaattggaccggcggcctcttcgggtgaacctttcatcaaaacgaccacagaagggcttt

SEQ ID NO: 71134 - DNA, 337 bp, Zea mays
  unsure at all n locations
  Clone ID: LIB3078-024-Q1-K1-B12
cccacgcgtccgcggagggccgggggccgacgcttgctcgacgcctcaagaagtccgacgcctgggacacccgtcccgggcgccgcccgtccggcggtggcagcagcggggaggtcgatccagcggccgtggcaccggcgggggcgatgcggaaggccgagactttcaacgacggtggcgccggaaggagcaggcctgctcccgctgcgctggtgcggctggagccgtcgctggggcangacgagctgaaccgtcgcgtggaggcgttcattcacaagttcaacatggagatgcggctgcagcggcaggagtcgctcaagcgctacaacgacatgat

SEQ ID NO: 71135 - DNA, 457 bp, Zea mays
  Clone ID: LIB3078-024-Q1-K1-B2
cccacgcgtccgctggccatgaacaagttcgactgggaccacccgatgcacctgcaaccgacgagccccacggccattaagcaggtgagctgcgtgtgggacgcgtacgaggccaccaagggcgcccacggggtgtgcatcctgaccgagtgggacgagttcaagaccctggactaccagaagatcttcgacaacatgcagaagcccgccttcgtcttcgacggccgcaacatcgtcgacccggagaagctgagggagatcggcttcatcgtctactccatcggcaagccgctcgacgcctggcttaaggacatgcccgcggtcgcttaattcgtctgaggtgctccattggattggatccggggaaggaagaggaactggttgaccattcttcattacagtttgttttttgcaggattcttaaaagttggacggcgctgctagtattccatgtttc

SEQ ID NO: 71136 - DNA, 437 bp, Zea mays
  Clone ID: LIB3078-024-Q1-K1-B3
cagagtgtggcaccaatcaacctattgagaaagtgcttgcagctgaagatgcagagtgttgtatttgcctatctgcttatgatgatggtgcagagttgcgggaactcccttgtgggcaccatttccactgcacctgcatcgataagtggcttcacatcaatgcaacatgccccctgtgcaagtacaacattcggaaaagcaacagtagcagtggaagtgaagaagtatgaatgcaaccgcttgacaatgccaatctgtttaaacttcgtgcctgtgtcgttgctaatgtaactccagggcttgagcagtgtaaatttttgtactaaaaagaagtgctgatagagtcaattatgtataaagttacctcaagtgctgtctatatgtccgataagtaataaatagttgggtgtgcatctgtatttactgtcaggaatgat

SEQ ID NO: 71137 - DNA, 455 bp, Zea mays
  Clone ID: LIB3078-024-Q1-K1-B6
gccgctgctccgcctctacctcgcgccgcaccaacgcctcctcctcgttggctgcggcaactccgtctttggtgagaacatgattgacgatggttatcaagatgttgtcaacattgatatatcttctgtggtaattgagcaaatgaagaagaaataccacgataagcctcaacttaaatacatgaagatggatgtaaagaacatgtcagattttgagtctggttcttttgatgctgttattgacaaaggaacactggattctcttatgtgtggtcaaaattcccaagagaatgcaacgaaaatgctagaagaggtcaacagaatcctcaaggaaaatggtgtctacatgctgatcacttatggggatccaagttaccgcttgcgtctcttgaaggacatggaaaaatggacagtaaagctccatgtcatagaaagatgggagaaaagttcgaatc

SEQ ID NO: 71138 - DNA, 398 bp, Zea mays
  Clone ID: LIB3078-024-Q1-K1-B7
tcggcatcatcgctgatggcgaagacaagaacggcaagccgcacaagctcaggctatactccatcgccagcagcgccctcggagatttcggcgactccaagacggtatcgctttgcgtgaagaggctagtctacaccaacgatcagggggagattgtcaaaggagtctgctcaaacttcctgtgtgacttgaaacctggcgccgatgtgaagatcacagggccagtgggcaaggagatgctcatgcccaaagaccccaatgcaacagtcatcatgctcgcaacggggaccggtattgctccgttccgctccttcttgtggaagatgttcctggaggagcacgaggactacaagttcagcggccttgcgtggctgttcttgggagtcccgacgagcgac

SEQ ID NO: 71139 - DNA, 368 bp, Zea mays
  unsure at all n locations
  Clone ID: LIB3078-024-Q1-K1-B9
gacgaaggaagctttggagatatgtcaagtggtgatgttgatgaagataacgagagaagagaatgcgtaaaagctgctgcagtttcctctgtcgtcggtgttctggctagtttgcccatatctttctatgaagttgaagatcttccacaactattccttcggtcatcaattgttttcataagttgtgctttgtttggagtcacattccggtacgctgttagaagagatctggataatatccaactaaaaactggggctcctgcagcatttgcttttgttagaggccttgctctgctggaatctggtagaaccttcgagctgagtactgataccttaatatcagntactcttgatgctgcagtcagtgt

SEQ ID NO: 71140 - DNA, 371 bp, Zea mays
  unsure at all n locations
  Clone ID: LIB3078-024-Q1-K1-C1
ctcgaagcttgcgttcttgtagtagaggtcggcagcaagcggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgncacctgcaagaactgcgtccccgtgtccacggacaagggcaccaccaagtacaggtgccgcgacttcctccccgaaaactgcggctgcaagatccactagactcatccacagcggcacagccgatggatccttccatgc

SEQ ID NO: 71141 - DNA, 389 bp, Zea mays
  Clone ID: LIB3078-024-Q1-K1-C10
cccacgcgtccgcccacgcgtccggtcatgaggcttactgggatcaccctcatgctaccgaccgcgtttgagaagcccacgagcagcgcgcccctgtcatcatgtccatctgatgcagcttctgcttctgcttctgccgccattgaagacagcgtgaagcatttcctccaggcgccacttgaaaacagtgggatcatcccaaacgcagcagtttttcagaccaagccagcttctctgcaccgtgttgctagcctggagaacctgcagaagaggatcgtcggggatgcaatgtattccgagaccgcgtcaacgacattctcagatcctgaagctcttgccgataggtaaaagttgctcctgtcctgtgatgaacagccgtgtgatgctct

SEQ ID NO: 71142 - DNA, 389 bp, Zea mays
  unsure at all n locations
  Clone ID: LIB3078-024-Q1-K1-C11
cccacgcgtccggcaagctaaggagagtgtgatcaccaacagctagtgctagtccccctgccttccatccatccatggcatgcgtcagcaccttccagagctgccccattgccagaagagcaaagatcaacacgaggtccaggggctgcagcagtagcgtggcgaaggggtcaccaccaccagccttccagttccagtgcagggcgtcgactttcgcggcggacaccagcctccggctcgagctggacgagaaccccgaggcgatcatctcgggggcgtggcccgggaactgctccctcctcagctacgacgacctncgcgcctacctcgagtcgcaggagacggcggcccangcagacggtcaacgcggcgtggcgctcctgagcgag

SEQ ID NO: 71143 - DNA, 255 bp, Zea mays
  Clone ID: LIB3078-024-Q1-K1-C12
tccgattgacccacgcgtctttttactcgtgcagttgtgcatgctccgactctagttgacattgtaatgacatgcaaccgtggaccatggaattgcacgcaggttgaccaacaccttcacatctgctttgcctcatgtccacaggtatttatccaccatggataaccagcctaacttcaagaaactcattggtgaagtcaagcagtcagagtaaagacctgatataccccaaggagctcctcgttgtaacgatcc

SEQ ID NO: 71144 - DNA, 106 bp, Zea mays
  Clone ID: LIB3078-024-Q1-K1-C2
acggtccccgactgctctctactctctattgttgacgactgggctaccttctacacagctgcgctacgctatgtattcaggtcgcgtgctctatacttgtacctaa

SEQ ID NO: 71145 - DNA, 422 bp, Zea mays
  unsure at all n locations
  Clone ID: LIB3078-024-Q1-K1-C3
gttctagatcgcgatctagagcaaagcataccccaaaatccccaaaccctaggcgaactgggcacggcggcgatggcagcggcgggcctgcggaaggggaacgcgcgcctnccacccgaggtgaaccgggtgctgtacgtgcggaatctgccgttcaacatctcgagcgaggagatgtacgacatcttcggcaagtacggcgcgatccggcagatccggctgggcaacgccaaggacacgcgcggcaccgnctacgtcgtctacgaggacatatacgacgccaagaacgccgtcgaccacctctccggcttcaacgtcgccaaccgctatctcatcgtgctctactaccagcccgccaagatgtccaagaagtcggatgtcaagaagaaggaggacgagatcactaggctccaggagaagta

SEQ ID NO: 71146 - DNA, 455 bp, Zea mays
  unsure at all n locations
  Clone ID: LIB3078-024-Q1-K1-C4
gagaggtagaggttccgaggtagagagatagagaggaggagagggagggcgaggcggcggatccgtcactccgttcttctccgctgatctggaggaaggaggcgaggggagttgcaaatccatcaatggccactccaaccacctattcagtccgcatatcctcggagacccacaagattgaagcctgggtggtgtctgacgaagctttggccaggcaactgcaggaggaggagaacacgcgtgacgctgctgccgacaccagagaagtcgccggcaatgtacccttggagtcatcgtcaccggctgttgagtacaagcctgcacagaatgcagctcaagttgcaagggaagacaatgtggacccagataatatgtcatatgagcaactacaagcattatgggaagcagtangaattcagtccaaaaggttatctgatgagctgatatcttatttg

SEQ ID NO: 71147 - DNA, 460 bp, Zea mays
  unsure at all n locations
  Clone ID: LIB3078-024-Q1-K1-C6
cccacgcgtccggggagtcgtagaggagcagcaggtgcaccaaaaggatggcagcgccaggctccctgcgacttctccaggccccgtccttcgctgcggccaagtgccagccggtgggtggccgggcatccgcgcggcgagcgccacggccactgttcgccgtgcgcgcctcggctgctgacgccgncaacagggatgccgtgctcaaggccttccgcgagaacagggctctcaagataatttccggtcttcagaactttgacaggagcagtgttgcatctgttgtcacagctgcagataagggaggtgcaacacatgttgacatagcatgtgacaaggacttagtaaagcttgccatggatcttaccaaccttccgatctgtgtctcatctgtagatccttcagcgttccattctgcagtacaagcaggagctaaaatggttgagattggaaactatga

SEQ ID NO: 71148 - DNA, 327 bp, Zea mays
  Clone ID: LIB3078-024-Q1-K1-C7
cgccacgaacttcgtccccggcaactaactgactgagcaacgccgtacatgtgtactacgatcagatccatccattcgttcgtccgtccgtcgagtgaacagtgtggtcttctctgtactctacttgttcagatcgtaggcgtgtagtagttgcaccagccggcgtatgctcatgatcgatgtgtgctcatcaatcaatgtcaatggctgcctgctgtaagcggtcgatgtaaactaagcacagacgcatgtatcgtcatcagtggatgaatcaatctatcgatggcctgtgccattcatttttgaatcgatcaacatcactccatc

SEQ ID NO: 71149 - DNA, 302 bp, Zea mays
  Clone ID: LIB3078-024-Q1-K1-C9
cggacgcgtgggcggacgcgtgggcaaatccgcagtccgcagacgagagtggaagcggggcacagacagagaagccaatggcgctgtgcctctccctcgcgcgccccgcgcccctcgccgtttccgccggcgcaggagccaggaagctacccgcagccagcctcgcattcccggcgaaatccttcttcggcgcgccgctggccgccaccgcggcctccgtcgcgtcgccgctcccgcgcaagccggccaccttcaccacctcgctcgaggtcgtcgcggcggggaagaaaggctacaagatg

SEQ ID NO: 71150 - DNA, 200 bp, Zea mays
  Clone ID: LIB3078-024-Q1-K1-D1
cggacgcgtgggcggacgcgtgggctcagttttcatgggcctttctgttcctcaatactgcaatgagtacacatctattgctggttatggtcctgttcacacacattcaagatgggtatgtaacatttgttctttttttccgtgaaatcttacaattctgtggaaagataaataaagtactcacatcggttgtcttgttc

SEQ ID NO: 71151 - DNA, 308 bp, Zea mays
  Clone ID: LIB3078-024-Q1-K1-B11
gaagaagatgacaacggtgtcaaggcattataggattgcgtgtcccctgagaaatcaggggctgggggaccattacaagagcacccagtccatgacaagccagcggacgcagtagctgagccgtcatctcaggacgacactgtcactgaaaagccctcagctacaactgacactgcacaaactgcatgagacatcagttagctggttaaagttagttagcaacagttttaaacggagtgtggatcgaatactattggtcatagttcggcgtggcttctgtttgggcactttttcggcgggttggggtg

SEQ ID NO: 71152 - DNA, 236 bp, Zea mays
  Clone ID: LIB3078-023-Q1-K1-H4
accgctgactatcgatcacatggacgctgtttacagcgccttgatcgagcccgatgactccgtgaaccgcagaggtttgacctacgccaaggacaagctggacgaccacatcacggtgtacgagtggctctacacgcacggtaccaacgaccagacggctctgcatgggctcaagggtgaccccacgtacctgctggtggagcacgacaagacgctgtgtcactacaggatcaacg

SEQ ID NO: 71153 - DNA, 430 bp, Zea mays
  Clone ID: LIB3078-023-Q1-K1-H5
gaatttttctctgttccatttgggctttttggtaaatctgcctatgcatgccgtgattcttcttgtagtgatgctactactgaaggactaattaaggtaagagatgcatacccttttggtgtggaccctgtttggcatggtagccgcagcgagctgccgtttctcaattcactgaagatgaagatgtccattcttcttggagttgcacaaatgaaccttgggattgtgatcagctacttcaatgcaaaattttttaggaacagtcttaatgtgtggtaccagttcattccccagctgatcttcttgaacagcttatttggttacctgtccttgcttattattattaagtggtgcacggggtcaaaagcagatctataccatgttatgatctacatgttccttagcccaacagatgagattggtgaaaacc

SEQ ID NO: 71154 - DNA, 420 bp, Zea mays
  Clone ID: LIB3078-023-Q1-K1-H6
gtcaagcttgctgagctagccgccatggtctgcctcgccgccgactccttcaaggccgcggccatcaagggtcttgccggtagctgcatcttcggaaggaagctcgccgacgccaggccgtgcggaccgctgcatgcgcaggccccgcgcagccgccgtggtggccaagtacagtgacaagagcgactactatgacctctgcgacatcagcaacgccaccggacagtgggacctgtacggctctgacgcgccctcgtcctaccacccgctacagagcaagccattcgagacgttcgctgatccgttcaccaagagaggtctgctgctcaagttcctgctgctgggcggcaggctcacttctggcctacgtgagcacgtatgcgataccggaccttctgtcgatcatgaagggacctaagg

SEQ ID NO: 71155 - DNA, 382 bp, Zea mays
  Clone ID: LIB3078-023-Q1-K1-H7
cccacgcgtccgcggacgcgtgggctttagcacaggagacacagcggtccgggaaagccatcaatacacttgagtcttggataaaaaaatcaaatagttccagagactgagtgaagttgagtagcaatagatggatttctgcaataagacatgaggaatggtagcaaataagggctccgctgagtccatccatcatccgtgtatgattggctttcttctcgtgttttgttcatgatttgtgtcagaaacctaggtggcatctagtctggtttatgtattgccagtgctgttgtgtagaaaaatctccgtcgatattctaagctttttggttagaaaggtgcgctcttcattgtccttgacggaactcggggtagatgaacat

SEQ ID NO: 71156 - DNA, 463 bp, Zea mays
  Clone ID: LIB3078-023-Q1-K1-H9
ccgagcctgcccagctgctctcatttctctctgcctctcgcgctgggcgggccgtcttgggggctgtcaaggtctccagccgagctcctccctgccgcagccaccacatgggcgctcatctccctactccatggcggcacctcctactccgtggtagcgagctcgcccctgtattcctgctcgcccagccctactctgctgatagccggtggccgacgacgtcgatttcagctccctggacgtgcgcccctgatccccatgtcccagctcctccccacctcctacatggtcggcgccatccccagcgctccctgctccagcacgtgtccatggccgtcaagtccctcccatggtcgagcacgtccctgcgttccgatgttggacaccggactgcgctgctcgtcctcaacctcgctgatgctattttactggtgcatgtcctcgccctacgccattgaacaac

SEQ ID NO: 71157 - DNA, 378 bp, Zea mays
  Clone ID: LIB3078-024-Q1-K1-A1
gcggcacggctttcccggcggatgatccgtcagtggacgtgcagacggaggaggcccggctgaagacggcgacgatgatccagcaggcgaggacgatggcggacggcaagaagctgggcgacgcgcgggacaagctggcggaggcccagaacgcgctggaggacgtggtggcgcagtccgacccgctgctggacgccctcaggacggagctgcaggagctactgaagctgatgaagtcgcaggacgtgtacgagaagcagggccggccctacgccatgtcgtcggagacgtcgcacgacaggcagcggttcgcggcgaggggcgacatcgagagcaatcgcctcttctcgacgccgcgcatggacaagtacctggagc

SEQ ID NO: 71158 - DNA, 330 bp, Zea mays
  Clone ID: LIB3078-024-Q1-K1-A10
agcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcggcgacaagtacagcgcgaacgttgactgatacagcccaatctacaacgaggatgactg

SEQ ID NO: 71159 - DNA, 326 bp, Zea mays
  Clone ID: LIB3078-024-Q1-K1-A11
ccggttcggaatcgacgccacgcgtccggtgacgcgtgcgtgctagagatgaccctgtgcgacagtcaccacgtctgctctgctcagagaatcacgtgccagtcgtgaccatgctcacaattctttacccaccgtactcagaacattctagggagacgctggcctatatgaaacttgatccataatcagtctcagaacgcgaagaagaagtggaagtccctggggcgacgacaacaccacattttgagtctcacgcatggtctcacttctactttagcatatgcgggcctgagactaactcatacataagcaaaggtgcggcagcg

SEQ ID NO: 71160 - DNA, 316 bp, Zea mays
  Clone ID: LIB3078-024-Q1-K1-A12
gcgctagctgaggacggtacagcggcacagaggtgctacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggcgacggccgggct

SEQ ID NO: 71161 - DNA, 200 bp, Zea mays
  Clone ID: LIB3078-024-Q1-K1-A2
aggcgacgattatggggccatcagatagcccatacgctggtggcgtatttttggtcactgttcagtttccaccggactacgcattcaaaccaccgaaagttgcattcaagacgaagggttaccacccgaatatcaacagcaacgggagcatctggcttgatatcttgaaagagcaatggagccctgcactgaccggttct

SEQ ID NO: 71162 - DNA, 57 bp, Zea mays
  Clone ID: LIB3078-024-Q1-K1-A3
tgagttatttgataacggcgaaatcgatctgctatctccataacggcatacaattct

SEQ ID NO: 71163 - DNA, 76 bp, Zea mays
  Clone ID: LIB3078-024-Q1-K1-A5
cctttccgtgtggctggtaatcctttccttcttcaagatcgccatcaacaacggcgtaaggaacttacaattattc

SEQ ID NO: 71164 - DNA, 343 bp, Zea mays
  Clone ID: LIB3078-024-Q1-K1-A6
cgcaaggactcgcgacggacggagcaacggaggaagcaactacgcggcagccatggtgaacgttccgaaaaccaagaagacctactgtaagaacaaggaatgcaagaagcacaccctgcacaaggttacccagtacaagaaaggtaaggatagcctttcagctcaagggaagcgacgttatgaccgcaaacagtctggatatggtggtcagacaaagcctgttttccacaagaaggcgaaaacaacaaagaagattgtgctgaagctgcagtgccagagcttgaagcactactctcaacacccgatcaagaagtgcaagcactttgagatcggtggtgacaag

SEQ ID NO: 71165 - DNA, 410 bp, Zea mays
  unsure at all n locations
  Clone ID: LIB3078-024-Q1-K1-A7
tcgtgctcatgggtgccgtcgagggctaccgcattgccggcgggccgctcggcgaggtcgtcgacccgctgtaccctggcggcagcttcgaccccctcggcctggccgacgaccccgaggccttcgccgagctcaaggtgaaggagctcaagaacggccgcctcgccatgttttccatgttcggcttcttcgtccaggccatcgtcaccggcaagggcccgctcgagaacctcgctgaccacatcgctgacccagtcaacaacaacgcatgggcctacgccaccaacttcgtccccggcaactaagctcaacggctatgctatgcaacttcattgtctttcggatcgganagggtgtacgtacgtggattgattgatgctgcnagatgcatgtgtgtcttttggttcacg

SEQ ID NO: 71166 - DNA, 455 bp, Zea mays
  Clone ID: LIB3078-024-Q1-K1-A8
cccacgcgtccgcgccgcggcagtgccgcatgccggcgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggagccaactttgcgcgcgcctacaccgtggagttcggcagctgccagttcccctacaacttcactgggtgccaggaccttgccaagcataagaaagtccccttcatcagcgacgacctcgaaattgagtgcgaggggaatgagaagttcaagtgcggctccaacgttttctggaagtggtgaagcatctagcagcagcgtctgatgggaatggaggagatcatca

SEQ ID NO: 71167 - DNA, 456 bp, Zea mays
  unsure at all n locations
  Clone ID: LIB3078-023-Q1-K1-H3
agtcaccactcccaagccagtaccgagtcctacgagcagtcgcacgcaagtgtcaagagacgaaacggtcgacatggctcgcacgcaatctgccgtagcggtcgccgtggtgggcgcggtgctgctgctggcagcggcngcgacgacctcggaggccgncatcacctgcgggcaggtgagctccggcatcgcgccctggctcttctacgcccgcggcacggggtccgnccccttcgcgtnctgctgtagcggcgtcaggaacctcaagagcgccgncagcaccgncgncgacaggcgcgccgnctgcaactgcctcaagaacgccgnncagggcgtcagcggnctcaacgccggaacgccgncagcatcctctcaagtgcggcgtcagcatccnctacaccatcagcaccttcaccgactgcttccaggtgaactaaaacctagaccacgcgcgac

SEQ ID NO: 71168 - DNA, 212 bp, Zea mays
  Clone ID: LIB3078-024-Q1-K1-A9
gtgagcgtgtcaacactgatgaaggcgattatgatttgtgagcttgccccatgtgatgggactgttgcctacaatcgtagtgtaatgtgctggtattctcgaatgccatatcccatagtctgccatggcttggaataacatagtgtctgactgatatgtcacgaggcactttatgtagtacttacagaactactacaatgttgtactataca

SEQ ID NO: 71169 - DNA, 230 bp, Zea mays
  Clone ID: LIB3078-024-Q1-K1-B1
tcgcggtcgtcttctcgctattcgtcgccgttttcgaaaccgaatgggggttcatcatccgtgtctggaaaaatatttgaatactggcctgcacggggaatgctccaaatctttggtgctgtcatgacgaaggcatacccaagtattgaaaggaatgatctcaaattgctccaggagattgccagctacatgcttcttgcatgtggagctgtctatgttgtctcggggat

SEQ ID NO: 71170 - DNA, 332 bp, Zea mays
  Clone ID: LIB3078-024-Q1-K1-B10
gacccacgcgtccggatttacggaaggccatggaaggtcttctcgaacccgctgaggaggaagtaccaattggttcggcaaaagttcgagctgtctttagtagtggcagtggaaaggtggccggatgcatgattacaacaggaaaagttgttcaagattgtaatgtgcgggttattcgtaaagggaaagaagtatacgtgggttcgcttgattccttgagaagggtgaaagaaactgtgaaggaggttggtgctgggctagagtgtggtattggggtagatgacttctatgaatgtgaggaaagtgacatcatagatgcattcaataccgtg

SEQ ID NO: 71171 - DNA, 308 bp, Zea mays
  Clone ID: LIB3078-023-Q1-K1-G10
cacacacgtgtgctctctctcgtccggtgttcagctggaccacgcttggcgatcattagggcgacatcctgaggtccttgggcgaccacctactcatcagacgttacacactattcgtctatcactatcttgttcgtttaaaggtgatcacattaactgtcaaacttcacactaatgattaagtcgtgatcctagtatagcctggacagcatacatttgccaatctaatgactgtctatactatcttacaaggagacaagatctcctcctccatcactacttcgacaccgacaatatagaccaactac

SEQ ID NO: 71172 - DNA, 463 bp, Zea mays
  Clone ID: LIB3078-023-Q1-K1-G11
cggacgcgtgggctctggtggttttgagcgagtatttgaggtcggccctgtgtttagaggagaaaattcaaacacacacaggcatctatgtgagttcgttggtcttgatgctgaaatggagattaaggagcattattttgaggtctgtgacattatagatggcttattcgtatcaatatttaaacacttgtctgaaaactgcaagaaagaactcgaatcaataaacaggcagtatccatttgaacctctgaagtatctagacaaaaccttgaagctcacttatgaagaaggaattcaaatgttgaaggaagccggaacagaaatcgagcctatgggtgacctcaataccgaagctgagaaaaaacttggtcggcttgtcagggaaaagtatgacacagattttttcatcctgtatcggtatcctttggctgtacgtccgttctacaccatgccttgttatgac

SEQ ID NO: 71173 - DNA, 431 bp, Zea mays
  Clone ID: LIB3078-023-Q1-K1-G12
cccacgcgtacacacacgcgtgcgcggagacccgttcggatcatacagggacccagccagagctacgaagagtgcaagctcaaggagatcaagaacggtcggctcgccatgctggacatcgcacgcttacgattccaacatacggacatccctatctccgtgcctctcgataaccttggcggccagctctgcgaacgctgtcacaacaacatgctgagacatgcatcatccctagatcgatctgccatggacaggaacacaggacgattattactactaggcactacgcactgactgcctacatgcaggagcagctcaacgacgacgactgcgaatctaggacttccgtcccctccggaaagctctgcgcatgtaaaggaaaaggaaattggaaccatgtagcgcacttatagcatgcatgacagcaatcg

SEQ ID NO: 71174 - DNA, 399 bp, Zea mays
  Clone ID: LIB3078-023-Q1-K1-G2
cccacgcgtccgcccacgcgttcgcccactcgtccgctccgccgcttgcccgcttttgcgctctgcctcccggctctcggcttcttctacacgctaccgtctcacagccgtaaacgcccctcccggatcccgctagttcgccaccgccgcccgcccgcccgccgttcgcctcatcatggccgcctcgtcgaccggcacctccgtccacgacttcatcgtcaaggatgcgagcggcaaagacgttgacctcagcacctacaaggggaaggttcttctcattgttaacgtcgcatcccagtgtggcttaactaactccaactacactgagctggcccagctctacgagaagtacaaggaccaaggctttgaaatcctggcttttccatgcaacctagttgg

SEQ ID NO: 71175 - DNA, 451 bp, Zea mays
  Clone ID: LIB3078-023-Q1-K1-G3
ccgctgccgtttcttctcgagtgtgaccatggcggctcagggatccctcgtcatgtggagggcggtcttcgcagcgctgggcttgctcatggtggccacgctggtgtacaccttggccaccgacggctcgccgttccgccttgagctgtttacgccgtggatggtggcaacactggctgatttttatgttaatgttattgcaatctcggcttgggttatctacaaggaagcaaactgggttagttctgctgtgtgggtggttctgttgttttgctttggcagtgctgtcacttgcgcttatattgttaagaaacttcttgaagtaacatctgcagggtcatcccaagatcctcttgaccttctatttatcaggcaaggtaatctatcccaaagaaagtgctcttatgttgtaattggaagggttattttcagcattttggggatattcatg

SEQ ID NO: 71176 - DNA, 291 bp, Zea mays
  Clone ID: LIB3078-023-Q1-K1-G4
cccacgcgtccggcgacgacctcgagattgagtgcgaggggaaggagaagttcaagtgcggctccaacgttttctggaagtggtgaagcagctagcagcagcgtctgatgggaatggaggagatcatcacctgtcttgtcgaccctagatatgtccaaactgcagggaaattaaatcttcatgtgtaattgtgctcattctgtttcaatcatctcaacatccgatcatgaacctcttgcattattaactggctcgatcgtcttctcagtttaagacgttggaggctgcttt

SEQ ID NO: 71177 - DNA, 452 bp, Zea mays
  Clone ID: LIB3078-023-Q1-K1-G6
ccgcgtgcgaaccaagcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaacctggagttgtcatccgaggaaagaagggcactggaggcattactatcaagaaaactggcatgtccttgattatcggtatctatgatgagccaatgactccagggcaatgcaatatggtggtggaaaggctcggcgattacct

SEQ ID NO: 71178 - DNA, 424 bp, Zea mays
  unsure at all n locations
  Clone ID: LIB3078-023-Q1-K1-G7
cggacgcgtgggcagaagaccaagctcatgacccgcctcacgtacacgctggacgagatcgagggcccgctcgaggtcggctccgacggcacgctcaagttcgaggagaaggacggcatcgactacgccgccgtcaccgtgcagctcccggggggcgagcgcgtgccgttcctcttcaccgtcaagcagctcgtcgccaccggcaagcccgagagcttcggcgggcccttcctcgtgcccagctaccgtggctcctccttcctcgaccccaagggccgcggcggctccaccggctacgacaacgccgtcgcgctccccgccgggggcagaagtgacgaggaggagctccagaaggagaacatcaagaacgccgnctnctncaccggcaacatcacgttgagcgtcaccaaaagcaacccggaga

SEQ ID NO: 71179 - DNA, 451 bp, Zea mays
  unsure at all n locations
  Clone ID: LIB3078-023-Q1-K1-G8
gcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgtcggcgtcaccggacctnctgccgatcaagaagggacctcaggagccgccgcagccgggcccgcgcggcaggatctaagct

SEQ ID NO: 71180 - DNA, 470 bp, Zea mays
  Clone ID: LIB3078-023-Q1-K1-G9
cggacgcgtgcgctatcaccttggaggtgtacagctctgacaccattgagaatgtgaagggcaagatccaggacaaggagggcattcccccagaccagcagcgtctgatctttgcgggcaagcagctggaggatggccgcactctcgcggactacaacatccagaaggagagcacccttcaccttgttctccgcctcaggggtggtatgcagatctttgtgaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccctagcagactacaacatccaaaaggagagcacccttcaccttgtgctccgtctccgtggtggtcaataagtcatgggtcgtttaagctgccgatgtgcc

SEQ ID NO: 71181 - DNA, 467 bp, Zea mays
  unsure at all n locations
  Clone ID: LIB3078-023-Q1-K1-H10
gggcagggcgccgcggagaagaggaggcccagcgctctacgtccgccatggcgggctctgccgaccccgacaagctcatgaacaaagccgacaaactgtaattaggcttgcacggaagctaccaacaggtgatctgcaggccatcaagaaagctgacgatggcgaggaatccttggacgagaatgacctgacttaaaacgatctcccgagccaaaaggtgcagagaacaaacgtcatagtttgccatcggtgggggaacatctgtaaaaagaagttatgcgagttacgtactaaaaacttgtgggcaacattcccatatctataaacatgaaatttgtagggcccaattatgttgtatccgtactggtggtttggtcatttggtgttaccgaaacagcgaaactntagtggtatgtttatggtgtcctgtgctacatgattcttgcaaatcgagcatggtgtaaaat

SEQ ID NO: 71182 - DNA, 467 bp, Zea mays
  Clone ID: LIB3078-023-Q1-K1-H11
gaccatcgcgcaccagtttttaggcagcccttcgctctacgaccaccagggcgctatctggagggctctaggcgctcatcaacgctcccaaccaactgtaattagccttgcacggaagctaccaacaggtgatctgtataccatcaagaaagatgacaatggccaggaatacttggacgacaatgacctgacttataacgatctgccgatccaacaggcgcagagaacagaccacatactatgccatctgctgtggaacatctgtcaaaagaagttatgccagttacatactaaaaacttgtggccaacattcccatatctataaacatgacatcagtagggcccaattatgttgcatccgtactggtggtttgatcatttgcagttaccgaaacagcgaaactttaatggtatgtttatggagtactgtgctacatgactcttgcatatcgagcatggtgtaaaat

SEQ ID NO: 71183 - DNA, 464 bp, Zea mays
  Clone ID: LIB3078-023-Q1-K1-H12
gccgacacggcggcttactatccagatggcacacatgaaggtaaccctgagcaccatgggccgccgttactccgctggacagctcctcagggtgaacatatacagacaccatctcgccatgcccgcagccatcatcatccgccagcgcagcgccagggtctatcctgaatataacgtcggaatggtcatggatcacacactcttctctttgatagacggactcctcaagttcgagatgtatcggcctatcatgaagaacgtttgtgtttacccatatgagaaggtgcctgataacccatactggtacagagcaaggaatagagagtacttccgcatgcagagtctacggatgaacgcgacatcctaaggcgccgctgatcctgagttgatactagctgctgccgatgaaaactctgaagtcatcgcgtactgttgataagtttcctgtgtggtgcttctctttt

SEQ ID NO: 71184 - DNA, 455 bp, Zea mays
  Clone ID: LIB3078-023-Q1-K1-H2
tctatccgtactttgtaacagacagtgagaaaatgtctgccgagtatgagaactgcaagctacttttggttgacaaaaagatcaccaacgcaagggatcttatcaatgttttggaagaagccatcagaggtggatacccaatcctgataattgctgaggatattgagcaggaggctcttgctacccttgttgtcaacaagctcagaggatcattgaagattgctgccatcaaagcccctggttttggagagcgcaagactcagtacttggatgatattgccatccttactggagcaactgtaatcagagatgaagttgggctgtcacttgacaaggctgacaaatcagtccttggaacagcagcaaaggttgtccttactaaagagtcgacaacaattgttggtgatggcagcacccaggacgaagttactaagaaggttgcacagattaaaaat

SEQ ID NO: 71185 - DNA, 353 bp, Zea mays
  Clone ID: LIB3078-023-Q1-K1-G1
gatcctctgagggtggactgctgacagacgcagatggacagccgtgatacacacttgtagtgttgggtgagattgagaaagcagcaccctgatgtcttcaacatgatgcttgatagtctgggagatgggagattgactgaccgcaaggtaaggacggtggatttcattaacacacttctgatcatgacctcaaatgtacgaagcagtgtcatcgagaatggtgcacggtagatcggatttcaccattgctctgatgagaatgacagtgagttcagcaggatcatgagcctgcacatggacgagatgaagcattgtctacgacctgaagtccttaaccgtcttgatgagatgat

SEQ ID NO: 71186 - DNA, 426 bp, Zea mays
  Clone ID: LIB3078-023-Q1-K1-E4
cgccaccgttcatgtgcccacgaccgccaccatgcatgtaccggaggtggtaatggagataaaagttgatatacacggtgtgcatgtgtttgtgccaaagcttctcgtacgtggtgttcgagtttctgtcaccccaaataagaaccgagctcttctccggatagaactatcttcacagggttccctgttcaagttaggatggcacgcatcatcatatctcggaaggaagccctcggggagtcttctccatgtatgggtggagttttgaaagaagtcattatattattgctagttcttgttccctactagatgttctcgttgatgcgtggattttatacgtgtacttgttctcttgtgctttccaccggccctgatgtcgtcccgttgtaaccgatgttcgtttgtgtttcaatgtgtctttggttt

SEQ ID NO: 71187 - DNA, 451 bp, Zea mays
  Clone ID: LIB3078-023-Q1-K1-E5
cccacgcgtccggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcgtcctcaacacgcccttctggtacaccgtcggcgagcagcagtacttcaccgacaccaccaccctcttcatcatcgagctcatcctcatcggctgggccgagggccgccgctgggctgacatcatcaagcccggaagcgtcaacaccgaccccatcttccccagcaacaagctcaccggcaccgacg

SEQ ID NO: 71188 - DNA, 346 bp, Zea mays
  Clone ID: LIB3078-023-Q1-K1-E6
cggacagcgtggggctgaaagtacttatcgattcgaacggattccaacatgggttacggatgtcggatgcagacccgcaattgctgcgatgaacctatacctctcctcagcagataatagctctaataatcgctacttctcgattatcaatcctaagaacgcactgtcagacaggaacggtgtctgtaccaaatgcagcacatgccttatgggccaatttcaaagaatacatctctcttatactcgtcacactcgagctttgccaaaacgtgcaggccacgttgcgtcttcgagctgtgtcatgcctgtgactgaagagaacgtggagagagtgctcgacgaagta

SEQ ID NO: 71189 - DNA, 438 bp, Zea mays
  Clone ID: LIB3078-023-Q1-K1-E7
tgagttcagggtggagacaaacaggaggagctggaaaagctacagaaggaagagaaagagcgcttgttggctgaaggtactgcagccatggaggcttgtagagccgaagctgaagctgaaaagaagcgtaaacggaattttgagagggagaaggctcgtcaggccctacaggagatggagagaactgtagaaattaatgataacctccatctcaaggatttggaattgcttggaacagccacaacagaacatattgtaagctctgttgatgagactagtccagaacgctctcatgatggcatggccggctatcatccaggagctgtcaatcctttggagcaacttggactgttcataaaggtagacgatgaggaagacgacgagcagtgttccctgcattaaagaaagcagagaaaggagaaatcagctgatggtgct

SEQ ID NO: 71190 - DNA, 448 bp, Zea mays
  Clone ID: LIB3078-023-Q1-K1-E8
agtcctcaggttctgcagttccgatggttcttgtaatcaacaaggtagattgtgcgccatttgttcctggagaacagttcaaacaattcagtggcctcttcagaaaacacgtacagacatgtgcagtcaccggtaaaggcatttctgatttggagagcgctgtaatagaggtcaggggtattgagcatgtgccttctgagggacgaaggtggaccgtaaatcagaggcaatttgaacagctgttgaggactaaagaagctttcgcacgtctagagtcatcaatcaacgagcagttaccaatggacttttggactgtggacttgaaggaagctgcgcttgcccttgcaacaatcagcggggaggacatctccgaagaagttttgagtagcatattcagcaaattctgcatcgggaaatgatctcgcaagatgctgcatccagtagtttg

SEQ ID NO: 71191 - DNA, 451 bp, Zea mays
  Clone ID: LIB3078-023-Q1-K1-F1
cccacgcgtccgcccacgcgtccgtgcaaagttccctgtgatgctctttcatcctaaggaacagacacaatcctaaggatggaaatacttaaatccagacttgggctaggaacagatgatgctccgcccgggtcaattaaggattggatgcgtatgtaggcctgttgatcaaggactatcttatctagccacatgccctgagaatgggacagggtaagcttgaacccggctattccatacatgaaaagacaatcgcgcactgggcgtggagagatggcgagagtggcacgtaccctcctggcaacggatcgcctaaaaggggtggtgtactctcgggtggcgcggacctgttcatgcagtggaggatccgtgggaatagtagacatcaaggtttacgagtaacatatgtcgtgtggttagaaatcctcagctgagtaaatcgattcggatc

SEQ ID NO: 71192 - DNA, 462 bp, Zea mays
  unsure at all n locations
  Clone ID: LIB3078-023-Q1-K1-F10
cggacgcgtgggcgccgacgccgcgccgccgcagcaattgtcaccgtcgctatggcccggatcaaggtgcacgagctccgggggaagagcaagacggacctgcaggcgcagctcaaggagctgaagtctgagctctccctcctccgcgtagccaaggtcaccggcggcgcacccaacaagctctccaagatcaaggtggtgcgcacctcgatcgcgcgcgtgctcacagtgatctcgcagaagcagaagtcggcgttgcgggaggcgtacaagaagaagaacctgctccccctcgacctccgccctaagaagacccgtgccatccgccgccgtctgaccaagcaccagctctctctgaagaccgagagggaaaagaagcgtgagaagtacttccccatgaggaagtatgctatcaaggcctangtcagaactgtgagatgctgcgcttagcatatcatcggc

SEQ ID NO: 71193 - DNA, 296 bp, Zea mays
  unsure at all n locations
  Clone ID: LIB3078-023-Q1-K1-F2
cccacgcgtccggacccacgcgtncgcccacgcgtccggtgcgtgtggcgttcgcgtacgtgcgcggngcagtcgggtactctgttgccgcgcgcggcagctcagtggcgcgttcatgccgtgcatgatgcgggtgacgtgcgggatgggcacgtcgctgcctgagaagctcgcaccgttggcgttcgtgtggctgcagaaaggtcgtcttggattgtaattctctctacttatttttgtaaattgacccagaaaagctgctgcttgcagcgccaaaaaaaaaaacgattttcatc

SEQ ID NO: 71194 - DNA, 364 bp, Zea mays
  Clone ID: LIB3078-023-Q1-K1-F4
cggacgcgtgggtcaagactggagctgagtgaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcaggtgctacgtgataacttgaccctatggacttctgacatctcgtaggaccctgcttaatagattaaggaggcactcaagcgcgactcgag

SEQ ID NO: 71195 - DNA, 454 bp, Zea mays
  Clone ID: LIB3078-023-Q1-K1-F5
cccacgcgtgcgtggacgcttgggtgagatgtgggttggcttctgctcctgcaccggttcgggttcaggttctagatcgaggacgagacggaagagatggctgagtccgacgtctagtaccgctgcttcgttggcggcatcgactgggccaccgtcgaccactccttcaacaactccttcaacacctacggctaggtcatcatgtcgaatatcatgatgcatcggtagactcataggtgctgcggcttctgcttcatgacctactccacgcacgacgcgatgcacagcgtcatcgagggcatgaacggcaaggagctcatcagccgtaacatcaccgataacgaggcccagtcccgaggcggtcgtggaggctgcggtggcggataccgtgacggacgccgttacggaggcggctacggaggtctcggtggaggctacggcggttgtcgtggaa

SEQ ID NO: 71196 - DNA, 450 bp, Zea mays
  unsure at all n locations
  Clone ID: LIB3078-023-Q1-K1-F6
gaagacaacccgtcagcccctctcgtttttcatccgccttcgcctccaaccgcgtgcgctccacgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtcattcagctccaaggtgatcagcgcangaatgttgctacttt

SEQ ID NO: 71197 - DNA, 432 bp, Zea mays
  Clone ID: LIB3078-023-Q1-K1-F7
acgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacaaggcgaccggggaggccatcaagcactcgctggggcagtcccacccggtgcgcctggtgccctacaacccggactttttggacgagtcggtgctgtggacggagagccgcgacgtcggcaacggcttccgctgcgtccgcatggtcaacaacatctacctcaacttcgacgccctccacggcgacaagtggcacg

SEQ ID NO: 71198 - DNA, 448 bp, Zea mays
  Clone ID: LIB3078-023-Q1-K1-F8
gtcaagaccatcaagatcggagccccgccgccgccctccggtggactccccgggactctgaactctgaccaggcgagggacttcgacctccccttgaaggagcggttctacctgcagccgctgccgccggcggaggcggtggcgagggtgaagacgtcggcgcaggacatcatcaacctcaagccactcatcgacaagaaggcgtggccgtacgtccagaacgacctccgcctccgggcctcctacctgcgctacgacctcaagaccgtcatcgcttccaagcccaaggaggagaagcagagcctcaaggagctcaccggcaagctcttcagcaccatcgacgatcttgaccatgccgcaaagatcaagagcaccccggaggccgagaaatacttcgcagcaaccaaagatgcgctcggcgacgtcctcgccaagctagcctagatgg

SEQ ID NO: 71199 - DNA, 422 bp, Zea mays
  Clone ID: LIB3078-023-Q1-K1-F9
gacgcgcgcgcgtgcggggtcgaccgccacctggccggcgggcggaggcacgtcgtgccggggcaggagcgcggctggaagaacgtcttcaaggtgcggcccagcgcggtaaccaggatcctcgtgcgcttcaagccgctcacagacgccgcgtcgccggaggagagccgcttccccttcgacgtcaccactggtccgggttacgtgtaccattgccacattttggaccacgaggacaacgagatgatgaggccgatgaagattgtgcgttgaacggtttccaggaagaaaaacatatattctatgaatgattccgtatcgcaaaagaaacgacatgtttactgtgtctttcccattaatgatttaagcaggaagaacttttagatgattgaacttttcagttaatatagcatttgtcgagt

SEQ ID NO: 71200 - DNA, 132 bp, Zea mays
  Clone ID: LIB3078-023-Q1-K1-E3
ggtttaactcttgattagctttgaaattgggagggcacttaagatggtcgagctttataaggaccaggggaaagcctttttcttggaaatggccctaccttacccttggaaggaacttatccggattattaa

SEQ ID NO: 71201 - DNA, 70 bp, Zea mays
  Clone ID: LIB3078-023-Q1-K1-D10
ccaagtctctgcacacctttaaaatcaggttctactcatactacaacgggagatcatgggcgcactttca

SEQ ID NO: 71202 - DNA, 455 bp, Zea mays
  Clone ID: LIB3078-023-Q1-K1-D11
cccacgcgtccggcagcagcaggcggcgcctaggagcggcatcccactgagtgcttgcggccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccccaagacaatggagaactacaggctgctttatgacaccaagggccgcttccgtcttcacccaatcagggatgaggatgccaagttcaagctctgcaaggtgaggtctgttcagttt

SEQ ID NO: 71203 - DNA, 228 bp, Zea mays
  Clone ID: LIB3078-023-Q1-K1-D12
cccactcgttcgttcgctctcaacgccgtctagttccgcgaggccacgggggtcaatgggggctctcagaggttcagagagggccttctgaaatacctcgataacccgagcctcattcacgcgcagagcatccttgccatctgggcctaccacttcattctcatccgcgccctccaggctacgccatctccttttacccacatcctcgagctctgctaccaatctacc

SEQ ID NO: 71204 - DNA, 366 bp, Zea mays
  unsure at all n locations
  Clone ID: LIB3078-023-Q1-K1-D2
gcccgacctcaggaagaaggtgatgcccgtcgtcatcgtccgccagcgcaagccgtggcgcctcatggacggngtctacatgtacttcgaagataatgctggagtgattgtgaatcccaagggtgagatgaaaggttccgctatcactggacctatcggcaaggagtgtgctgatctttggcctaggattgctagcgcagcaaacgccattgtttgagagcttgttggaatatgttcagacttctatatgatcatcttattatcagctgctagactgcaattgggcttatgtttgttcactcaattttgtaggaaacagaatttggtataccaaggggatctatatgacaatgtatgccataaaaa

SEQ ID NO: 71205 - DNA, 448 bp, Zea mays
  unsure at all n locations
  Clone ID: LIB3078-023-Q1-K1-D3
aggaatcttacccttaccaaggtgtcaatggaatctgcaagtttaagaatgagaatgttggagtcaaggttttggactcggttaacatcaccctgagtgctgaggatgaactgaaggatgctgttggtctggttcgcccagttagtgttgccttcgaggtgatcactggtttcaggctgtacaagagcggagtttacactagcgaccattgtggaactacaccgatggatgtgaaccacgctgttctggctgttggctacggtgtcgaagatggtgtcccctactggctcatcaagaactcatggggcgctgactggggtgatgatggttacttcaagatggaaatgggcaagaacatgtgcggtgttgctacgtgtgcatnctaccctattgtcgcatgaggcccttacgaaatgttacatggtctgtttggcatcaataatgcatg

SEQ ID NO: 71206 - DNA, 439 bp, Zea mays
  Clone ID: LIB3078-023-Q1-K1-D4
cagcatgctgcgtcgcatgtatgaaactgttcaagagcctgttctgaatgctacaacaatgggtagcgagggtgagcgaaattcgaatccatttgctgcacttctaggaaatcaggggtctaaccaagcaagagactcatctgcaaatggaacaactacagcttcagacaccacatcaggggctccagctccatatactaatgcacttccgaatccttggggtccaaatgcaagatcccctcctgctaccaacactaggagtactacagcaggtggcccaggagggttgggttcagcagattttggaagtactattggtgccagtggtggtggctatgatgctaccttcttgactcaagttttgcaaaacccaactatgatgcaaatgatgcagtacattatgtctaatcctgagttcatgaatcagctgcttaatatg

SEQ ID NO: 71207 - DNA, 307 bp, Zea mays
  Clone ID: LIB3078-023-Q1-K1-D5
cccacgcgtccgcccacgcgtccgttcatgtaaagcatctgagtggaagagaagagaactgcaggttgaaagtggagaatgaaatgctgaaggaggaaaacaataggcttattaggcaggaacagagcaatgctcctgcccctgctccctgtcccagatgcattaatgatgcggtgcacctactgctcgagaaagaagttgaacggctgaaggctgcttaaccagatgctgcaccaagagttgcagctacaaggctcggatggcgaaactcatatctcttcttgactcgctcagagcttatcatggc

SEQ ID NO: 71208 - DNA, 449 bp, Zea mays
  Clone ID: LIB3078-023-Q1-K1-D6
ggacgatgatgaggtcgtagtcaaccatacctatggggttgatggacacattcggttggctaagcgaatggtgagtatgtagtattctgttttactcagaaatgaaacaggattgaactcatatatttgcaggaggctcaaactggagttgtcccgagcccaatcgatgtttataggagagggcatcgagcgaaaaacagtgaaatctccgatgagctgtgtagtcaagcggccgttgagcgtatggagacatacgagcaggagatggttaagaagtatggagaagactacgattggcgaggagcgcctaccatcgacgctgaggttgtgcattcacttggcggcaaggcgcatggacgatattctatgtttaccggtgttatcgattcgacggagttgcgttctcgtggcggctcttcgtcgcaagcgggctgtggtagtagcagccg

SEQ ID NO: 71209 - DNA, 450 bp, Zea mays
  Clone ID: LIB3078-023-Q1-K1-D7
cggacgcgtgggctgttgagtatgcacttcgtgatgacgatgaaaaaggtgaaagagggagacgggtacagcccagacaggagaggtcgtgaaagatccccaggtagaaggcgttctcctagtccctacggtagaggacgggagagaggtagcccagattacgggagaagcaaggagagggggagcccagactatggcaggggaggacgcagccctgataatggcaggggagtaagcccagctggtggtggcagaggcgatcatgccaggggtggagggcgcagtcctgactatgatcgccagcgccgggaagctagtcctccaggttatgacaggtcccccagccgctcacctgggagggaggccagagagtagaagcagcgttccattccatgcctgtgttcaagcatcagatgaatgtgcaagttggtaatgttagccggcaggaaa

SEQ ID NO: 71210 - DNA, 451 bp, Zea mays
  unsure at all n locations
  Clone ID: LIB3078-023-Q1-K1-D8
ggcctcgcgaaagtagagagagaaccatcatgccagccaataacaaaaatggagttcgagtttgagcgaagaaaggtgaccaaagaggatgtcaaggaacttatattcagggagatattagagtatcatcctcaacttctcaaggattacatgaatggaactgagaaaacaaactttatatatcctagtgctgttgacaatttccgaaggcaatttgctaacttggaggaaaatggaggaaagagtgtggcgcacaccgcttcatcagacaggaagcatgtttcgctcccaaggacaaccacagttcattctaatccaatccctccaaatggaacctcccaagttccccgaaagattcccacaggtagaccaggaagagtggttggttcagtaataccatttgagaacgcaactgctgttgatccatacagccaacgcanggtggtgagga

SEQ ID NO: 71211 - DNA, 392 bp, Zea mays
  Clone ID: LIB3078-023-Q1-K1-D9
ccacgtacctgcgcacctacaagatcggctactacgtcgacgtcaaggttaacggctcggggcacaagggcatgccgcacaagttctaccacggccgcaccgggagcgtctggaacgtcaccaagcgcgccatcggcgtcgagatcaacatgcaggttaatggccgcatcatcaggaagcggatccatgtccgtgtggagcatgtgcagcccttccgttgcacagaggagttccgcctgaggaatgccaagaatgaccagctcaaggcggatgccaagctccgcggtgaggtgatcagcaccaagaggcatcccgcgggacccaaacctggcttcatggttgagggtgctacactcgagacagccactactactgctaatgatgagatcaac

SEQ ID NO: 71212 - DNA, 394 bp, Zea mays
  Clone ID: LIB3078-023-Q1-K1-E1
tcgccttatccacccgtcctgttcctgaacaccgtgacacacagacacaggtactagtactaccatatcatgtgacgtgcatgcggctgtgatgcacaccaacccagccatggccaaggcagctcctcctctcctcgccgccggcagccgcactgccatcacagcgcagcagccatcgtcgaggaaaggcgccgctggcgcaggtttgttctgcagtcgcgtcatcgtcagcaagcgcgccagggtaacagcgaagctcggagacggagagctgaagcctgcaggcaagcggaagttcatcaccaaggaagaggagccagaacagtactggcagaccgcgggggagagggaaggcgagaaccccatgatgacacccctgccctacatcatcatc

SEQ ID NO: 71213 - DNA, 460 bp, Zea mays
  Clone ID: LIB3078-023-Q1-K1-E10
agccactaggtttgctctgcacaagtgttggcacaccatcggtctgccagtagtgaccaggccggtcagtttggccatgtcgccgtggccaagacaactcagcaagagctccgagcagaaggagtgtaaattcaagacgaagtggttgtggaagaggagtttgctccagtgcctattcagcaagtggatggagctatctaactggttattgggtagaaaggtcttgagcctcttcactacaataaaggatggcggtgccgaagattgatagtccgaagcacgttccgaaggctgttgaagcttctcttaggcctgcctgtgtagagcttagtaacatttgtattaactttgtagaaaaaactgtaatcaaggattgaacaatgttatgtataactgtccataccttgtaatatatttttaccttttcatccatgtacaagttgctttgctgtggacgaaa

SEQ ID NO: 71214 - DNA, 454 bp, Zea mays
  Clone ID: LIB3078-023-Q1-K1-E11
gcacgccaggctcctcctccagctcctgttcgagatggtggtggctccatgtttggaggagttgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcatccattctaaggctttccaagattgtctcaacaactatggcagcgagatcagcaagtgccagttctacctagacatgctgaacgagtgccgccgtggtggtgtgtctgcctaagctgcctctggggttattcgtggattttctttcggtgatgctatctcattaataagataccgtgaaacttttgtctccacagcttgaagctaaacttcctgggattaataca

SEQ ID NO: 71215 - DNA, 465 bp, Zea mays
  Clone ID: LIB3078-023-Q1-K1-E12
ccctcgtccaagtatatcaacgtagcaaggtggtttaatcacattgatgcgctcgtgaggctgagcggaattactgcagagggccaaggtgtgaaggttgaatcctcagcagttccttcagccccaactccagatgttgctgaagcacaggccccagctgctgaggaggaggacgatgatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatggccaagcttgaggaagctgttaggagtgtccagatggaagggctgctctggggcgcatccaagcttgtcccagtcggatatggtatcaagaagctgcaaatcatgatgaccatagtcgacgatcttgtctctgtc

SEQ ID NO: 71216 - DNA, 399 bp, Zea mays
  unsure at all n locations
  Clone ID: LIB3078-023-Q1-K1-E2
tcgtagcgaatcggaccggggggctagggttccggtgcgcctctgcaatcggacgcgaggctaggctgggcatggagggaaccgctgcggcccggaagaggtcccggccggagacggcgaacggggctgccgccgccgggaagcgttccaaagacacggagtcatttcaaactgggctatcaagcaaatcgaagccttgcaccaagtttttcagtacgattgggtgcccgtttggcgagggatgtcattttctgcactttgtccctggtggttacgcggcagttgcaaaaatgctgaatctaagtagctctgctgtatctgcgccatcaagaactcatgtggatcatgccgctcttaccggggcctctcatncagcttctacgggtcaggacacgcatg

SEQ ID NO: 71217 - DNA, 455 bp, Zea mays
  Clone ID: LIB3078-023-Q1-K1-D1
atggagtcttgcattcagctgaaggaagttcaggacgatggggacaatgacgatgatgatgatggtgctgaagatgttgatgacaacgatgaagaggaagacaccgaagatgatgatgaggattcggacgacgacgacgatgcgagagaagaaacagaagaggaatttctggaaagatatgcactagcggcggctgcgggcgagtcagtcgaggaaggagacattgatgaagagacccaagacatcgaattgggctctctggatgacgtggacatacagcaggtggttattcccctgatgcagaaacttcctgctctgcagcccgccggagcgtttccggacagcctggttgaaagaattgcagaaacattcccggaatacgaacagtttttgcaagcccttcgacgagcttagagtataggaaacatgtgcagatttttctctttttggtatat

SEQ ID NO: 71218 - DNA, 432 bp, Zea mays
  Clone ID: LIB3078-026-Q1-K1-A11
acgagctccagctgtcggacgccgagaaggcccggatataccacttctacatccccgtcttcctgtggtgcgaggacgaggtcatggtgcacagagccaggtacaacgacggcgatgacatcccgccattggtgatcggggtcagcgctccccaaggaagtgggaagacgactcttgtgttcgcacttgattatctttttcgggttgctggtaggaattctgccacattgtctatagacgacttctatctgacagcaaaagaacagaatgaattgagggacagaaatcctgcaaatgctcttttagagttccgcgggaatgctggaagccacgatctgcaactctcagtggaaacactcgagtcactgatcaagctaacgaaggaaggtatgaagatgaaggttccacggtatgacaagtctgcgtttgggg

SEQ ID NO: 71219 - DNA, 414 bp, Zea mays
  unsure at all n locations
  Clone ID: LIB3078-026-Q1-K1-A12
nccacgcgtncggcgacgcgctccccgacacctgcaggctgctggtggcgaagaacacgctggtggggaaagccatcgagggtaccccctgggaggcgctcaagccgtgcatgaagggtatgaatgcctggctcttcgtccacactgaggaggtacccgcagcgctcaagccctaccgcgccttccagaaggaggagcgtgtcgaggagaccaacgacttcgtcggcgccgtctttgagggcaagttttacgggcccggcgacttcaaggcgctcgagactatgcccagccgcgcagaggtgtacgccacgctgctcggcgcgctgcagggacccgctacgtccctcgtcgccacgctgcangcgccagccagagatgttgttgcggtgctctccgnctacgtgcgcaagctcg

SEQ ID NO: 71220 - DNA, 110 bp, Zea mays
  Clone ID: LIB3078-026-Q1-K1-A2
ctttggcgttctagacgcccgggaagtagaatggacagacgaacaccaccagtgtgcagttcacatgactagagagaactatcgaccaagtgtgaattactgattcaagt

SEQ ID NO: 71221 - DNA, 397 bp, Zea mays
  Clone ID: LIB3078-026-Q1-K1-A3
gttctgctggtctttgatcatgactcgtggatgacgatctgaactctgacggtaccagggcacaagtttctttctgaaaaaaaaaattctcccattcgaactgtcttgtaaggctgagcaaaccatagtttctggactaactatgattgttacatgaattttattgccttcatgttagaacttagaatgcagcgtctatgaaacgactggtaatatgtggcctatcccatttcagaaacatttatgtaagttagtatgtgtcactttgaattaggagggtgaaatctgccatgataaccgaaaactgtaacccaagacaagagctttagtttgaagccagcaacaaaatcatagtaggatatgtgagatgtcatgcatttgactatgcctgacatct

SEQ ID NO: 71222 - DNA, 369 bp, Zea mays
  unsure at all n locations
  Clone ID: LIB3078-026-Q1-K1-A4
gggcaaggagctccaggacgccttcagggtcaagattcccaatgccgtgctcgggcaggggtacgggatgacggangcaggccccgtgctggcgatgtgcctggccttcgccaaggagccgtacccggtcaagtccgggtcgtgcggcaccgtggtgcggaacgcggagctgaagatcgtcgaccccgacaccggcgccgccctcggccggaaccagcccggcgagatctgcatccgcggngagcagatcatgaaaggttacctgaacgaccccgagtcgacgaagaacaccatcgaccaagacggcttgctgcacaccggagacattcgctacgtggacgacgacgacgagatcttcatcgtcgacag

SEQ ID NO: 71223 - DNA, 449 bp, Zea mays
  Clone ID: LIB3078-026-Q1-K1-A5
cgtctccacgcccgctcgctgccatctcctccccaagccgcggcggtgttgcgcgcgccgccacatcgagcgtcgggtggccgtcggcagcgacgtgtcttcgtcccatgacgtggctgccgaggaggccgctgctgcgcccaaggtcgggaagcgcgtgcgcgtcacggtgcccgtccgcgtccaccacgttgccaaggcgcccggcctggacctgcgcggcatggagggcgtcgtcaagcagtacatcggcgtttggaaggggaagcgcatcacggccaatctcccattcaaggtagagttcgagctcaagctggacggtcaggacaagccggtccggttcatcacccaccttcgcgagcaagagttcgagatcctcggggaggaatagagctctggactagagaataacgcgctctcatcggcggctgtggcatctgtatactatt

SEQ ID NO: 71224 - DNA, 458 bp, Zea mays
  unsure at all n locations
  Clone ID: LIB3078-026-Q1-K1-A6
ggacccggagcacgcgcagcggcacaagatcgaggagggcgtggcggcggtggctgccctgggcagcggcggcttcgcgttccacgagcaccacgacaagaaggaggccaaagacgcggcggaggacgccggggaggaggaggagtccggccgccgcggcgaggggaagaagaagcaccacttcttcggctgatcgggctgctgctcgatcgatctacttgcgtacgtaggctgctccccaggaccagaaggagcatgcatggagggcgaacgaagtcacgggggtttgattgcccgtctatgtatatcatgtgtagttactgatgatgtgtgtgcatggtacttcgtacgcgtgtttggtgatcgatgtgtggtgtgtgtgtctctgcatggacattntcctactctgcgttttttctctctctactgatatagtatatatgtggtgtgtctatata

SEQ ID NO: 71225 - DNA, 456 bp, Zea mays
  Clone ID: LIB3078-026-Q1-K1-A8
agtgcaagaagcacactctccacaaggttactcagtacaagaagggtaaggatagcctgtgtgcccagggaaagcgccgttatgaccgcaagcagtcaggatatggtggccagaccaagcctgtcttccacaagaaggccaagaccaccaagaaaatcgtgttgaagctgcagtgccagagctgcaagcactactcacagcacgcaattaagaggtgcaagcattttgagattggtggagacaagaagggcaagggaacatctctcttctaagtttctcatcacccatctcgatggtggatcgaagctgtgggtctactactgttctaaaaactcgtcaaatttcaatgttactagtagttctgaaagcaggtcatgctgtgtatcaaattccaatgcctgacatttgcactgaatgtgggttgtcttttggctaaatgaagttttgcaccctgaa

SEQ ID NO: 71226 - DNA, 426 bp, Zea mays
  Clone ID: LIB3078-026-Q1-K1-A9
cccacgcgtccgctcttccatcgcgccagtgttttgagaagctggtcggcgctcctagatgccttcgcctctctcgcgttcgaggctaggtagccgccaccatgagccgctcggggcagcctccggatctcaagaagtacatggacaagaagcttcagattaagctgaatgcaaaccgtgttgttattggcacacttcggggattcgaccagttcatgaatctggtgatcgacaacactgtggaggtcaatggaaatgacaagacagatattggaatggtggttatcaggggaaacagtgttgtcatgatcgaggcactggagctagttgccaagtcgcagtgaatccttatttttcagctgatatagtcgcagcatgaaaactgatgtaaatgctatgagtgaaccctgttgtacttcggactcg

SEQ ID NO: 71227 - DNA, 379 bp, Zea mays
  Clone ID: LIB3078-026-Q1-K1-B1
aatttgccaggaaggatatatgggctggtgggctgggacttagggtcttgtccttctttggtttcctttgtgctgttgctttaaagtttcttataatcatatggcatcttcttgcctcgctttatgatcacctaggaactgccttgccttggtgcctgagtaatctcgaatatatcgtatagatctttggtcttcagtactctaatgaagataagacaaattctcttgaaaatacaaatcttgtgatagtgaaatgaaattcattttgtttgtatggcatgatgagctacgtgatgctgtgctgcttggtttcgccaacaagcatgatcttcctaatgccatgaatgctgctgagatcacttgacagcttggattacac

SEQ ID NO: 71228 - DNA, 408 bp, Zea mays
  Clone ID: LIB3078-026-Q1-K1-B10
cccacgcgtccggcctgccttccccatccgcacctccgcgtcgtcgacaacctcgccaaggcccggcaccccaggctcatcaggaacgccgccgccgtcttcaccacaaccccctccacccttgtggccatgggcgacgccgtggagcacctcaagagcgggttccagaagttcaagaccgaggtgtatgacaagaagccggagctgttcgagcctctcaaggccggtcaggcccccaagtacatggtgttcgcctgctccgactcccgcgtgtgcccgtcggtgaccctgggcctgcagcccggcgaggccttcaccgtgcgcaacatcgccgccatggtcccggcctacgacaagaccaagtacaccggcatcgggtccgccatcgagtacgccgtgtgcgccctc

SEQ ID NO: 71229 - DNA, 393 bp, Zea mays
  Clone ID: LIB3078-026-Q1-K1-B11
ccgagctcgacccggagaagaggctgtaccccggcggctcctacttcgacccgctcggcctggcggccgaccctgagaagaaggagcggctgcagctggcggagatcaagcacgcgcgcctcgccatggtcgccttcctcggcttcgccgtgcaggccgccgccaccggcaaggggccgctcaacaactgggccacccacctgagcgacccgctccacactaccatcttcgacacgttcggagggtcctcttaagcccgccattgctccgccccgtccatcgaccggaacgtgttcttggattaattaactacgatctctatgagcctggggatggatcaacccgtcgtgcgtggtctcgttttgtgatgagtgggagagagaggatgacaag
